(12) United States Patent
Fontana et al.

(10) Patent No.: US 7,504,111 B2
(45) Date of Patent: Mar. 17, 2009

(54) GONOCOCCAL PROTEINS AND NUCLEIC ACIDS

(75) Inventors: Maria Rita Fontana, Siena (IT); Mariagrazia Pizza, Siena (IT); Vega Masiganani, Siena (IT); Elisabetta Monaci, Siena (IT)

(73) Assignee: Novartis Vaccines and Diagnostics S.R.L., Siena (IT)

( * ) Notice: Subject to any disclaimer, the term of this patent is extended or adjusted under 35 U.S.C. 154(b) by 392 days.

(21) Appl. No.: 10/467,657

(22) PCT Filed: Feb. 12, 2002

(86) PCT No.: PCT/IB02/02069

§ 371 (c)(1),
(2), (4) Date: Dec. 20, 2004

(87) PCT Pub. No.: WO02/079243

PCT Pub. Date: Oct. 10, 2002

(65) Prior Publication Data

US 2005/0260581 A1    Nov. 24, 2005

(30) Foreign Application Priority Data

Feb. 12, 2001    (GB) .................................... 0103424

(51) Int. Cl.
*A61K 39/095*    (2006.01)
*A61K 39/00*    (2006.01)
*C12P 21/04*    (2006.01)
*C07H 21/04*    (2006.01)
*C07K 14/00*    (2006.01)

(52) U.S. Cl. .............. 424/249.1; 424/234.1; 424/134.1; 530/350; 435/69.1; 435/69.7; 536/23.4; 536/23.7

(58) Field of Classification Search .............. 424/249.1, 424/134.1; 536/23.1, 23.7; 435/69.1, 69.7
See application file for complete search history.

(56) References Cited

FOREIGN PATENT DOCUMENTS

WO    WO9802547    1/1998
WO    WO 00 26375    5/2000

OTHER PUBLICATIONS

Zhan et al World Journal of Microbiology and Biotechnology, vol. 22, No. 7 / Jul. 2006, pp. 693-700.*
Nachamkin et al Infect ImmuMay 1981; 32(2):641-648.*
Bowie et al. Science, vol. 247: 1990; p. 1306; p. 1308.*
Tinsley et al., "Analysis of the genetic differences between *Nelsseria meningltldis* and *Neisseria gonorrhea*: Two closely related bacteria expressing two different pathogenicities'," *Proceedings Of The National Academy Of Sciences Of The USA*, vol. 93, (Oct. 1, 1996), pp. 11109-11114.
Pizza et al., "Identification of vaccine candidates against serogroup *B* meningococcus by whole-genome sequencing" *Science*, vol. 287, 2000, pp. 1816-1820.
Salzberg et al., "Microbial gene identification using interpolated Markov models," *Nucleic Acids Research*, vol. 26, 1998, pp. 544-548.
Klee et al., "Molecular and biological analysis of eight genetic Islands that distinguish *Neisseria meningitides* from the closely related pathogen *Neisseria gonorrhea*," *Infection and Immunity*, vol. 68, (Apr. 2004), pp. 2082-2095.
Heckels et al., "Vaccination against *gonorrhea*: The potential protective effect of immunization with a synthetic peptide containing a conserved epitope of gonococcal outer membrane protein IB," *Vaccine*, vol. 8, (Jun. 1, 1990), pp. 225-230.
Database EMBL 'Online! (Feb. 1, 1997), "Pilin gene Inverting protein homolog PivNG" retrieved from EBI, accession No. P72078 Database accession No. P72078.
Database EMBL 'Online! (Mar. 21, 2000), "*Nelsseria gonorrhea* ORF 122 protein sequence SEQ 10 No. 446" retrieved from EBI, accession No. AAY74485 Database accession No. AAY74485.
Database EMBL 'Online! (Oct. 1, 2000), "Hypothetical protein NMA2029" retrieved from EMBL, accession No. Q9JT17 Database accession No. Q9JT17.
Database EMBL 'Online! (May 1, 2000), "Trafficking protein B" retrieved from EMBL, accession No. Q9RF91 Database accession No. Q9RF91.
Database EMBL 'Online! (Nov. 1, 1999), "Hypothetical 12.2 kDa protein" retrieved from EBI, accession No. Q9XAZ8 Database accession No. Q9XAZ8.
Database EMBL 'Online! (Nov. 1, 1999), "DpcA protein precursor" retrieved from EBI, accession No. Q9XB00 Database accession No. Q9XB00.
Database EMBL 'Online! (Jul. 15, 1999), "Carbonic anhydrase precursor" retrieved from EBI, accession No. Q50940 Database accession No. Q50940.
Database EMBL 'Online! (Jan. 1, 1998), "Putative hemoglobin receptor component HpuA precursor" retrieved from EBI, accession No. 031179 Database accession No. 031179.
Database EMBL 'Online! (Oct. 1, 2000), "Putative integral membrane protein" retrieved from EBI, accession No. Q9JWE8 Database accession No. Q9JWE8.
Database EMBL 'Online! (Jul. 1, 1993), "Type III restriction enzyme NgoMIV (EC 3.1.21.4) (Endonuclease NgoMIV)(R.NgoMIV)" retrieved from EBI, accession No. P31032 Database accession No. P31032.
Database EMBL 'Online! (Oct. 1, 2000), "Hypothetical protein NMA0089" retrieved from EBI, accession No. Q9JX27 Database accession No. Q9JX27.

(Continued)

*Primary Examiner*—Robert B Mondesi
*Assistant Examiner*—Padma V Baskar
(74) *Attorney, Agent, or Firm*—Banner & Witcoff, Ltd.

(57) ABSTRACT

The invention provides proteins from gonococcus (*Neisseria gonorrhoeae*), including amino acid sequences, the corresponding nucleotide sequences, expression data, and serological data. The proteins are useful antigens for vaccines, immunogenic compositions, and/or diagnostics. They are also useful for distinguishing between gonococcus and meningococcus and, in particular, between gonococcus and serogroup B meningococcus.

2 Claims, No Drawings

OTHER PUBLICATIONS

Database EMBL 'Online! (Nov. 1, 1996), "NgoII cytosine methylase M.NgoII (EC 2.1.1.73)(Modified methylase) (Cytosine-specific methyl transferase)" retrieved from EMBL, accession No. Q59604 Database accession No. Q59604.

Database EMBL 'Online! (Oct. 25, 2000), "*Nelsseria meningitidis* BASB060 gene-encoded protein" retrieved from EBI, accession No. AAY95648 Database accession No. AAY95648.

Database EMBL 'Online! (Oct. 16, 2001), Stein et al., "Type II restriction enzyme NgoBI (EC 3.1.21.4) (Endonuclease NgoBNI HR. NgoBI)(R. NgoI)" retrieved from EBI, accession No. Q50973 Database accession No. Q50973.

Database EMBL 'Online! (Mar. 1, 2001), "DNA cytosine methyl transferase M.NgoMIII (EC 2.1.1.73) (Modification methylase) (Cytosine-specific methyl transferase)" retrieved from EMBL, accession No. Q9F658 Database accession No. Q9F658.

* cited by examiner

GONOCOCCAL PROTEINS AND NUCLEIC ACIDS

All documents cited herein are incorporated by reference in their entirety.

TECHNICAL FIELD

This invention relates to proteins from the bacterium *Neisseria gonorrhoeae*, and more particularly to such proteins which do not have corresponding homologs or orthologs in serogroup B *N. meningitidis*.

BACKGROUND ART

*Neisseria gonorrhoeae* is a bacterial pathogen. There is currently no effective vaccine against *N. gonorrhoeae* infection. It is an object of the invention to provide proteins and nucleic acid useful in vaccine study and/or manufacture.

*N. gonorrhoeae* is related to *N. meningitidis*. Sequence data are now available for serogroup B of meningococcus [e.g. WO99/24578; WO99/36544; WO99/57280; WO00/22430; WO00/66791; Tettelin et al. (2000) *Science* 287: 1809-1815] and also for serogroup A [Parkhill et al. (2000) *Nature* 404:502-506]. It is a further object of the invention to provide proteins and nucleic acid useful in distinguishing between gonococcus and meningococcus and, in particular, between gonococcus and serogroup B meningococcus.

DISCLOSURE OF THE INVENTION

The invention provides proteins comprising the *N. gonorrhoeae* amino acid sequences disclosed in the examples (the even-numbered SEQ IDS 2 to 8622). 159 of these have no homolog in serogroup B meningococcus and these have been given a name in the form "NGSn".

It also provides proteins comprising amino acid sequences having sequence identity to the *N. gonorrhoeae* amino acid sequences disclosed in the examples. Depending on the particular sequence, the degree of sequence identity is preferably greater than 50% (e.g. 60%, 70%, 80%, 90%, 95%, 99% or more). These proteins include homologs, orthologs, allelic variants and functional mutants. Typically, 50% identity or more between two proteins is considered to be an indication of functional equivalence. Identity between proteins is preferably determined by the Smith-Waterman homology search algorithm as implemented in the MPSRCH program (Oxford Molecular), using an affine gap search with parameters gap open penalty=12 and gap extension penalty=1.

The invention further provides proteins comprising fragments of the *N. gonorrhoeae* amino acid sequences disclosed in the examples. The fragments should comprise at least n consecutive amino acids from the sequences and, depending on the particular sequence, n is 7 or more (e.g. 8, 10, 12, 14, 16, 18, 20, 30, 40, 50, 60, 70, 80, 90, 100 or more). Preferably the fragments comprise one or more epitopes from the sequence. Other preferred fragments are (a) the N-terminal signal peptides of the proteins disclosed in the examples, and (b) the proteins disclosed in the examples, but without their N-terminal signal peptides.

The proteins of the invention can, of course, be prepared by various means (e.g. recombinant expression, purification from *Neisseria*, chemical synthesis etc.) and in various forms (e.g. native, fusions etc.). They are preferably prepared in substantially pure form (i.e. substantially free from other *N. gonorrhoeae* or host cell proteins).

The proteins of the invention are preferably Neisserial proteins, more preferably *N. gonorrhoeae* proteins.

The invention provides antibodies which bind to these proteins. These may be polyclonal or monoclonal and may be produced by any suitable means. The antibodies may include a detectable label.

The invention provides nucleic acid comprising the *N. gonorrhoeae* nucleotide sequences disclosed in the examples. In addition, the invention provides nucleic acid comprising nucleotide sequences having sequence identity to the *N. gonorrhoeae* nucleotide sequences disclosed in the examples.

Furthermore, the invention provides nucleic acid which can hybridise to the *N. gonorrhoeae* nucleic acid disclosed in the examples, preferably under "high stringency" conditions (e.g. 65° C. in a 0.1×SSC, 0.5% SDS solution).

Nucleic acid comprising fragments of these sequences are also provided. These should comprise at least n consecutive nucleotides from the *N. gonorrhoeae* sequences and, depending on the particular sequence, n is 10 or more (e.g. 12, 14, 15, 18, 20, 25, 30, 35, 40, 50, 60, 70, 80, 90, 100, 150, 200 or more).

The invention also provides nucleic acid encoding the proteins and protein fragments of the invention.

The invention includes nucleic acid comprising sequences complementary to those described above (e.g. for antisense or probing purposes).

Nucleic acid according to the invention can be prepared in many ways (e.g. by chemical synthesis, from genomic or cDNA libraries, from the organism itself etc.) and can take various forms (e.g. single stranded, double stranded, vectors, probes etc.).

In addition, the term "nucleic acid" includes DNA and RNA, and also their analogues, such as those containing modified backbones, and also peptide nucleic acids (PNA) etc.

The invention provides vectors comprising nucleotide sequences of the invention (e.g. cloning or expression vectors) and host cells transformed with such vectors.

The invention provides compositions comprising protein, antibody, and/or nucleic acid according to the invention. These compositions may be suitable as immunogenic compositions, for instance, or as diagnostic reagents, or as vaccines.

The invention also provides nucleic acid, protein, or antibody according to the invention for use as medicaments (e.g. as vaccines) or as diagnostic reagents. It also provides the use of nucleic acid, protein, or antibody according to the invention in the manufacture of: (i) a medicament for treating or preventing infection due to *Neisseria*; (ii) a diagnostic reagent for detecting the presence of *Neisseria* or of antibodies raised against *Neisseria*; and/or (iii) a reagent which can raise antibodies against *Neisseria*. Said *Neisseria* may be any species, but is preferably *N. gonorrhoeae*.

The invention also provides a method of treating a patient, comprising administering to the patient a therapeutically effective amount of nucleic acid, protein, and/or antibody of the invention.

According to further aspects, the invention provides various processes.

A process for producing proteins of the invention is provided, comprising the step of culturing a host cell of to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridising conditions to form duplexes; and (b) detecting said duplexes.

A process for detecting proteins of the invention is provided, comprising the steps of: (a) contacting an antibody of the invention with a biological sample under conditions suitable for the formation of an antibody-antigen complexes; and (b) detecting said complexes.

A process for distinguishing *N. gonorrhoeae* from *N. meningitidis* is provided, comprising the steps of: (a) contacting an antibody of the invention with a biological sample under conditions suitable for the formation of an antibody-antigen complexes; and (b) detecting said complexes. Alternatively, the steps may be (a) contacting nucleic acid of the invention with a biological sample under conditions suitable for the nucleic acid hybridisation; and (b) detecting any such hybridisation. Alternatively, the steps may be (a) contacting a protein of the invention with a biological sample (e.g. blood or serum) under conditions suitable for the formation of an antibody-antigen complexes; and (b) detecting said complexes.

A summary of standard techniques and procedures which may be employed in order to perform the invention (e.g. to utilise the disclosed sequences for vaccination or diagnostic purposes) follows. This summary is not a limitation on the invention, but gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989) or Third Edition (2000); *DNA Cloning, Volumes I and II* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology*, Volumes I-IV (D. M. Weir and C. C. Blackwell eds 1986).

Standard abbreviations for nucleotides and amino acids are used in this specification.

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional e.g. X+Y.

The term "heterologous" refers to two biological components that are not found together in nature; The components may be host cells, genes, or regulatory regions, such as promoters. Although the heterologous components are not found together in nature, they can function together, as when a promoter heterologous to a gene is operably linked to the gene. Another example is where a Neisseria sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell, Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753, 235).

Expression Systems

The *Neisseria* nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual*, 2nd ed.].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or beterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:7611] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA, In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual]*.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers &

Smith, *Texas Agricultural Experiment Station Bulletin No.* 1555(1987) ("Summers & Smith").

Prior to inserting the DNA sequence encoding the protein into the baculovirus genome, the above described components, comprising a promoter, leader (if desired), coding sequence, and transcription termination sequence, are usually assembled into an intermediate transplacement construct (transfer vector). This may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extra-chromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamH1 cloning site 32 basepairs downstream from the ATT; see Luckow and Summers, *Virology* (1989)17: 31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5'to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers & Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91.The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers & Smith, supra; Miller et al. (1989).

Recombinant baculovirus expression vectors have been developed for infection into several insect cells. For example, recombinant baculoviruses have been developed for, inter alia: *Aedes aegypti , Autographa californica, Bombyx mori, Drosophila melanogaster, Spodoptera frugiperda,* and *Tri-*

*choplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers & Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, etc. As appropriate, the product may be further purified, as required, so as to remove substantially any insect proteins which are also present in the medium, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. Nos. 5,693,506; 5,659,122; and 5,608, 143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:3340 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology,*. Malcolm B. Wilkins, ed., 1984 Pitman Publishing Limited, London, pp. 21-52. References that describe other metabolically-regulated genes: Sheen, *Plant Cell,* 2:1027-1038(1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for Agrobacterium transformations, T DNA sequences for Agrobacterium-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a beterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature*, 327,70-73, 1987 and Knudsen and Muller, 1991, *Planta*, 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA*, 79,1859-1863, 1982.

The vector may also be introduced into the plant cells by electroporation. (Fromm et al., *Proc. Natl Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus, All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobryclis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Herocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. 1. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymeraselpromoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli,* the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) J. Biotechnol. 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression;* Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various Bacillus strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.*

54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, Campylobacter], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], *[Chassy et al. (*1987*) FEMS Microbiol. Lett.* 44:173 *Lactobacillus]; [Fiedler et al. (*1988*) Anal. Biochem* 170:38, *Pseudomonas]*; *[Augustin et al.* (1990) *FEMS Microbiol. Lett.* 66:203, *Staphylococcus]*, *[Barany et al. (*1980*) J. Bacterial.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbial.* 54:655; Somkuti et al. (1987) *Proc. 4th Evr. Cong. Biotechnology* 1:412, *Streptococcus]*.

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PH05 gene, encoding acid phosphatase, also provides useful promoter sequences [Myanohara et al. (1983) *Proc. Natl. Acad. Sci. USA* 80:1].

In addition, synthetic promoters which do not occur in nature also function as yeast promoters. For example, UAS sequences of one yeast promoter maybe joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PH05 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Publer); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) Gene 8:17-24], pCl/1 [Brake et al. (1984) Proc. Natl. Acad. Sci USA 81:4642-4646], and YRp17 [(Stinchcomb et al. (1982) J. Mol. Biol. 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) Methods in Enzymol. 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) Proc. Natl. Acad. Sci. USA 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) Microbiol, Rev. 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts:Candida albicans [Kurtz, et at. (1986) Mol. Cell. Biol. 6:142], Candida maltosa [Kunze, et at. (1985) J. Basic Microbiol, 25:141]. Hansenula polymorpha [Gleeson, et al. (1986) J. Gen. Microbiol. 132:3459; Roggenkamp et al. (1986) Mol. Gen. Genet. 202:302], Kluyveromyces fragilis [Das, et al. (1984) J. Bacteriol. 158:1165], Kluyveromyces lactis [De Louvencourt et al. (1983) J. Bacteriol. 154:737; Van den Berg et al. (1990) Bio/Technology 8:135], Pichia guillerimondii [Kunze et al. (1985) J. Basic Microbiol. 25:141], Pichia pastoris [Cregg, et al. (1985) Mol. Cell. Biol. 5:3376; U.S. Pat. Nos. 4,837,148 and 4,929,555], Saccharomyces cerevisiae [Hinnen et al. (1978) Proc. Natl. Acad. Sci. USA 75:1929; Ito et al. (1983) J. Bacteriol. 153:163], Schizosaccharomyces pombe [Beach and Nurse (1981) Nature 300:706], and Yarrowia lipolytica [Davidow, et al. (1985) Curr. Genet. 10:380471 Gaillardin, et al. (1985) Curr. Genet. 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) Mol. Cell. Biol. 6:142; Kunze et al. (1985) J. Basic Microbiol. 25:141; Candida]; [Gleeson et al. (1986) J. Gen. Microbiol. 132:3459; Roggenkamp et al. (1986) Mol. Gen. Genet. 202:302; Hansenula]; [Das et al. (1984) J. Bacterial. 158:1165; De Louvencourt et al. (1983) J. Bacteriol. 154:1165; Van den Berg et al. (1990) Bio/Technology 8:135; Kluyveromyces]; [Cregg et at. (1985) Mol. Cell. Biol. 5:3376; Kunze et al. (1985) J. Basic Microbiol. 25:141; U.S. Pat. Nos. 4,837,148 and 4,929,555; Pichia]; [Hinnen et al. (1978) Proc. Natl. Acad. Sci. USA 75;1929; Ito et al. (1983) J. Bacteriol. 153:163 Saccharomyces]; [Beach and Nurse (1981) Nature 300:706; Schizosaccbaromyces]; [Davidow et al. (1985) Curr. Genet. 10:39; Gaillardin et al. (1985) Curr. Genet. 10:49; Yarrowia].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying Neisseria proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 µg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg. 1,000g for 10 minutes). About 20-50 ml per bleed may be obtained from rabbits.

Monoclonal antibodies are prepared using the standard method of Kohler & Milstein [Nature (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuram yl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be used [eg. Robinson & Torres (1997) *Seminars in Immunol* 9:271-283; Donnelly et al. (1997) *Annu Rev Immunol* 15:617-648; later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a TRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. Nos. 5,219,740, 4,405,712, 4,861, 719, 4,980,289, 4,777,127, 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) Human Gene Therapy 1.

Human adenoviral gene therapy vectors are also known in the art and employable in this invention, See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354, 678, 5,173,414, 5,139,941, and 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC with accession numbers VR-977 and VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. Nos. 4,603,112 and 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hem atopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of plasmodium falciparum known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotidelpolypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Feigner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Feigner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio)propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C & E, over time these lipoproteins lose A and acquire C & E. VLDL comprises A, B, C & E apoproteins, LDL comprises apoprotein B; and HDL comprises apoproteins A, C, & E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phospholipids, The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in Zuckermann et al. PCT/US97/14465.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

*Neisseria* antigens of the invention can be used in immunoassays to detect antibody levels (or, conversely, anti-*Neisseria* antibodies can be used to detect antigen levels). Immunoassays based on well defined, recombinant antigens can be developed to replace invasive diagnostics methods. Antibodies to Neisseria proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra]Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1ug for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and form amide content of the hybridization buffer. The effects of all of these factors can be approximated by a single equation:

$$Tm=81+16.6(\log_{10}Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisseria nucleotide sequences of the invention (including both sense and antisense strands). Though many different nucleotide sequences will encode the amino acid sequence, the native Neisseria sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisseria sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex, Additional Neisseria sequence may also be helpful as a label to detect the formed duplex. For example, a non-complementary nucleotide sequence may be attached to the 5' end of the probe, with the remainder of the probe sequence being complementary to a Neisseria sequence. Alternatively, non-complementary bases or longer sequences can be interspersed into the probe, provided that the probe sequence has sufficient complementarity with the a Neisseria sequence in order to hybridize therewith and thereby form a duplex which can be detected.

The exact length and sequence of the probe will depend on the hybridization conditions (e.g. temperature, salt condition etc.). For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Jyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acid. The assay is described in Mullis et al. [*Meth. Enzymol.* (1987) 155:335-350] & U.S. Pat. Nos. 4,683,195 & 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisseria sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisseria sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

BRIEF DESCRIPTION OF DRAWINGS

There are no drawings.

MODES FOR CARRYING OUT THE INVENTION

The following examples describe nucleic acid sequences which have been identified in *N. gonorrhoeae*, along with their inferred translation products.

The examples are generally in the following format:
- a nucleotide sequence which has been identified in *N. gonorrhoeae*. The strain used is FA1090 [Dempsey et al. (1991) *J. Bacteriol.* 173:5476-5486]
- the inferred translation product of this sequence
- a computer analysis (e.g. PSORT output) of the translation product, indicating antigenicity
- homologous sequences (where relevant)
- results of expression and purification (where relevant)

These examples typically include details of sequence homology between species and strains. Proteins that are similar in sequence are generally similar in both structure and function, and the homology often indicates a common evolutionary origin. Comparison with sequences of proteins of known function is widely used as a guide for the assignment of putative protein function to a new sequence and has proved particularly useful in whole-genome analyses.

Open reading frames (ORFs) within nucleotide sequences were predicted using the GLIMMER program [Salzberg et al. (1998)] *Nucleic Acids Res* 26:544-8). All predicted open-reading frames longer than 60 aa were screened against the meningococcus serotype B ('MenB') ORFs (accession NC002183) using the BLASTP algorithm [Altschul et al. (1990) *J. Mol. Biol.* 215:403-410]. ORFs were considered to be gonococcus-specific if they showed sequence identity to a MenB ORF lower than 60% over the whole protein length, or matching the MenB ORF over less than 30% of the length.

Open reading frames are usually shown with a N-terminal methionine. Where this is not the case (e.g. SEQ IDs 12, 18, 20, 32, 54, 62, 66, 84, 98, 102, 104, 112, 116, 118, 126, 128, 130, 134, 136, 138, 146, 152, 162, 186, 228, 238, 240, 278, 280, 288, 290, 298, 300, 308, 314), a non-ATG start codon is present, but the N-terminus amino acid will be methionine when translated using this start codon. If an upstream start codon is used, however, the "native" amino acid will be translated (e.g. if the sequence is expressed with N-terminus fusion sequences). Even where the first amino acid is not shown as methionine, the invention encompasses sequences in which the first amino acid is methionine.

Various tests can be used to assess the in vivo immunogenicity of the proteins identified in the examples. For example, the proteins can be expressed recombinantly and used to screen patient sera by immunoblot. A positive reaction between the protein and patient serum indicates that the patient has previously mounted an immune response to the protein in question ie. the protein is an immunogen. This method can also be used to identify immunodominant proteins.

The recombinant protein can also be conveniently used to prepare antibodies e.g. in a mouse. These can be used for direct confirmation that a protein is located on the cell-surface. Labelled antibody (e.g. fluorescent labelling for FACS) can be incubated with intact bacteria and the presence of label on the bacterial surface confirms the location of the protein.

For protein expression of 14 antigens, sequences were amplified using the following primers:

| | Sequences | Restriction site |
|---|---|---|
| NGS5 | Fwd CGCGGATCCCATATG-TGGGCAGAACAACCGGC | NdeI |
| | Rev CCCGCTCGAG-GTTTTCAGCAGGGGGATTG | XhoI |
| NGS7 | Fwd CGCGGATCCCATATG-GCCGGTAAAGAGCAATTTAC | NdeI |
| | Rev CCCGCTCGAG-AGCCAAGAAGAACCCGTTAT | XhoI |
| NGS13 | Fwd CGCGGATCCGCTAGCTGCGTTGCCGACCCCG | NheI |
| | Rev CCCGCTCGAG-CATGTGCCGTGCGGCGT | XhoI |
| NGS36 | Fwd CGCGGATCCGCTAGC-GACACCCCGAACAATACC | NheI |
| | Rev CCCGCTCGAG-AAACCTGCCCTTGATGCC | XhoI |
| NGS37 | Fwd CGCGGATCCCATATG-GTAGAAGTTAAAGGCGGGG | NdeI |
| | Rev CCCGCTCGAG-TTTTTTCGCGCCGCCGAA | XhoI |
| NGS38 | Fwd CGCGGATCCCATATG-GCCGACGAACGCCGCC | NdeI |
| | Rev CCCGCTCGAG-AAACCGATATTTAAAACCCAACAGCC | XhoI |
| NGS39 | Fwd CGCGGATCCGCTAGCAACCAAGAAGGGATTACCG | NheI |
| | Rev CCCGCTCGAG-TTTTTGAGCATAATGACTTTTGCCCT | XhoI |
| NGS67 | Fwd CGCGGATCCCATATG-CGTGCGCACGGACACG | NdeI |
| | Rev CCCGCTCGAG-GGCGGCGAGTTTTTCGC | XhoI |
| NGS106 | Fwd CGCGGATCCCATATG-GCAAACAGCGGAACGATAG | NdeI |
| | Rev CCCGCTCGAG-AAAATCCTGCGGGATCGGT | XhoI |
| NGS115 | Fwd CGCGGATCCCATATG-GGGGGCGGCTCCGGC | NdeI |
| | Rev CCCGCTCGAG-TTCGGCCAACAATGCTTCC | XhoI |

| Sequences | | Restriction site |
|---|---|---|
| NGSΔG115 | Fwd CGCGGATCCCATATG-GATGCCCAATCTTCACAAAG | NdeI |
| | Rev CCCGCTCGAG-TTCGGCCAACAATGCTTCC | XhoI |
| NGS118 | Fwd CGCGGATCCCATATG-ACCGCCCTTCCCTCTGA | NdeI |
| | Rev CCCGCTCGAG-CGGCTGCCATTCGCGTT | XhoI |
| NGS122 | Fwd CGCGGATCCCATATG-AACCCGAACGATGCGTTTT | NdeI |
| | Rev CCCGCTCGAG-AGGGTAAAACTTATTCAAATCGGCAA | XhoI |
| NGS144 | Fwd CGCGGATCCCATATGGCTTCTGAAAATTCTGTAGC | NdeI |
| | Rev CCCGCTCGAG-GAACACGCTTTTCATTACACCCA | XhoI |
| NGS151 | Fwd CGCGGATCCCATATGCACGGTATGCATAAGAGCA | NdeI |
| | Rev CCCGCTCGAG-TTGCTGATGCGGCTTTATTCG | XhoI |

EXAMPLE 1

A DNA sequence was identified in *N. gonorrhoeae* <SEQ ID 1> which encodes amino acid sequence <SEQ ID 2; NGS1>. Analysis of this protein sequence reveals the following:

GvH: Examining signal sequence (von Heijne)
   Signal Score (-7.5): -5.47
   Possible cleavage site: 36
   >>> Seems to have no N-terminal signal seq.
Amino Acid Composition of Predicted Mature Form:
 calculated from 1
ALOM: Finding transmembrane regions (Klein et al.)
   count: 0  value:    4.72 threshold:    0.0
   PERIPHERAL Likelihood = 4.72
   modified ALOM score: -1.44
Rule: cytoplasmic protein
* * * Reasoning Step: 2
----- Final Results -----
       bacterial cytoplasm --- Certainty= 0.326(Affirmative) < succ>
       bacterial periplasmic space --- Certainty= 0.000(Not Clear) < succ>
       bacterial outer membrane --- Certainty= 0.000(Not Clear) < succ>
       bacterial inner membrane --- Certainty= 0.000(Not Clear) < succ>

The protein has homology with the following sequences in the databases:

Based on this analysis, it was predicted that this protein from *N. gonorrhoeae*, and its epitopes, could be useful antigens for vaccines or diagnostics.

EXAMPLE 2

A DNA sequence was identified in *N. gonorrhoeae* <SEQ ID 3> which encodes amino acid sequence <SEQ ID 4; NGS2>. Analysis of this protein sequence reveals the following:

GvH: Examining signal sequence (von Heijne)
   Signal Score (-7.5): -7.2
   Possible cleavage site: 18
   >>> Seems to have no N-terminal signal seq.
Amino Acid Composition of Predicted Mature Form:
 calculated from 1
ALOM: Finding transmembrane regions (Klein et al.)
   count: 0  value:    5.89 threshold:    0.0
   PERIPHERAL Likelihood = 5.89
   modified ALOM score: -1.68
Rule: cytoplasmic protein
*** Reasoning Step: 2
----- Final Results -----
       bacterial cytoplasm --- Certainty= 0.367(Affirmative) < succ>
       bacterial periplasmic space --- Certainty= 0.000(Not Clear) < succ>
       bacterial outer membrane --- Certainty= 0.000(Not Clear) < succ>
       bacterial inner membrane --- Certainty= 0.000(Not Clear) < succ>

```
>sp|P45941|LYQC_BACSU HYPOTHETICAL 21.5 KD PROTEIN IN CWLA-CISA INTERGENIC REGION
pir||E69949 hypothetical protein yqcF-Bacillus subtilis
dbj|BAA06963.1| (D32216) ORF95 [Bacillus subtilis]
dbj|BAA12427.1| (P84432) YqcF [Bacillus subtilis]
emb|CAB14528.1| (Z99117) yqcF [Bacillus subtilis]
Length = 192
Score = 35.5 bits (81), Expect = 0.45
Identities = 36/162 (22%), Positives 77/162 (47%), Gaps 5/162 (3%)

Query:     19 DSGSQYKLNIAAIPSSPNRDLKTYITLGLSKHDLHYK---SRFEILFVCSLKYDENQIFP      75
              D     ++I ++    P   + +Y TLGLS H +NY+   +    I  V +++      +
Sbjct:     29 DDNKSSIDILSVSDQPQEGITSYSTLGLSDHSIEGTPLRIEIV~AAMESASDIYAN       88

Query:     76 FLRWLAETIIENKKILLRGQVVYLPRSIVNS-TKMDALYVSAPFYFDDDFQVCYGEHYNI     134
              L   A  II +    G +      S+ +  T M +    PF +++D ++    + N+
Sbjct:     89 VLSTCAFNIINSNFTCAPGVIFKNVISMYDQETDMKHIMFVPPFLWEEDLELLEFSNKNV     148

Query:    135 VFPLLVPLYKQEAELVEKKGWNAFEQFLLDNEVGNLSDMNRK                    176
              + + +P+ + E ++ EK G + + Q LL+++  ++ D+ R+
Sbjct:    149 TWLMALPISEGELQVAEKHG-SDYLQDLLESKQIDIFDIKRE                    189
```

The protein has homology with the following sequences in the databases:

```
>emb|CAC01359.1|(AL390975) hypothetical protein SCP8.21 [Streptomyces coelicolor A3(2)]
Length = 198
Score = 37.2 bits (85), Expect = 0.15
Identities = 29/107 (27%), Positives = 51/107 (47%), Gaps = 3/107 (2%)

Query:    73 ETPEHIETLAMLASASYPDQFQLGKNIGRPWVEQSSFRHFLISLPYPYGQELEY        130
             +T + +  LA+LA++       G ++++G P   + F  L++ P    ++LE
Sbjct:    88 DTDKVLRPLAVLAASPQVEGVIVAPGASLDVGEPLWPGAPFTSVLVAEPGGLVEDLELDA  147

Query:   131 -MDNRFFWLLPITQTERLFLNTHSVEELETKFDEAGIDYLDINRAS             176
             +D VRF  LLP+T E  +  H   L+ ++     G D  D +R S
Sbjct:   148 PLDPVFLPLLPMTPNEAAWKRVHGAPALQERWLNHGTDLRDPSRRS             194
```

Based on this analysis, it was predicted that this protein from *N. gonorrhoeae,* and its epitopes, could be useful antigens for vaccines or diagnostics.

EXAMPLE 3

A DNA sequence was identified in *N. gonorrhoeae* <SEQ ID 5> which encodes amino acid sequence <SEQ ID 6; NGS3>. Analysis of this protein sequence reveals the following:

---
GvH: Examining signal sequence (von Heijne)
 Signal Score (-7.5): -1.69
 Possible cleavage site: 32
>>> Seems to have a cleavable N-term signal seq.
Amino Acid Composition of Predicted Mature Form:
 calculated from 33
ALOM: Finding transmembrane regions (Klein et al.)
 count: 5 value: -10.56 threshold: 0.0
 INTEGRAL   Likelihood = -10.56  Transmembrane 182-198
 (171-201)

-continued

INTEGRAL   Likelihood = -7.86   Transmembrane 251-267
 (244-273)
 INTEGRAL   Likelihood = -7.48   Transmembrane 142-158
 (136-167)
 INTEGRAL   Likelihood = -6.32   Transmembrane 55-71
 (50-82)
 INTEGRAL   Likelihood = -2.97   Transmembrane 100-116
 (99-117)
 PERIPHERAL Likelihood = 4.72
 modified ALOM score: 2.61
Rule: cytoplasmic membrane protein
*** Reasoning Step: 2
----- Final Results -----
    bacterial inner membrane --- Certainty= 0.522(Affirmative) < succ>
    bacterial periplasmic space --- Certainty= 0.000(Not Clear) < succ>
    bacterial outer membrane --- Certainty= 0.000(Not Clear) < succ>
       bacterial cytoplasm --- Certainty= 0.000(Not Clear) < succ>
---

The protein has homology with the following sequences in the databases:

```
>sp|P19845|NOSY_PSEST MEMBRANE PROTEIN NOSY PRECURSOR
pir||S13585 nosY protein precursor-Pseudomonas stutzeri
emb|CAA37717.1|(X53676) nosY [Pseudomonas stutzeri]
Length = 276
Score = 163 bits (413), Expect = 2e-39
Identities = 117/275 (42%), Positives = 174/275 (62%), Gaps = 2/275 (0%)

Query:     1 MNPVWIITGKEARDSLRNRWVLAAVLLLAALALSLGFLGSSPTGSVKVDPLTVTVVSLSS      60
             MN VW I  KE D LRNRW+LA  LL A LA+ + +LG++ +G +    + T+ SL+S
Sbjct:     1 MNQVWNIARKELSDGLRNRWLLAISLLFAVLAGIAWLGAAASGQLGFTSIPATIASLAS      60

Query:    61 LLSIFLIPLIAMLLSYDALIGEIERGTMALLLSYPIWRNQILAGKFVGHLIILALATTAGY    120
             L+ FL+PLIA+LL+YDA++GE E GT+ LLL+YP+ R QIL GKFVGH +ILALA   G+
Sbjct:    61 LATFLMPLIALLLAYDAIVGEDEGGTLMLLLTYPLGRGQILLGKFVGHGLILALAVLIGF   120

Query:   121 GLAGITLQLANGGFDIAA-WKPFALLAASVILGAAFLSMGYLISAKVKERGTAAGISIG    179
              G A + + L  G ++      + F   + +S +LG  FL+   Y++S    KV E+ +AAG+++G
Sbjct:   121 GCAALAIALLVEGVELGMLFWAFGRFHISSTLLGWVFLAFAYVLSGKNEKSSAAGLALG   180

Query:   180 VWLFFVVIFDMALLGILVADSKQVITAPVVETVLLFNPTDIYRLLNLTGYENTAMYAGMA    239
              VW  F V+   +L  S+       ++ +LL NPTDIYRL+NL+G+E +     G+
Sbjct:   181 VW-FLFVLVFDLVLLALLVLSEGKFNPELLPWLLLLNPTDIYRLINLSGFEGSGSAMGVL   239

Query:   240 GLSGQIGLTVPVLLTAQVLWVIIPLVLAAGIFRKR                            274
               L    +  VL   + W+ +  L+LA  IFR+R
Sbjct:   240 SLGADLPVPAAVLCLLAWIGVSLLLAYAIFRRR                             274
```

A homolog (amino acids 226-276) was found in serogroup A *N. meningitidis* but not in serogroup B, so NGS3 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 4

A DNA sequence was identified in *N. gonorrhoeae* <SEQ ID 7> which encodes amino acid sequence <SEQ ID 8; NGS4>. Analysis of this protein sequence reveals the following:

GvH: Examining signal sequence (von Heijne)
  Signal Score (-7.5): 1.53

Possible cleavage site: 58
>>> Seems to have no N-terminal signal seq.
Amino Acid Composition of Predicted Mature Form:
  calculated from 1
ALOM: Finding transmembrane regions (Klein et al.)
  count: 0   value:     0.63  threshold:     0.0
  PERIPHERAL Likelihood = 0.63
  modified ALOM score: −0.63
Rule: cytoplasmic protein
*** Reasoning Step: 2
----- Final Results -----
      bacterial cytoplasm --- Certainty= 0.103(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>

The protein has homology with the following sequences in the databases:

```
>sp|Q59746|NOSZ_RHIME NITROUS-OXIDE REDUCTASE PRECURSOR (N(2)OR) (N2O REDUCTASE)
gb|AAC44023.1|(U47133) nitrous-oxide reductase [Sinorhizobium meliloti]
prf||2209347B nitrous-oxide reductase [Rhizobium meliloti]
       Length = 639

Score =  660 bits (1704), Expect = 0.0
 Identities = 344/536 (64%), Positives = 407/536 (75%), Gaps = 23/536 (4%)

Query:    1 MSDEKLEQNGLSRRSFLGTAA--ASGAGIAGAGLIGLAGCSKDGEQAAANASGAAPVAKA    58
            MS+E+ +    L+RR LGT A A+    +   G L L+G              G A A+A
Sbjct:    1 MSNEETKMR-LNRRQMLGTTAFMAAAGAVGAGGALTLSG-------------GTATPARA    46

Query:   59 QGESKPGQLSSEVGPGELDQYYGFLSGGQSGEMRLIGLPSMRELMRIPVFNMDSATGWGR   118
            Q S    S EV PGELD+YY F S GQSGE+R++G PSMRE+MRIPVFN  SATGWG+
Sbjct:   47 QETSGS---SYEVKPGELDEYYVFFSSGQSGEIRIVGAPSMREMMRIPVFNRCSATGWGQ   103

Query:  119 TNESLKVLNGNITEETRKFLKDSGLRCYPNGDLHHPHLSFTDQTYDGRYAYANDKANNRV   178
            TNES KV+ +  ET +FLKD G   Y NGDLHHPH SFTD TYDGRY YANDK+N+RV
Sbjct:  104 TNESRKVMTEGLLPETVEFLKDQG-GLYLNGDLHHPHPSFTDGTYDGRYLYANDKSNSRV   162

Query:  179 CRVRLDVMKADIIDIPNDSGIHGIHGLRPQRYPKTGYVFANGEHITPVSGVGK-LDDAKTWN   237
            CR+RLDVMK DKII +PN   +HGLR Q+YPKTGYVF NGE    PV  GK + D  ++
Sbjct:  163 CRIRLDVMKCDKIIQLPNQHTVHGLRVQKYPKTGYVFCNGEDAVPVPNDGKTMGDKNSYQ   222

Query:  238 AVYTAIDGETMEIAWQVLVDGNLDNGDADYQGKYSFATCYNSERALTVQGASSNEQDWCV   297
            A++TA+DGETME+AWQV+VDGNLDN DADYQGKY FATCYNSE  T+     ++EQDW V
Sbjct:  223 AIFTAVDGETMEVAWQVMVDGNLDNVDADYQGKYCFATCYNSEEGFTLADMMASEQDWVV   282

Query:  298 VFDLKAIEEGIKAGDFKEVNGVLDGRABAKSKYTRYIPVFNSPHGCNASPDGKYIMPN   357
            +F+LK IEE + GD+KE+ GV +LDGR    S YTRY+PVPNSPHG N +PDG +++ N
Sbjct:  283 IFNLKRIEEAVAKGDYKEIGGVPVLDGR--KGSPYTRYVPVPNSPHGINTAPDGIHVVAN   340

Query:  358 GKLPPTVTVLDVSKLDDLFAGKIKERDVVAEPQLGLGPLHTAFDGRGNAYTTLFIDSQM   417
            GKL PTVTV DV K DDLF  KI+ RD VVAEP+LGLGPLHTA+DG+GNAYTTLFIDSQ+
Sbjct:  341 GKLSPTVTVFDVRKFDDLFDDKIQARDTVVAEPELGLGPLHTAYDGKGNAYTTLFIDSQV   400

Query:  418 VKWNIDDAIKAYGEKIDPIKQKLDVHYQPGHNHTTMGETKEADGQWLVSLNKFSKDRFL   477
            KWNI+DA +AY GEK+DPI+ KLDVHYQPGHNHT+MG+TKEADG+WL+SLNKFSKDR+L
Sbjct:  401 CKWNIEDAKRAYAGEKVDPIRHKLDVHYQPGHTSMGQTKEADGKWLISLNKFSKDRYL    460

Query:  478 NAGPLKPECDQLIGISGDEMRLVHDNPTFAEPHDLCLVAASKLNPGKTWDRKDPWF     533
            N GPLKPE DQLI ISGDEM LVHDNPTFAEPHD  +V ASK+NP  W+R DP+F
Sbjct:  461 NVGPLKPENDQLIDISGDEMVLVHDNPTFAEPHDATIVHASKINPVHVWNRDDPFF    516
```

Based on this analysis, it was predicted that this protein from *N. gonorrhoeae,* and its epitopes, could be useful antigens for vaccines or diagnostics.

EXAMPLE 5

A DNA sequence was identified in N. gonorrhoeae <SEQ ID 9> which encodes amino acid sequence <SEQ ID 10; NGS5>. Analysis of this protein sequence reveals the following:

```
GvH: Examining signal sequence (von Heijne)
   Signal Score (-7.5): 1.09
   Possible cleavage site: 19
>>> Seems to have a cleavable N-term signal seq.
Amino Acid Composition of Predicted Mature Form:
   calculated from 20
ALOM: Finding transmembrane regions (Klein et al.)
   count: 0   value:     7.43 threshold:    0.0
   PERIPHERAL Likelihood = 7.43
   modified ALOM score:   -1.99
Score for OM-PP discrimination: 4.97
Rule: outer membrane or periplasmic protein
Score for OM-PP discrimination: 4.97
Rule: outer membrane or periplasmic protein
*** Reasoning Step: 2
Outer membrane?  score:  0.496525
----- Final Results -----
    bacterial outer membrane --- Certainty= 0.781(Affirmative) < succ>
    bacterial periplasmic space --- Certainty= 0.138(Affirmative) < succ>
    bacterial inner membrane --- Certainty= 0.000(Not Clear) < succ>
       bacterial cytoplasm --- Certainty= 0.000(Not Clear) < succ>
```

The protein has no homology with sequences in the databases.

The protein was expressed in *E. coli* as an insoluble 43.56 kDa His-fusion product and then purified.

Based on this analysis, it was predicted that this protein from *N. gonorrhoeae,* and its epitopes, could be useful antigens for vaccines or diagnostics.

EXAMPLE 6

A DNA sequence was identified in *N. gonorhoeae* <SEQ ID 11> which encodes amino acid sequence <SEQ ID 12; NGS6>. Analysis of this protein sequence reveals the following:

```
GvH: Examining signal sequence (von Heijne)
   Signal Score (-7.5): -3.93
   Possible cleavage site: 36
>>> Seems to have no N-terminal signal seq.
Amino Acid Composition of Predicted Mature Form:
   calculated from 1
ALOM: Finding transmembrane regions (Klein et al.)
   count: 0   value:     6.42 threshold:    0.0
   PERIPHERAL Likelihood = 6.42
   modified ALOM score:   -1.78
Rule: cytoplasmic protein
*** Reasoning Step: 2
----- Final Results -----
    bacterial cytoplasm --- Certainty= 0.447(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>
```

The protein has homology with the following sequences in the databases:

```
>pir|F83173 outer membrane protein OprC PA3790 [imported]-Pseudomonas
aeruginosa (strain PAO1)
dbj|BAA05664.1|(D28119) outer membrane protein C [Pseudomonas aeruginosa]
gb|AAG07177.1|AE004797_12 (AE004797) outer membrane protein OprC
[Pseudomonas aeruginosa]
Length = 723

Score = 77.9 bits (191), Expect = 1e-13
Identities = 58/188 (30%), Positives = 89/188 (46%), Gaps = 13/188 (6%)

Query:  49 VKDLIIFDRAHGQSGTASKGGIITRNVDAILFTAQAYARYNFNPHWAAGIKAAYNYGHN  108
              V+D I+F    G  G++++     NVDAR+   + A Y   +W      AY +G N
Sbjct: 546 VQDFILFSYREGMMGSSTQ-----ATNVDARIMGGELGASYQLTGNWKTDASLAYAWGKN  600

Query: 109 ETDGRPPYQIRPFEAAVQADYKNYFAHGSYNIGAATRFVAKQTRGDFDMASGLGIDKREA  168
              +D R   QI P EA     Y+     G ++ G+  R VA Q R    D  ++G D  ++
Sbjct: 601 SSDDRALPQIPPLEARFGLTYE----EGDWSAGSLWRVVAPQNRIARDQGNVVGKDFDKS  656

Query: 169 AKGFTVADVYAGVNIKDKYGLRLGVNNVFNKKYVEYI--SGDHVLALSPS-VVYAPGRTY  225
              A GF V +    +   L  GV+N+F+K  Y E++   +GD    S +  V    PGRT+
Sbjct: 657 A-GFGVFSLNGAYRVTRNVKLSAGVDNLFDKDYTEHLNKAGDAGFGFSANETVPEPGRTF  715

Query: 226 WLSLHAAF                                                      233
              W    +F
Sbjct: 716 WTKVDFSF                                                      723
```

Based on this analysis, it was predicted that this protein from *N. gonorrhoeae,* and its epitopes, could be useful antigens for vaccines or diagnostics.

EXAMPLE 7

A DNA sequence was identified in *N. gonorrhoeae* <SEQ ID 13> which encodes amino acid sequence <SEQ ID 14; NGS7>. Analysis of this protein sequence reveals the following:

---

GvH: Examining signal sequence (von Hejine)
   Signal Score (−7.5): 4.94
   Possible cleavage site: 26
>>> Seems to have a cleavable N-term signal seq.
Amino Acid Composition of Predicted Mature Form:
  calculated from 27
ALOM: Finding transmembrane regions (Klein et al.)
   count: 0  value:     0.79 threshold:     0.0
   PERIPHERAL Likelihood = 0.79
   modified ALOM score:   −0.66
Score for OM-PP discrimination: −18.85
Rule: outer membrane or periplasmic protein
Score for OM-PP discrimination: −18.85
Rule: outer membrane or periplasmic protein
*** Reasoning Step: 2
Periplasmic space?'0 score:   1.8846
----- Final Results -----
    bacterial periplasmic space --- Certainty= 0.929(Affirmative) < succ>
    bacterial outer membrane --- Certainty= 0.211(Affimative) < succ>
    bacterial inner membrane --- Certainty= 0.000(Not Clear) < succ>
      bacterial cytoplasm --- Certainty= 0.000(Not Clear) < succ>

---

The protein has homology with the following sequences in the databases:

The protein was expressed in *E. coli* as an insoluble 32.89 kDa His-fusion product and then purified.

Based on this analysis, it was predicted that this protein from *N. gonorrhoeae,* and its epitopes, could be useful antigens for vaccines or diagnostics.

EXAMPLE 8

A DNA sequence was identified in *N. gonorrhoeae* <SEQ ID 15> which encodes amino acid sequence <SEQ ID 16; NGS8>. Analysis of this protein sequence reveals the following:

---

GvH: Examining signal sequence (von Heijne)
   Signal Score (−7.5): 2.39
   Possible cleavage site: 15
>>> Seems to have a cleavable N-term signal seq.
Amino Acid Composition of Predicted Mature Form:
  calculated from 16
ALOM: Finding transmembrane regions (Klein et al.)
   count: 4  value:     −8.23 threshold:     0.0
   INTEGRAL    Likelihood = −8.23   Transmembrane 49-65 (41-73)
   INTEGRAL    Likelihood = −7.38   Transmembrane 83-99 (75-106)
   INTEGRAL    Likelihood = −7.06   Transmembrane 110-126 (100-133)
   INTEGRAL    Likelihood = −4.41   Tranamembrane 164-180 (163-187)
   PERIPHERAL Likelihood = 5.89
   modified ALOM score:   2.15
Rule: cytoplasmic membrane protein
*** Reasoning Step: 2
----- Final Results -----
    bacterial inner membrane --- Certainty= 0.429(Affirmative) < succ>
    bacterial periplasmic space --- Certainty= 0.000(Not Clear) < succ>
    bacterial outer membrane --- Certainty 0.000(Not Clear) < succ>
      bacterial cytoplasm --- Certainty 0.000(Not Clear) < succ>

---

The protein has homology with the following sequences in the databases:

```
>pir||D72405 hypothetical protein-Thermotoga maritima (strain MSB8)
gb|AAD35294.1|AE001705_5 (AE001705) hypothetical protein
[Thermotoga maritima]
Length = 300
Score = 81.8 bits (201), Expect = 1e-14
Identities = 72/289 (24%), Positives = 124/289 (41%), Gaps = 17/289 (5%)

Query:   38 PAMPSVTIAVAALQGKLAKQADVSLKIWRSPDQLRAGVASGQFKVMMSPSNVGVNLRNQG    97
              P  P++     V  + GK+       DV ++IW++P++   A + S +      + P  VG NL  +G
Sbjct:   24 PLGPALIPVVPIMDGKIP--TDVKIEIWKNPEEAVAKIVSKEVDFAVLPVTVGANLYGKG    81

Query:   98 QKVGMNILTNGITQLVCKGSAIASP-QDLVGKKILVPF-KNDMPDIVLQALLKKLKIDA   155
              ++ +V +      +LV     A      + L G+++  P  +      D++++  L K   +
Sbjct:   82 VRIKLVGVHEWKVFYLVASDDATFDGWESLRGQEVYTPHGRGQTVDVLMRYFLSKAGLTL   141

Query:  156 HK-VSITYAATPPEAVGLFPSKGYHAVILPEPMATASLLKGKTIGINVVHGFDLVKAWGQ   214
              + V   I YA    P E V LF S         LPEP +  L +GK +        D   K WG+
Sbjct:  142 DRDVKILYAP-PQEIVALFKSGKVKYAALPEPFVSMCLDRGKVV-------LDFQKEWGK   193

Query:  215 AFDTKPLIPMAGIIANEEYFHAHKAQFDIFHQDLKNALNWILANRQNAAKIGKNYLPAPE   274
                      IP+AG+       E        K    +   +L +++ W+  N       ++      L  P
Sbjct:  194 ELGVPGRIPIAGLFVRE---GVDKETVEKVKALIDSIRWMKENLDETVQLSSEKLGIPA   250

Query:  275 PALVHGLDGAPLTVSKGSEVKNEILKFYEILMQFNPELLGGKLPDNGFF            323
                   L    L+          + + E+    F +L +  PE       K+PD GF+
Sbjct:  251 KILKSSLERIEFEYVPVEKCREEVETFLKKLNELYPEGF-EKIPDEGFY            298
```

```
>sp|P38044|NRTB_SYNP7 NITRATE TRANSPORT PERMEASE PROTEIN NRTB
pir||S30892 nitrate transport protein nrtB-Synechococcus sp. (strain PCC
7942)
emb|CAA43810.1|(X61625) nitrate transporter [Synechococcus sp.]
prf||1908370A nitrate transporter [Synechococcus sp.]
Length = 279
Score = 67.5 bits (164), Expect = 1e-10
Identities = 54/202 (26%), Positives = 96/202 (46%), Gaps = 7/202 (3%)

Query:     4 VALWAWGSAVFGEFMLPAPVEFQKSL--DLLKHFQEN-----EIGISLWRSVVGISVAL    56
             +A+W  SA+ G+   LP P+ V    +   +++ F +N      +G+ +  S+ +++
Sbjct:    36 LAIWQVISAILGQDRLPGPINVVANTWMPYIVEPFFDNGGTSKGLGLQILISLQRVAIGY   95

Query:    57 IAGLAAGLVAGLVAGSFKTAMALLKPVITILLAMPPIIWVVMALFWFGFGNPSVLFTIIV  116
             +      G++  G V G  K       L PVI +L  +PP+ W   ++L  F   N S +F I +
Sbjct:    96 LLAACTGILVGGVLGMSKFLGKGLDPVIQVLRTVPPLAWFPISLMVFQDANTSAIFVIFI  155

Query:   117 LVAPLTFASAAVGMASVNKQHEELFDAYKLGRLKKIRYLYIPHLTGYVISSVGVAVAMGV  176
                        + AVG+  +  +    +  KL +    I  + IP    YV + + +AV +
Sbjct:   156 TAIWPIIINTAVGINQIPDDYNNVARVLKLSKKDYILNILIPSTVPYVFAGLRIAVGLAW  215

Query:   177 KAVIMAELLGASKGVGARIADA                                       198
             A++ AE+L A  G+G   I DA
Sbjct:   216 LAIVAAEMLKADGGIGYFIWDA                                       237
```

Based on this analysis, it was predicted that this protein from *N. gonorrhoeae*, and its epitopes, could be useful antigens for vaccines or diagnostics.

EXAMPLE 9

A DNA sequence was identified in *N. gonorrhoeae* <SEQ ID 17> which encodes amino acid sequence <SEQ ID 18; NGS9>. Analysis of this protein sequence reveals the following:

---

GvH: Examining signal sequence (von Heijne)
  Signal Score (-7.5): -5.07
  Possible cleavage site: 29
  >>> Seems to have no N-terminal signal seq.
Amino Acid Composition of Predicted Mature Form:
  calculated from 1

ALOM: Finding transmembrane regions (Klein et al.)
  count: 1    value:    -1.81 threshold:    0.0
  INTEGRAL    Likelihood = -1.81    Transmembrane 97-113
  (96-113)
  PERIPHERAL    Likelihood = 4.24
  modified ALOM score: 0.86
Rule: cytoplasmic membrane protein
*** Reasoning Step: 2
----- Final Results -----
    bacterial inner membrane --- Certainty= 0.172(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

---

The protein has homology with the following sequences in the databases:

```
>sp|P97027|SSUB_BACSU PUTATIVE ALIPHATIC SULFONATES THANSPORT ATP-BINDING
PROTEIN SSUB
pir||G69816 nitrate ABC transporter (binding protein) homolog ygaL-
B. subtilis
emb|CAB07520.1|(Z93102) hypothetical 30.6 kd protein [Bacillus subtilis]
emb|CAB12711.1|(Z99108) similar to nitrate ABC transporter (binding
protein) [Bacillus subtilis]
Length = 274
Score = 99.5 bits (247), Expect = 3e-20
Identities = 68/181 (37%), Positives 102/181 (55%), Gaps = 9/181 (4%)

Query:     4 LFGPSGCGKTTVLRLIAGLETPKSGTIRNTFH-------KTGFLFQENRLPENLTAMQNI   56
             L GPSGCGK+T+L+IAGL++    G++            + GF+FQE+RL   LT  QNI
Sbjct:    56 LIGPSGCGKSTLLKIIAGLDSEYDGSVEINGRSVTAPGIQQGFIFQEHRLFPWLTVEQNI  115

Query:    57 A--IFMDNPDEGEIVALAAKVGLTAGDLNKYPTELSGGMAKRVAFLRLLLCGCDLALLDE  114
             A   + ++P    + V     ++       G      YP ELSGGM++RVA  R LL    ++ LLDE
Sbjct:   116 AADLNLKDPKVKQKVDELIEIVRLKGSEKAYPRELSGGMSQRVAITRALLREPELLLDE  175

Query:   115 PFVGLDRDLRDILVAMLVEKIERQGMACILVTHDRFEAARLSHEIMLLSAKGMNVQNVIT  174
                PF  LD   R L  +L++    ++        ILVTHD  E+  L +E+ +L AK   +  ++
Sbjct:   176 PFGALDAFTRKHLQDVLLDIWRKKTTNILVTHDIDESVYLGNELAILKAKPGKIHKLMP  235

Query:   175 L                                                            175
             +
Sbjct:   236 I                                                            236
```

Based on this analysis, it was predicted that this protein from *N. gonorrhoeae*, and its epitopes, could be useful antigens for vaccines or diagnostics.

EXAMPLE 10

A DNA sequence was identified in *N. gonorrhoeae* <SEQ ID 19> which encodes amino acid sequence <SEQ ID 20; NGS10>. Analysis of this protein sequence reveals the following:

GvH: Examining signal sequence (von Heijne)
   Signal score (−7.5): 2.27
   Possible cleavage site: 26
>>> Seems to have no N-terminal signal seq.

Amino Acid Composition of Predicted Mature Form:
  calculated from 1
ALOM: Finding transmembrane regions (Klein et al.)
  count: 0  value:    5.14 threshold:    0.0
  PERIPHERAL Likelihood = 5.14
  modified ALOM score:   −1.53
*** Reasoning Step: 2
imb2 HYPID: 2 CFP: 0.1
----- Final Results -----
    bacterial inner membrane --- Certainty= 0.100(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

The protein has homology with the following sequences in the databases:

```
>pir||A82615 surface protein XF1981 [imported]-Xylella fastidiosa (strain
9a5c)
gb|AAF84783.1|AE004017_6 (AE004017) surface protein [Xylella fastidiosa]
Length = 1190
Score = 50.2 bits (119), Expect = 2e-05
Identities = 59/210 (28%), Positives = 92/210 (43%), Gaps = 5/210 (2%)

Query:    17 SIGTSAEANAPGAALGGSSEASKFSIAEGYLASSDGYGAIAIGSAAKI-KQLEKGTIN    75
              ++G    A+A GA A+G  + AS K S A G  A+     G++A+G   AK   +  +
Sbjct:   876 AVGVGTLASAEGATAVGSGAAASGKGSTAIGRNAVASADGSVALGDGARGAESYTG    935

Query:    76 HIVGNDNKGLYVDADGNVTKITVRTESEKDILSRYGQTYGAVALGFRSSSHNLFA----S   131
                     G  N  +   + G+ +K   RT S              L    +  N +
Sbjct:   936 KYSGLQNNTVGTVSVGDASKGETRTVSNVADAKEATDAVNLRQLDRVAQDANRYVDNKIE   995

Query:   132 SFGAFSTATAIESLAVGDSSQSTGYRSATFGSHSRALAEEESLALGYETRANYGSVALGA   191
               S     T    + SL  +   + G +   G   A    +S+A+G +   A+A   +VA+G
Sbjct:   996 SLSEGQTFVKVNSLNNSATPIAAGVDATAIGVGATASGADSIAMGNKASADNAVAIGN   1055

Query:   192 ESVANEENTVSVSSDTLKRKIVNVIADGTED    221
               SVA+  NTVSV S    +R++ NVA GT D
Sbjct:  1056 HSVADRANTVSVGSAGSERQVTNVAAGTAD    1085

>sp|P10858|YADA_YERPS INVASIN PRECURSOR (OUTER MEMBRANE ADHESIN)
pir||S04534 invasin precursor-Yersinia pseudotuberculosis plasmid pIBI
emb|CAA32088.1|(X13883) Yop1 preprotein (AA 1-434) [Yersinia
pseudotuberculosis]
prf||1411295A invasin [Yersinia pseudotuberculosis[
Length = 434
Score = 42.1 bits (98), Expect = 0.006
Identities = 35/134 (26%), Positives = 68/134 (50%), Gaps = 28/134 (20%)

Query:   116 AVALGFRSSSHLFASSFGFSTATAIESDSSQSTGYRSATFGSHSRA--------    167
              ++A+G  + +     A + G+ S AT + S+A+G   S++  G   + T+G+ S A
Sbjct:   107 SIAIGATAEAAKPAAVAVGSGSIATGVNSVAIGPLSKALGDSAVTYGASSTAQKDGVAIG    166

Query:   168 ----LAEESLALGYETRANAYGSVALGA----------------ESVANEENTVSVSSDT   207
                   ++  +A+G+  ++  +A   SVA+G                  S    + EN+VS+   ++
Sbjct:   167 ASDTGVAVGFNSKDAQNSVAIGHSSHVAADHGYSIAIGDHSKTDRENSVSIGHES    226

Query:   208 LKRKIVNVADGTED    221
               L  R++  ++A GTED
Sbjct:   227 LNRQLTHLAAGTED    240
```

Based on this analysis, it was predicted that this protein from *N. gonorrhoeae,* and its epitopes, could be useful antigens for vaccines or diagnostics.

EXAMPLE 11

A DNA sequence was identified in *N. gonorrhoeae* <SEQ ID 21> which encodes amino acid sequence <SEQ ID 22; NGS11>. Analysis of this protein sequence reveals the following:

```
GvH: Examining signal sequence (von Heijne)
    Signal Score (-7.5): -0.16
    Possible cleavage site: 60
>>> Seems to have no N-terminal signal seq.
Amino Acid Composition of Predicted Mature Form:
    calculated from 1
ALOM: Finding transmembrane regions (Klein et al.)
    count: 0    value:       4.67 threshold:     0.0
    PERIPHERAL Likelihood = 4.67
    modified ALOM score:   -1.43
Rule: cytoplasmic protein
*** Reasoning Step: 2
----- Final Results -----
        bacterial cytoplasm --- Certainty= 0.297(Affirmative) < succ>
        bacterial periplasmic space --- Certainty= 0.000(Not Clear) < succ>
        bacterial outer membrane --- Certainty= 0.000(Not Clear) < succ>
        bacterial inner membrane --- Certainty= 0.000(Not Clear) < succ>
```

The protein has homology with the following sequences in the databases:

```
>sp|P10858|YADA_YERPS INVASIN PRECURSOR (OUTER MEMBRANE ADHESIN)
pir||S04534 invasin precursor-Yersinia pseudotuberculosis plasmid pIBI
emb|CAA32088.1|(X13883) Yop1 preprotein (AA 1-434) [Yersinia
pseudotuberculosis]
prf||1411295A invasin [Yersinia pseudotuberculosis]
            Length = 434
 Score = 41.3 bits (96), Expect = 0.007
 Identities = 27/71 (38%), Positives = 48/71 (67%), Gaps = 4/71 (5%)

Query:   16 QLNRLSKRTNRVGASAAALASL-KPAQLGKNDKFAFSLGFGSYKNAQAVAMGAVFKPAEN   74
            +L++L KR ++  AS+AAL SL +P  +GK +   F+ G G Y+++QA+A+G+ ++  E+
Sbjct:  353 RLDKLDKRVDKGLASSAALNSLFQPYGVGKVN---FTAGVGGYRSSQALAIGSGYRVNES  409

Query:   75 VLLNVAGSFAG                                                  85
               V L   ++AG
Sbjct:  410 VALKAGVAYAG                                                 420
```

Based on this analysis, it was predicted that this protein from *N. gonorrhoeae,* and its epitopes, could be useful antigens for vaccines or diagnostics.

EXAMPLE 12

A DNA sequence was identified in *N. gonorrhoeae* <SEQ ID 23> which encodes amino acid sequence <SEQ ID 24; NGS12>. Analysis of this protein sequence reveals the following:

```
GvH: Examining signal sequence (von Heijne)
    Signal Score (-7.5): -1.29
    Possible cleavage site: 61
>>> Seems to have a cleavable N-term signal seq.
Amino Acid Composition of Predicted Mature Form:
    calculated from 62
ALOM: Finding transmembrane regions (Klein et al.)
    count: 0    value:       6.36 threshold:     0.0
    PERIPHERAL Likelihood = 6.36
    modified ALOM score:   -1.77
Score for OM-PP discrimination: 6.03
Rule: outer membrane or periplasmic protein
Score for OM-PP discrimination: 6.03
Rule: outer membrane or periplasmic protein
*** Reasoning Step: 2
Outer membrane? score:   0.602784
----- Final Results -----
        bacterial outer membrane --- Certainty= 0.867(Affirmative) < succ>
        bacterial periplasmic space --- Certainty= 0.158(Affirmative) < succ>
        bacterial inner membrane --- Certainty= 0.000(Not Clear) < succ>
        bacterial cytoplasm --- Certainty= 0.000(Not Clear) < succ>
```

The protein has no homology with sequences in the databases.

Based on this analysis, it was predicted that this protein from *N. gonorrhoeae,* and its epitopes, could be useful antigens for vaccines or diagnostics.

EXAMPLE 13

A DNA sequence was identified in *N. gonorrhoeae* <SEQ ID 25> which encodes amino acid sequence <SEQ ID 26; NGS13>. Analysis of this protein sequence reveals the following:

```
GvH: Examining signal sequence (von Heijne)
    Signal Score (-7.5): -3.64
    Possible cleavage site: 51
>>> May be a lipoprotein
Amino Acid Composition of Predicted Mature Form:
    calculated from 21
ALOM: Finding transmembrane regions (Klein et al.)
    count: 1    value:      -1.01 threshold:     0.0
    INTEGRAL   Likelihood = -1.01    Transmembrane  36-52
    (36-52)
    PERIPHERAL  Likelihood = 5.14
    modified ALOM score:   0.70
Rule: inner or outer membrane protein
Rule: inner or outer membrane protein
Rule: cytoplasmic membrane protein
*** Reasoning Step: 2
Lipoprotein?
Inner membrane?
----- Final Results -----
        bacterial outer membrane --- Certainty= 0.790(Affirmative) < succ>
``` bacterial inner membrane --- Certainty= 0.742(Affirmative) < succ>
bacterial periplasmic space --- Certainty= 0.000(Not Clear) < succ>
bacterial cytoplasm --- Certainty= 0.000(Not Clear) < succ>

The protein has homology with the following sequences in the databases:

```
>gb|AAC33455.1|(AF067083) outer membrane protein homolog [Vitreoscilla sp.]
Length = 217
Score = 236 bits (602), Expect = 2e-61
Identities = 134/217 (61%), Positives = 166/217 (75%)

Query:    1 MTFFKPSTVVLTASALALSGCVADPVTGQQSPNKSAMYGLGGAAVCGWGALTHSGKGAR      60
            M  +K  +++ T +A+ALS C  DP+TGQ    N + +  LGGAA CGIVGALTH  KGAR
Sbjct:    1 WKAWKKFSLMATVAAVALSACATDPMTGQVDRNNTVLGALGGAATCGIGALTHGSKGAR    60

Query:   61 NSALACGAIGAGVGGYMDYQEQRLRQNLAGTQIEIQRQGNQIRLVMPESVTFATGSAALG    120
            NSALACGAIGAGVG YMD+QE++LRQ+LA  TQ+E+ R G++IRLVMPES+TFATGS  L
Sbjct:   61 NSALACGAIGAGVGAYMDHQERQLRQSLANTQVEVNRVGDEILVMPESITFATGSYQLN   120

Query:  121 GSAQYALNTAAQTLVQYPDTTLTINGHTDNTGSDAVNNPLSQHRAQAVAYYLQTRGVAAS   180
            SA  +LN+ +  L QY DTT+ I GHTD+TGSDA+N PLS++RA AVA YL +R VA++
Sbjct:  121 SSASTSLNSVSSVLAQYTDTTINIVGHTDSTGSDAINEPLSRNRASAVANYLVSRNVASN   180

Query:  181 RLTVYGYGSHMPVASNATVEGRAQNRRVEILINPDQR                         217
            R+T  G G    PVASN TV GRA+NRRVEI +NP QR
Sbjct:  181 RITTVGAGCRQPVASNNTVAGRAENRRVEITVNPIQR                         217

>gb|AAD40344.1|U88088_22 (U88088) OmpA [Pseudomonas alcaligenes]
Length = 220
Score = 130 bits (328), Expect = 1e-29
Identities = 90/219 (41%), Positives = 127/219 (57%), Gaps = 6/219 (2%)

Query     7 STVVLTASALALSGCVA---DPVTGQQSPNKSAMYGLGGAAVCGIVGALTHSGKGARNSA    63
            S + +    L+GC +   + T + +    A   L GA    ++G  +  +GA   A
Sbjct:    3 SVIAASLVIFTLTGCASIQNEDGTTKNTALYGAGGALAGAVAGALIGK-ENRAQGALIGA    61

Query:   64 LACGAIGAGVGGYMDYQEQRLRQNLAGTQIEIQRQGNQIRLVMPESVTFATGSALLLGGSA   123
               G++GAG G Y D QE  LR+ + G+ ++++RQG++I +VMP ++TFATG A + +
Sbjct:   62 AVAGSLGAGYGYYADKQEAELREQMKGSGVQVERQGDEIVIVMPGAITFATGKAEIQPNF   121

Query:  124 QYALNTAAQTLVQYPDTTLTINGHTDNTGSDAVNNPLSQHRAQAVAYYLQTRGVAASRLT   183
              LN  A +    YPD+ L + GHTD+ GS  N  LSQ RAQ+VA +L+  GV   R+
Sbjct:  122 ANTLNQLAGSFPNYPDSRLIVTGHTDSVGSYEANELLSQRRAQSVAQFLRGNGVQTDRIE   181

Query:  184 VGYGHMPVASNATEGRAQNRRVEILINPDQRAVNAA                          222
            V G G + PVASNAT EGRAQNRRVEI + P  RAV  A
Sbjct:  182 VIGAGPNQPVASNATAEGRAQNRRVEIKLAP--RAVQQA                       218
```

The protein was expressed in *E. coli* as a soluble 22.55 kDa His-fusion product and then purified.

Based on this analysis, it was predicted that this protein from *N. gonorrhoeae*, and its epitopes, could be useful antigens for vaccines or diagnostics.

EXAMPLE 14

A DNA sequence was identified in *N. gonorrhoeae* <SEQ ID 27> which encodes amino acid sequence <SEQ ID 28; NOS14>. Analysis of this protein sequence reveals the following:

GvH: Examining signal sequence (von Heijne)
 Signal Score (-7.5): -5.32
 Possible cleavage site: 40
 >>> Seems to have no N-terminal signal seq.
Amino Acid Composition of Predicted Mature Form:
 calculated from 1
ALOM: Finding transmembrane regions (Klein et al.)
 count: 0  value:  3.39  threshold:  0.0
 PERIPHERAL Likelihood = 3.39
 modified ALOM score:  -1.18
Rule: cytoplasmic protein
*** Reasoning Step: 2
----- Final Results ----- bacterial cytoplasm --- Certainty= 0.254(Affirmative) < succ>
bacterial periplasmic space --- Certainty= 0.000(Not Clear) < succ>
bacterial outer membrane --- Certainty= 0.000(Not Clear) < succ>
bacterial inner membrane --- Certainty= 0.000(Not Clear) < succ>

The protein has no homology with sequences in the databases.

Based on this analysis, it was predicted that this protein from *N. gonorrhoeae*, and its epitopes, could be useful antigens for vaccines or diagnostics.

EXAMPLE 15

A DNA sequence was identified in *N. gonorrhoeae* <SEQ ID 29> which encodes amino acid sequence <SEQ ID 30; NGS15>. Analysis of this protein sequence reveals the following:

GvH: Examining signal sequence (von Heijne)
    Signal Score (-7.5): -1.75
    Possible cleavage site: 45
>>> Seems to have no N-terminal signal seq.
Amino Acid Composition of Predicted Mature Form:
    calculated from 1
ALOM: Finding transmembrane regions (Klein et al.)
    count: 0    value:    5.89 threshold:    0.0
    PERIPHERAL Likelihood = 5.89
    modified ALOM score:   -1.68
Rule: cytoplasmic protein
*** Reasoning Step: 2
----- Final Results -----
        bacterial cytoplasm --- Certainty= 0.232(Affirmative) < succ>
        bacterial periplasmic space --- Certainty= 0.000(Not Clear) < succ>
        bacterial outer membrane --- Certainty= 0.000(Not Clear) < succ>
        bacterial inner membrane --- Certainty= 0.000(Not Clear) < succ>

GvH: Examining signal sequence (von Heijne)
    Signal Score (-7.5): -3.64
    Possible cleavage site: 20
>>> Seems to have no N-terminal signal seq.
Amino Acid Composition of Predicted Mature Form:
    calculated from 1
ALOM: Finding transmembrane regions (Klein et al.)
    count: 0    value:    4.67 threshold:    0.0
    PERIPHERAL Likelihood = 4.67
    modified ALOM score:   -1.43
Rule: cytoplasmic protein
*** Reasoning Step: 2
----- Final Results -----
        bacterial cytoplasm --- Certainty= 0.262(Affirmative) < succ>
        bacterial periplasmic space --- Certainty= 0.000(Not Clear) < succ>
        bacterial outer membrane --- Certainty= 0.000(Not Clear) < succ>
        bacterial inner membrane --- Certainty= 0.000(Not Clear) < succ>

The protein has homology with the following sequences in the databases:

The protein has homology with the following sequences in the databases:

```
>sp|P10487|RCI1_ECOLI SHUFFLON-SPECIFIC DNA RECOMBINASE
pir||S03815 probable integrase-Escherichia coli
dbj|BAA77989.1|(AB027308) shufflon-specific DNA recoinbinase [Plasmid R64]
Length = 384
Score = 67.1 bits (163), Expect = 3e-10
Identities = 75/301 (24%), Positives = 125/301 (40%), Gaps = 34/301 (11%)

Query:   68 KVKMMTLSEAMRKYLNETLGAGRSKKMGL---RFLMEFPIGGIGIDKLKRSDFAEHVMQR  124
             +++ M+LS A+ KYL       + +       + PI   +D++   D A +    R
Sbjct:    5 RIRKMSLSRALDKYLKTVSVHKKGHQQEFYRSNVIKRYPIALRNMDEITTVDIATYRDVR   64

Query:  125 RRGIPELDIAPIAASTALQELQYIRSVLKHAFYVWGLEIGWQELDFAANGLKRSNMVAKS  184
              I    PI +T   EL + S+   A    WG        N ++           S
Sbjct:   65 LAEINPRTGKPITGNTELELALLSSLFNIARVEWG--------TCRTNPVELVEKPKVS  116

Query:  185 AIRDRLPTTEELQTLTTYFLRQWQSRKSSIPMHLIMWLAIYTSRRQDEICRLLFDDWHKN  244
              + RDR  T+E + L+YF         R+ ++ +++I  LA+ T+ RQ EI    L     W
Sbjct:  117 SGRDRRLTSSEBRRLSRYF------REKNLMLYVIFHLALETAMRQGEILAL---RWEHI  167

Query:  245 DCTRPVRDLKNPNGSTGNNKEFDILPMALPVIDELPEESVRKRMLANKGIADSLVPCNGK  304
               D   V L  P   G++++ +    A   +P            + ++
Sbjct:  168 DLRHGVAL--PETNGHSRDVPLSRRARNFLQMMP-----------VNLHGNVFDYTAS   214

Query:  305 SVSAAWTRACKTLGIKDLRFHULREEAATRMAEDG-FTIPQNQRVTLHDGWNSLQRYVSVR 364
              AW  A + L I+DL FHDLRHEA +R  E G   + ++  ++  H    N L+RY  +R
Sbjct:  215 GFKNAWRIATQRLRIEDLHRHDLRHEAISRFFELGSLNVMEIAAISGHRSMNMLKRYTHLR 275
```

Based on this analysis, it was predicted that this protein from *N. gonorrhoeae*, and its epitopes, could be useful antigens for vaccines or diagnostics.

EXAMPLE 16

A DNA sequence was identified in *N. gonorrhoeae* <SEQ ID 31> which encodes amino acid sequence <SEQ ID 32; NGS16>. Analysis of this protein sequence reveals the following:

```
>sp|P10484|T1M1_ECOLI TYPE I RESTRICTION ENZYME ECOR124II M PROTEIN
(M.ECOR124II)
pir||S02166 type I site-specific deoxyribonuclease (EC 3.1.21.3)
EcoR124/3 chain hsdM-Escherichia coli plasmid R124/3
emb|CAA31541.1|(X13145) hsdM protein (AA 1-520) [Escherichia coli]
Length = 520
Score = 44.4 bits (104), Expect = 0.002
Identities = 65/235 (27%), Positives = 99/235 (41%), Gaps = 55/235 (23%)

Query:  107NRKKAGGYAEYITGGSLRRLVAARRYCGEHPGVFDGAAGSG--------QLEQYIEPS   158
            N  K+GG  E+ T   + +L+A         ++D AAGSG          Q + +I
```

```
-continued
Sbjct:  191 NAGKSGG--EFFTPQHVSKLIAQLAMHGQTHVNKIYDPAAGSGSLLLQAKKQFDNHIIEE  248

Query:  159 DFRAVEIQAEACRALLQNYPAAKVYNTSLFL-------------------YTDGEPQDC  198
            F    EI          N+   +   ++FL                   + D +P D
Sbjct:  249 GFFGQEI----------NHTTYNLARMNMFLHNINYDKRDIKLGNTLTEPHFRDEKPFDA  298

Query:  199 TVMNPPFSIKLKDLSEDEKSRIAQEYPWKKSGV------ADEIFVLKGLE--NARRFGFF  250
              V NPP+S+K   + D+ + I   E  +GV        AD FVL  L   +A+
Sbjct:  299 IVSNPPYSVKW--IGSDDPTLINDER-FAPAGVLAPKSKADFAFVLHALNYLSAKGRAAI  355

Query:  251 ILFPGIAYR-KSEQRFRE-IIGNRLAE--LNRIQNAFEDTPIEVLLLVIDKDKTD       301
            + FPGI YR  +EQ+ R+ ++ N   E  ++   N F   T I V +LV+ K KTD
Sbjct:  356 VCFPGIFYRGGAEQKIRQYLVDNNYVETVISLAPNLFFGTTIAVNILVLSKHKTD       410
```

Based on this analysis, it was predicted that this protein from *N. gonorrhoeae*, and its epitopes, could be useful antigens for vaccines or diagnostics.

EXAMPLE 17

A DNA sequence was identified in *N. gonorrhoeae* <SEQ ID 33> which encodes amino acid sequence <SEQ ID 34; NGS17>. Analysis of this protein sequence reveals the following:

GvH: Examining signal sequence (von Heijne)
  Signal Score (-7.5): -5.29
  Possible cleavage site: 16
>>> Seems to have no N-terminal signal seq.
Amino Acid Composition of Predicted Mature Form:
  calculated from 1
ALOM: Finding transmembrane regions (Klein et al.)
  count: 0   value:      2.60   threshold:     0.0
  PERIPHERAL Likelihood = 2.60
  modified ALOM score:   -1.02
Rule: cytoplasmic protein
*** Reasoning Step: 2
----- Final Results -----
      bacterial cytoplasm --- Certainty= 0.284(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>

The protein has homology with the following sequences in the databases:

Based on this analysis, it was predicted that this protein from *N. gonorrhoeae*, and its epitopes, could be useful antigens for vaccines or diagnostics.

EXAMPLE 18

A DNA sequence was identified in *N. gonorrhoeae* <SEQ ID 35> which encodes amino acid sequence <SEQ ID 36; NGS18>. Analysis of this protein sequence reveals the following:

GvH: Examining signal sequence (von Heijne)
  Signal Score (-7.5): -2.56
  Possible cleavage site: 38
>>> Seems to have no N-terminal signal seq.
Amino Acid Composition of Predicted Mature Form:
  calculated from 1
ALOM: Finding transmembrane regions (Klein et al.)
  count: 0   value:      4.56   threshold:     0.0
  PERIPHERAL Likelihood = 4.56
  modified ALOM score:   -1.41
Rule: cytoplasmic protein
*** Reasoning Step: 2
----- Final Results -----
      bacterial cytoplasm --- Certainty= 0.397(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>

The protein has no homology with sequences in the databases.

```
>ref|NP_052389.1|translocator YopD [Yersinia enterocolitica]
sp|P37132|YOPD_YEREN YOPD PROTEIN
gb|AAD16812.1|(AF102990) translocator YopD [Yersinia enterocolitica]
Length = 306
Score = 32.1 bits (72), Expect = 8.2
Identities = 29/93 (31%), Positives = 43/93 (46%), Gaps = 17/93 (18%)

Query:   13 MLAAKRAAKESTRQERAVKRAGTVRNVDRNRLSARSKAQKENIARMLSGAKVSEDEALTC    72
            +L    R A+E    Q+R ++      T+              AQKE +A M+SGAK+         A+
Sbjct:   89 LLELARKAREMGLQQRDIENKATI------------SAQKEQVAEMVSGAKLMIANAVVS  136

Query:   73 GIMMRLSLQDMRYACNQELINFAEHIVKQVQRL                              105
            GIM    S     ++    +E+        IVKQ Q L
Sbjct:  137 GIMAATSTVASAFSIAKEV-----KIVKQEQIL                             164
```

Based on this analysis, it was predicted that this protein from *N. gonorrhoeae,* and its epitopes, could be useful antigens for vaccines or diagnostics.

EXAMPLE 19

A DNA sequence was identified in *N. gonorrhoeae* <SEQ ID 37> which encodes amino acid sequence <SEQ ID 38; NGS19>. Analysis of this protein sequence reveals the following:

```
GvH: Examining signal sequence (von Heijne)
   Signal Score (-7.5): -4.12
   Possible cleavage site: 43
>>> Seems to have no N-terminal signal seq.
Amino Acid Composition of Predicted Mature Form:
   calculated from 1
ALOM: Finding transmembrane regions (Klein et al.)
   count: 0    value:     8.49 threshold:     0.0
   PERIPHERAL Likelihood = 8.49
   modified ALOM score: -2.20
Rule: cytoplasmic protein
*** Reasoning Step: 2
----- Final Results -----
      bacterial cytoplasm --- Certainty= 0.250(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>
```

The protein has homology with the following sequences in the databases:

```
>ref|NP_043483.1|orf14 [Bacteriophage HP1]
sp|P51716|YO14_BPHP1 HYPOTHETICAL 14.9 KD PROTEIN IN REP-HOL INTERGENIC
REGION (ORF14)
pir||S69520 hypothetical protein 14-phage HP1
gb|AAB09199.1|(U24159) orf14 [Bacteriophage HP1]
Length = 133
Score = 73.3 bits (179), Expect = 1e-12
Identities = 44/129 (34%), Positives = 74/129 (57%), Gaps = 6/129 (4%)

Query:   1 MFIPAALHKDEHSAYGVTIPDLPGCFSCGDTVEEAVANARSAAYMHIDGMIEDGGFKNLA   60
           M  P   + K   +  Y V++PD+PGCFS GDT+ EA+ NA+ A   HI+GM+ED   + L
Sbjct:   1 NLYPICIEK-VNDGYVVSVPDVPGCFSAGDTLSEAMLNAKEAISFHIEGMLEDD--EELP  57

Query:  61 VSS-IADLSQEPDYHGATWVMIEIDPAKISRQQIRFNVSWPQYLLDRVDEY--TSANHET  117
           S+ I     +P+Y      ++++D   +  +  + N++ P  LL R+D++    T   ++
Sbjct:  58 KSNPIEQYINQPEYKDFIVTVVDVDLTHLMGKAEKINITVPALLLHRIDQFIATHPEYKN  117

Query: 118 RSGFLAKAA                                                    126
           RS FL++ A
Sbjct: 118 RSNFLSQLA                                                    126
```

Based on this analysis, it was predicted that this protein from *N. gonorrhoeae,* and its epitopes, could be useful antigens for vaccines or diagnostics.

EXAMPLE 20

A DNA sequence was identified in *N. gonorrhoeae* <SEQ ID 39> which encodes amino acid sequence <SEQ ID 40; NGS20>. Analysis of this protein sequence reveals the following:

```
GvH: Examining signal sequence (von Heijne)
   Signal Score (-7.5): -0.1
   Possible cleavage site: 19
>>> Seems to have no N-terminal signal seq.
Amino Acid Composition of Predicted Mature Form:
   calculated from 1
ALOM: Finding transmembrane regions (Klein et al.)
   count: 0    value:     7.58 threshold:     0.0
   PERIPHERAL Likelihood = 7.58
   modified ALOM score: -2.02
Rule: cytoplasmic protein
*** Reasoning Step: 2
----- Final Results -----
      bacterial cytoplasm --- Certainty= 0.057(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>
```

The protein has no homology with sequences in the databases.

Based on this analysis, it was predicted that this protein from N. gonorrhoeae, and its epitopes, could be useful antigens for vaccines or diagnostics.

EXAMPLE 21

A DNA sequence was identified in *N. gonorrhoeae* <SEQ ID 41> which encodes amino acid sequence <SEQ ID 42; NGS21>. Analysis of this protein sequence reveals the following:

```
GvH: Examining signal sequence (von Heijne)
   Signal Score (-7.5): -3.52
   Possible cleavage site: 52
>>> Seems to have no N-terminal signal seq.
Amino Acid Composition of Predicted Mature Form:
   calculated from 1
ALOM: Finding transmembrane regions (Klein et al.)
   count: 0    value:     5.83 threshold:     0.0
   PERIPHERAL Likelihood = 5.83
   modified ALOM score: -1.67
Rule: cytoplasmic protein
*** Reasoning Step: 2
----- Final Results -----
      bacterial cytoplasm --- Certainty= 0.311(Affirmative) < succ>
      bacterial periplasmic space --- Certainty= 0.000(Not Clear) < succ>
      bacterial outer membrane --- Certainty= 0.000(Not Clear) < succ>
      bacterial inner membrane --- Certainty= 0.000(Not Clear) < succ>
```

The protein has homology with the following sequences in the databases:

```
>ref|NP_040628.1|cI (repressor; 237) [bacteriophage lambda]
ref|NP_061378.1|phage lambda repressor protein CI [Escherichia coil]
sp|P03034|RPC1_LAMBD REPRESSOR PROTEIN CI
pir||RPBPL repressor protein cI-phage lambda
emb|CAA24991.1|(X00166) coding sequence cI gene [bacteriophage lambda]
gb|AAA96581.1|(J02459) cI (repressor; 237) [bacteriophage lambda]
emb|CAB96428.1|(AJ277653) phage lambda repressor protein CI [Escherichia
coli]
Length = 237
Score = 62.5 bits (151), Expect = 5e-09
Identities = 36/85 (42%), Positives = 51/85 (59%)

Query:   2 KKRELNEIETAECAELKRIFNSKKEELKLTQYKLAEAVGVTQSAVNHYLNGTNALNASIA   61
           KK+ L + + +  LK I+  KK EL L+Q  +A+ +G+ QS V   NG NALNA  A
Sbjct:   4 KKKPLTQEQLEDARRKKAIYEKKKELGLSQESVADKMGMGQSGVGALFNGINALNAYNA   63

Query:  62 SQFAKILQIPVSDFSLRLAEEISSM                                    86
           +  AKIL++ V +FS  +A EI  M
Sbjct:  64 ALLAKILKVSVEEFSPSIAREIYEM                                    88
```

Based on this analysis, it was predicted that this protein from *N. gonorrhoeae*, and its epitopes, could be useful antigens for vaccines or diagnostics.

EXAMPLE 22

A DNA sequence was identified in *N. gonorrhoeae* <SEQ ID 43> which encodes amino acid sequence <SEQ ID 44; NGS22>. Analysis of this protein sequence reveals the following:

---

GvH: Examining signal sequence (von Heijne)
    Signal Score (-7.5): -2.6
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 0   value:      7.74 threshold:      0.0
    PERIPHERAL Likelihood = 7.74
    modified ALOM score:   -2.05
Rule: cytoplasmic protein
*** Reasoning Step: 2
----- Final Results -----
    bacterial cytoplasm --- Certainty= 0.072(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

---

The protein has homology with the following sequences in the databases:

```
>pir||S30432 hypothetical protein-Streptomyces clavuligerus plasmid pSCL
Length = 307
Score = 43.6 bits (102), Expect = 0.002
Identities = 25/86 (29%), Positives = 49/86 (56%), Gaps = 2/86 (2%)

Query:   6 MGMAFKT-GIPRGRFVLVLCDCANDDGLCYPSQETLAEDTGFAETAVRQHIKWLKDNN   64
           MGM F    G+   ++ +L+    +    G  C+PS++ L +D G + + V++    +L     N
Sbjct:   1 MGMVFAAEGLDGSEKLLLLGYTNWTDPYGYCWPSEDRLVDDCGTSRSTVQRTKRKLVKKN   60

Query:  65 FIKSARRQRGR-ERKSDIYRINVALL                                  89
           ++S  RR+  +  E   S++ R+N+ LL
Sbjct:  61 LLRSVRRKNSKGEPISNLSRVNLPLL                                   86
```

Based on this analysis, it was predicted that this protein from *N. gonorrhoeae*, and its epitopes, could be useful antigens for vaccines or diagnostics.

EXAMPLE 23

A DNA sequence was identified in *N. gonorrhoeae* <SEQ ID 45> which encodes amino acid sequence <SEQ ID 46; NGS23>. Analysis of this protein sequence reveals the following:

---

GvH: Examining signal sequence (von Heijne)
    Signal Score (-7.5): -2.8
    Possible cleavage site: 59
>>> Seems to have no N-terminal signal seq.
Amino Acid Composition of Predicted Mature Form:
    calculated from 1
ALOM: Finding transmembrane regions (Klein et al.)
    count: 0   value:      0.05 threshold:      0.0
    PERIPHERAL Likelihood = 0.05
    modified ALOM score:   -0.51
Rule: cytoplasmic protein
*** Reasoning Step: 2
----- Final Result -----
    bacterial cytoplasm --- Certainty= 0.195(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

---

The protein has homology with the following sequences in the databases:

```
>sp|P07905|DNAC_ECOLI DNA REPLICATION PROTEIN DNAC
pir||XMECNC DNA replication protein dnaC-Escherichia coli (strain K-12)
Length = 245
Score = 110 bits (275), Expect = 2e-23
Identities = 75/224 (33%), Positives = 116/224 (51%), Gaps = 23/224 (10%)

Query:  50 EAADEMAAYAETLRRGAMRDA---------LEKRIGRSGIAPRFRNCRIENYAV--SDS    97
            + +E+ A+ +    +GA+R A          +++  RSGI P +NC  ENY V
Sbjct:  24 KTGEELLAWQK--EQGAIRSAALERENRAMKMQRTFNRSGIRPLHQNCSFENYRVECEGQ   81

Query:  98 IPGMARAKAAAAEYAANFADVLQTGRSMIFSGRRGTGKNHLACGIAREVIAAGKSALVIT  157
            +  +++A+    E+  N A       S IFSG+ GTGKNHLA  I  E++  GKS L+IT
Sbjct:  82 MNALSKARQYVEEFDGNIA-------SFIFSGKPGTGKNHLAAAICNELLLRGKSVLIIT  134

Query: 158 VGDMLRTVKDSF--GGGGEAGAVGIFVKPDLLVLDEFGAGSLSETDGRILFSVVNARYER  215
            V D++  +KD+F    G E  +         DLLV+DE G  + S+ +   I+  +V+ R
Sbjct: 135 VADIMSAMKDTFRNSGTSEEQLLNDLSNVDLLVIDEIGVQTESKYEKVIINQIVDRRSSS  194

Query: 216 LMPMLVLTNLTAEAFRENTDARIRDRLRDGGGKLIPFDWESTRA                 259
              P  +LTN  E   +     R+ DR+R G    + F+W+SYR+
Sbjct: 195 KRPTGHLTNSNMEEMTKLLGERVMDRMRLGNSLWVIFNWDSYRS                 238
```

Based on this analysis, it was predicted that this protein from *N. gonorrhoeae*, and its epitopes, could be useful antigens for vaccines or diagnostics.

EXAMPLE 24

A DNA sequence was identified in *N. gonorrhoeae* <SEQ ID 47> which encodes amino acid sequence <SEQ ID 48; NGS24>. Analysis of this protein sequence reveals the following:

---

GvH: Examining signal sequence (von Heijne)
  Signal Score (-7.5): -5.76
  Possible cleavage site: 26
  >>> Seems to have no N-terminal signal seq.

---

-continued

Amino Acid Composition of Predicted Mature Form:
  calculated from 1
ALOM: Finding transmembrane regions (Klein et al.)
  count: 0  value:    1.43 threshold:   0.0
  PERIPHERAL Likelihood = 1.43
  modified ALOM score: -0.79
Rule: cytoplasmic protein
*** Reasoning Step: 2
----- Final Results -----
    bacterial cytoplasm --- Certainty= 0.112(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

---

The protein has homology with the following sequences in the databases:

```
>ref|NP_053228.1|pXO2-73 [Bacillus anthracis]
gb|AAF13678.1|AF188935_76 (AF188935) pXO2-73 [Bacillus anthracis]
Length = 541
Score = 125 bits (315), Expect = 9e-28
Identities = 139/535 (25%), Positives = 254/535 (46%), Gaps = 70/535 (13%)

Query:  14 PVLFIGTGMSLRYLDNSYTWDGLLSKIAIDLFGDDREYLNIKSRYCEDGRFQYEEIAEEL   73
            P LFIG+G S RYL N   W GL+ K ++L     + EY      Y    + E+AE +
Sbjct:  19 PFLFIGSGFSKRYL-NLEDWAGMKKFS-NLMPYEFEY------YSSTANKDWAEVAELM   70

Query:  74 QSKFDKVL--ENDPDGEFKEINDKFFENMRAGNTLSRFKIYISTLLSQLNYK----DNSN  127
             F  +   E    KE  D       R  + S K+ ++ L+ + YK   + ++
Sbjct:  71 AKDFHPIWWKEQQFENNRKEFKD------RISSKQSPLKVEVAKYIiNSIEYKYGLDEKND 124

Query: 128 TELSELKKARKNVGSIITTNYDKLAQDIFEFNPL---IGN-DILLSNPY--GSVYKIHGC  181
            E°+ LKK    + IITTN+D L + IFE  +    IG  ++L S+P     +YKIHGC
Sbjct: 125 KEIAALKKIV--IDGIITTNWDLLLEQIFEEQEMQVYIGQKELLFSHPLEINEIYKIHGC  182

Query: 182 VDDPSKIIITKKDYEKFKEKYELIRAQLLSLFIHNPIIFLGYNVGDENIKEILKTIFTYV  241
                 P  +++T  DY+ +  EK  + A+LL++FI +P+IFLGY++  D+NI++ILK I    +
Sbjct: 183 SSIPDSLVLTTSDYKGYNEKNAYLAAKLLTVFIEHPVIFLGYSISDDNIQQIILKAITRCL  242

Query: 242 EQNSPSANKIRRNFLLVEYEPESNNEDIVEDIDIT-GFSTIRINKIKTDNFSQIYKALA   300
            +Q++    K R    L+  E      ED E++  +T G  T+ I  +KT+++  +IY ALA
Sbjct: 243 DQDNIHKLKDR----LIFVERAGQEEDSFENNSSLTIGKITVPITRVKTNDYEKIYNALA  298

Query: 301 ELTLPISAMDVRKFQSIAKEIYTGGNIKVSF---TEDMDNLNNSDKVVAIGSTKTISYNF  357
            +       S   +R+ +S  E+   +          + D+  + V+ +G  K
Sbjct: 299 QNKRKFSMKMMRQMKSQIYELVKTNDPEEKIYVVDGEYDDTQDIEFVIGLG-VKNVVEEM  357

Query: 358 QTTSEMMSN---------------YFKIIEEENS----QLLKLIDKHSIASTQYFPI--  395
            Q+   E+  ++                       + +++ +E         ++K+      + S QY P+
```

```
Sbjct: 358 QSNHEISADKELSEHGYGGISDIELFNELLSDEPKYDYDSIVKISLPQILRSNQYVPLFR  417

Query: 396 YGFSRICSDIHKEAVLKRQQKEKLDHFIEEINRRCKNNHSSIQSILDDENISDTYKNDAI  455
            Y       D   ++ +K + K +    F+ E ++    N S        + + +  + + +
Sbjct: 418 YVLESSVEDELLDSKIKNKLKMRYTDFIITETQKNIKLDWQFKNLDEVLKGFPDIKV     477

Query: 456 AWG----IWNNQLSEDEVENYL---KNFVNKKN----THYKRLLCMFDYKKYADT       499
            A    +    L+ D+++++L       FV +KN        T  +RL  ++D+ KY  +
Sbjct: 478 AIEQIPLLGQKNLNNCDDLDFLIKNSKFVKEKNTPERTGIRRLFRIYDWLKYGQS        532
```

Based on this analysis, it was predicted that this protein from *N. gonorrhoeae*, and its epitopes, could be useful antigens for vaccines or diagnostics.

EXAMPLE 25

A DNA sequence was identified in *N. gonorrhoeae* <SEQ ED 49> which encodes amino acid sequence <SEQ ID 50; NGS25>. Analysis of this protein sequence reveals the following:

---

GvH: Examining signal sequence (von Heijne)
    Signal Score (-7.5): 4.76837e-07
    Possible cleavage site: 56
>>> May be a lipoprotein
Amino Acid Composition of Predicted Mature Form:
    calculated from 21
ALOM: Finding transmembrane regions (Klein et al.)
    count: 0   value: 6.68  threshold: 0.0

PERIPHERAL Likelihood = 6.68
    modified ALOM score: -1.84
Rule: inner or outer membrane protein
Rule: inner or outer membrane protein
*** Reasoning Step: 2
Lipoprotein?
Inner membrane?
----- Final Results -----
    bacterial outer membrane --- Certainty= 0.790(Affirmative)
     < succ>
    bacterial inner membrane --- Certainty= 0.700(Affirmative)
     < succ>
    bacterial periplasmic space --- Certainty= 0.000(Not Clear)
     < succ>
     bacterial cytoplasm --- Certainty= 0.000(Not Clear)
      < succ>

---

The protein has homology with the following sequences in the databases:

```
>gi|7433005|pir||B70313 cytochrome-c peroxidase (EC 1.11.1.5)-
Aquifex aeolicus
gi|2982865|gb|AAC06485.1|(AE000675) cytochrome c peroxidase
[Aquifex aeolicus]
Length = 355
Score = 345 bits (885), Expect = 7e-94
Identities = 180/336 (53%), Positives = 237/336 (69%), Gaps = 12/336 (3%)

Query:  59 EDQDLLKRAQGVFQPLPTVEEMQKIRPFTEEQVKLGHQLWYEPRLSKGNTVSCNSCHNLA  118
            +D++LLK A+  F+PLP V E  +  P T E+VKLG  L+Y+PRLSK    +SCN+CHNLA
Sbjct:  22 DDKELLKKMARQYFKPLPKVAENPQ-NPVTPEKVKLGKMLYYDPRLSKSGLISH-        80
            CNTCHNLA Query: 119 SAGVDNMPTSQGHKGQFGGRNSPTALNAALLGSQFWDGRAADVEEQAGGPLVNPVEMAND  178
             GVDN+PTS GH+    G RN+PT  NAA+  +QFWDGRA DVEEQA GP+VNP+EMAN
Sbjct:  81 RYGVDNLPTSIGHRWAIGPRNAPTVYNAAIHIAQFWDGRAKDVEEQALGPIVNPIEMAN-  139

Query: 179 SQEAAAAKIAKVPEYQEFKAFP-EDGAVSFKNITTALGAFERTLLTPTKWDEYLKGNV    237
            +++E A   +  +PEY E+FKKAFP E     V ++NI   A+GAFERTL+TP+++DE+LKGN
Sbjct: 140 TEENAVKTLKSIPEYVELFKKAFPNEKDPVKYENIGKAIGAFERTLMTPSRFDEFLKGNT  199

Query: 238 NALSEQERKGRAFDNGCIACHNGNLGGTTFQKRGLVQGPYWK------FIEDP--KR    289
            +AL+EQE++G++  F++ GC+ACHNG  +GG  F KFG++      YWK         +  P    K
Sbjct: 200 KALTEQEKRGLKTFIEVGCVACHNGPGVGGNMFAKFGMIT-EYWKVTYPYVLVGKPAIKV  258

Query: 290 DKGEADVTKKTEDEFFFRVPGLRNVAKTYPFHNGSVWELDKAVTIMGKAQLGKDIPKED  349
            D  GR   VTKK ED F F+VP LRN+   TYPYFH+GSVW L+  AV IM K QLGK++   +
Sbjct: 259 DFGRFGVTKKEEDMFVFKVPSLRNIEHTYPYFHDGSVWSLEDAVRIMAKTQLGKELTDQQ  318

Query: 350 VDNIVVFLNALSGNVSESARTHPELPLTAPMESKPD                          385
            V +IV FL AL+G + +  A  +PELP +            KP+
Sbjct: 319 VKDIVAFLKALTGKIPKHALEVPELPPSTDKTPKPE                          354
```

Based on this analysis, it was predicted that this protein from *N. gonorrhoeae,* and its epitopes, could be useful antigens for vaccines or diagnostics.

EXAMPLE 26

A DNA sequence was identified in *N. gonorrhoeae* <SEQ ID 51> which encodes amino acid sequence <SEQ ID 52; NGS26>. Analysis of this protein sequence reveals the following:

```
GvH: Examining signal sequence (von Heijne)
    Signal Score (-7.5): 0.610001
    Possible cleavage site: 15
>>> Seems to have no N-terminal signal seq.
Amino Acid Composition of Predicted Mature Form:
    calculated from 1
ALOM: Finding transmembrane regions (Klein et al.)
    count:  0   value:   5.04 threshold:   0.0
    PERIPHERAL Likelihood =   5.04
    modified ALOM score:    -1.51
Rule: cytoplasmic protein
*** Reasoning Step: 2
----- Final Results -----
            bacterial cytoplasm --- Certainty= 0.127(Affirmative)
            < succ>
        bacterial periplasmic space --- Certainty= 0.000(Not Clear)
        < succ>
            bacterial outer membrane --- Certainty= 0.000(Not Clear)
            < succ>
            bacterial inner membrane --- Certainty= 0.000(Not Clear)
            < succ>
```

The protein has homology with the following sequences in the databases:

```
>pir||T13296 hypothetical protein 8-Streptococcus phage phi-O1205
gb|AAC79524.1|(U88974) ORF8 [Streptococcus thermophilus temperate
bacteriophage O1205]
Length = 157
Score = 62.5 bits (151), Expect = 2e-09
Identities = 53/161 (32%), Positives = 86/161 (52%), Gaps = 8/161 (4%)

Query:   5 TLYRCDVQAALDYYFDSETEREDTLEAV--IGQFEVKAQSVIAYIKNQEITEKMLEGH    62
           TLY     +    +    D ET + DTLEA+     +E K +   IK+ E   +  +
Sbjct:   3 TLYELTDQLLEIYNMDVDDET-KLDTLEAIDWTTDYENKVEGYVKVIKSLEADIEARKNE  61

Query:  63 IRQMTGKLKAAKARNQSLKDYLARNMQAAGITEIKADDGTFKASFRKSEAVVILDEAQIP  122
           +++ G  K+ +++   LK  LA +M   G T +  D    FK  FRKSEAVV+ +E ++P
Sbjct:  62 KKRLDGLNKSDQSKIDKLKTALAVSMAETGQTRV--DTTLFKVGFRKSEAVVV-NEEKLP 118

Query: 123 AEFMREAVKTEPDKTAIRXAIESGRQVAGAKIEGRKNLQIR                    163
           E+     K  PDK +++ ++SG+ + GA +E R+NL IR
Sbjct: 119 KEYQIATYK--PDKKTLKLKSGKHIEGATLEERRNLNIR                     157
```

Based on this analysis, it was predicted that this protein from *N. gonorrhoeae,* and its epitopes, could be useful antigens for vaccines or diagnostics.

EXAMPLE 27

A DNA sequence was identified in *N. gonorrhoeae* <SEQ ID 53> which encodes amino acid sequence <SEQ ID 54; NGS27>. Analysis of this protein sequence reveals the following:

```
GvH: Examining signal sequence (von Hejine)
    Signal Score (-7.5): -5.45
     Possible cleavage site: 49
>>> Seems to have no N-terminal signal seq.
Amino Acid Composition of Predicted Mature Form:
    calculated from 1
ALOM: Finding transmembrane regions (Klein et al.)
    count: 0 value: 1.80 threshold: 0.0
    PERIPHERAL Likelihood = 1.80
    modified ALOM score: -0.86
Rule: cytoplasmic protein
*** Reasoning Step: 2
----- Final Results -----
        bacterial cytoplasm --- Certainty = 0.559 (Affirmative) < succ>
motifs:
Subtilase_Asp (S, T, A, I, V)x(L, I, V, M, F)(L, I, V, M)D(D, S, T, A)G(L, I, V, M, F, C)x)
                                (A)x(L)(I)D(D)G(I)x{2}(D)
    79: DDDFL                       AALIDDGIVFD                      V
```

A homolog was found in serogroup A N. meningitidis but not in serogroup B, so NGS27 protein and nucleic acid are useful for distinguishing between gonococcus and serogroup B N. meningitidis.

Based on this analysis, it was predicted that this protein from N. gonorrhoeae, and its epitopes, could be useful antigens for vaccines or diagnostics.

EXAMPLE 28

A DNA sequence was identified in N. gonorrhoeae <SEQ ID 55> which encodes amino acid sequence <SEQ ID 56; NGS28>. Analysis of this protein sequence reveals the following:

```
GvH: Examining signal sequence (von Heijne)
     Signal Score (-7.5): -0.19
     Possible cleavage site: 61
>>> Seems to have a cleavable N-term signal seq.
Amino Acid Composition of Predicted Mature Form:
     calculated from 62
ALOM: Finding transmembrane regions (Klein et al.)
     count: 0     value:     0.69 threshold:     0.0
     PERIPHERAL Likelihood =   0.69
     modified ALOM score:    -0.64
Score for OM-PP discrimination: -24.78
Rule: outer membrane or periplasmic protein
Score for OM-PP discrimination: -24.78
Rule: outer membrane or periplasmic protein
*** Reasoning Step: 2
Periplasmic space?   score: 2.47798
Periplasmic space?   score: 2.47798
----- Final Results -----
     bacterial periplasmic space --- Certainty= 0.916(Affirmative)
     < succ>
```

The protein has homology with the following sequences in the databases:

```
>prf||1306286A mobilization protein B [Escherichia coli]
Length = 529

Score = 34.7 bits (78), Expect = 2.4
Identities = 24/69 (34%), Positives = 31/69 (44%), Gaps = 12/69 (17%)

Query:  344 QLRARQQEIPVDYARTAVCGRIPFRRHSRPTLRSRTLGAQRRRIVPNVGQAGGIRAD---  400
            +LRA  Q++P D+ +T V    P R    R    +    GA       GQ G IR D
Sbjct:  440 RLRAAGQDLPADFVKTTVLDNTPIRWFYRAASQESRSGA---------GQTGEIRVDVER  490

Query:  401 RTPNTQRGT  409
            R P  +RGT
Sbjct:  491 RGPAGRRGT  499
```

A homolog was found in serogroup A N. meningitidis but not in serogroup B, so NGS28 protein and nucleic acid are useful for distinguishing between gonococcus and serogroup B N. meningitidis.

Based on this analysis, it was predicted that this protein from N. gonorrhoeae, and its epitopes, could be useful antigens for vaccines or diagnostics.

EXAMPLE 29

A DNA sequence was identified in N. gonorrhoeae <SEQ ID 57> which encodes amino acid sequence <SEQ ID 58; NGS29>. Analysis of this protein sequence reveals the following:

```
GvH: Examining signal sequence (von Heijne)
     Signal Score (-7.5): -3.61
     Possible cleavage site: 31
>>> Seems to have no N-terminal signal seq.
Amino Acid Composition of Predicted Mature Form:
     calculated from 1
ALOM: Finding transmembrane regions (Klein et al.)
     count: 0     value:     4.03 threshold:     0.0
     PERIPHERAL Likelihood =   4.03
     modified ALOM score:    -1.31
Rule: cytoplasmic protein
*** Reasoning Step: 2
----- Final Results -----
     bacterial cytoplasm --- Certainty= 0.106(Affirmative) < succ>
```

The protein has homology with the following sequences in the databases:

```
emb|CAB83930.1|(AL162753) hypothetical protein NMA0640 [Neisseria meningiti-
dis
Z2491]
Length = 387
Score = 653 bits (1685), Expect = 0.0
Identities = 324/388 (83%), Positives = 351/388 (89%), Gaps = 1/388 (0%)

Query:   1 MNITIAAPYCSLPSEPHFNRFWYLAELLSQSHDVLLITSNFKHYDKSFRRPEDAKAASQG   60
           MNITI APYCSLPSEP+FNRFWYLAE LSQSHDVLLITS F+HYDKSFRR EDA A S G
Sbjct:   1 MNITIVAPYCSLPSEPYFNRFWYLAERLSQSHDVLLITSRFRHYDKSFRRHEDAAATSNG   60

Query:  61 RLKVMLLEESGYSKNVSLGRVTSHHRFVKHFEKWLENCRPGEQDVVYSAYPLIATNLLLG  120
           RL+V LL+E GY KNVSL RV SH  FV++  +WL + +  EQD+VYSAYPL+ATNLLLG
Sbjct:  61 RLRVKLLDEPGYRKNVSLARVASHRVFVRNLARWLHSPQAAEQDIVYSAYPLMATNLLLG  120

Query: 121 KHKARLGYKLIVDVQDVWPESFSSVVPFLKKIPHNLLPFASRANRAYRYADALVAVSQTY  180
           KHKARLGYKLIVDVQDVWPESFSSVVPFLKK+PH LLPFASRANRAYR ADAL+AVSQTY
Sbjct: 121 KHKARLGYKLIVDVQDVWPESFSSVVPFLKKVPHKLLPFASRANRAYRCADALIAVSQTY  180

Query: 181 LDRAKEANPNVPGEVVYIGADFAAIAPPPRFRSKTVRFFYLGTLSYNYDVETVCKGVRKL  240
           LDRAKEANPNVPGE VYIG DFAAIA PPRFRSKTVR FYLGTLSY+YDVETVCKGVRKL
Sbjct: 181 LDRAKEANPNVPGETVYIGTDFAAIA-PPRFRSKTVRLFYLGTLSYSYDVETVCKGVRKL  239

Query: 241 LDDGENVELHIMGGGPDLDRLKQYACDGIKFYGYIPYAEMMSVAKGCDIAVNAIHSYAMQ  300
           LDDGENVELHIMGGGPDL++LKQY    IKFYGY+PY+EMMS+AK CDIAVNAIHS+AMQ
Sbjct: 240 LDDGENVELHIMGGGPDLEKLKQYENRAIKFYGYLPYSEMMSIAKACDIAVNAIHSHAMQ  299

Query: 301 SITNKLSDYMALQKPILNSQVHDEVAEVLTLLPHENYRSGDVDGFVQAAKDILKRKNDPV  360
           S+TNKLSDYMALQKPILNSQ + EV ++L LLPHENYRSGDVD FVQAAK+ILKRK+DPV
Sbjct: 300 SVTNKLSDYMALQKPILNSQNNAEVLDLLNLLPHENYRSGDVDSFVQAAKNILKRKDDPV  359

Query: 361 QSDEIVRRFRHDISYRKIVNLIERLANE                                 388
           QSDEIVRRFR DISYRKIVNLIERLA+E
Sbjct: 360 QSDEIVRRFRRDISYRKIVNLIERLAHE                                 387

>emb|CAB58324.1|(AL121855) hypothetical protein SCF62.09 [Streptomyces
coelicolor A3 (2)]
Length = 407
Score = 54.7 bits (130), Expect = 2e-06
Identities = 57/243 (23%), Positives = 105/243 (42%), Gaps = 24/243 (9%)

Query:  99 RPGEQDVVYSAYP---LIATNLLLGKHKARLGYKLIVDVQDVWPESFSSVVPFLKKIPHN  155
           R G  DVV++ P   L    L L    R G + + D+ PE + S    K + +
Sbjct:  81 RVGPVDVVHACNPPDLLFLPALWL----KRRGARFVFDQHDLIPELYLSRFGRGKDLLYR  136

Query: 156 LLPFASANRAYRYADALVAVSQTYLDRAKEANPNVPGEVVYIGA-----DFAAIAPPPR  210
             +      R   YR AD ++A +++Y D A        P +V ++        F + P P
Sbjct: 137 AVCALERWT--YRAADVVLATNESYKDVAIRRGGRRPDDVFVVRSAPATDRFQPVPPEPE  194

Query: 211 F-RSKTVRFFYLGTLSYNYDVETVCKGVRKLLDDGENVELH--IMGGGPDLDRLKQYA--  265
             R K     YLG +     V+    + +  KL D+      + H    +G G   D + + +
Sbjct: 195 LKRGKPHLLCYLGVMGPQDGVDYALRALAKLRDEVGRTDWHAVFVGSGDAFDAMVELSRS  254

Query: 266 ---CDGIKFYGYIPYAEMMSVAKGCDIAVNAIHSYAMQSIT--NKLSDYMALQKPILNSQ  320
              + ++F G IP A++++     D+ ++         + ++  NK+ +YMA+ +PI++
Sbjct: 255 LGLDEQVRFTGRIPDADLVRHLSTADVCLSPDPRNPLNDVSTMNKVLEYMAMGRPIVSFD  314

Query: 321 VHD                                                          323
            + +
Sbjct: 315 LRE                                                          317
```

As a homolog was found in serogroup A *N. meningitidis* but not in serogroup B, NGS29 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 30

A DNA sequence was identified in *N. gonorrhoeae* <SEQ ID 59> which encodes amino acid sequence <SEQ ID 60; NGS30>. Analysis of this protein sequence reveals the following:

Signal Score (−7.5): −4.8
    Possible cleavage site: 46
>>> Seems to have no N-terminal signal seq.
Amino Acid Composition of Predicted Mature Form:
    calculated from 1
ALOM: Finding transmembrane regions (Klein et al.)
    count: 0  value: 1.54  threshold: 0.0
    PERIPHERAL Likelihood = 1.54
    modified ALOM score: −0.81
Rule: cytoplasmic protein
*** Reasoning Step: 2
----- Final Results -----
    bacterial cytoplasm --- Certainty= 0.113(Affirmative) < succ>

The protein has homology with the following sequences in the databases:

```
fastidiosa (strain 9a5c)
gb|AAF84279.1|AE003977_2 (AB003977) conserved hypothetical protein
[Xylella fastidiosa]
Length = 376
Score = 73.6 bits (179), Expect = 3e-12
Identities = 82/354 (23%), Positives = 143/354 (40%), Gaps = 35/354 (9%)

Query:    1 MKIILTTSMSGLGGTETATVRLGRLLKRHGHDIILASSDG-PFVGEAQASGIRWQPVDFY    59
            MKI+ T + +G GG E    R    ++ GH + L    G P     A+ +G+    ++ +
Sbjct:    1 MKILHTEAATGCGGEEIYIYRHMLSMQAQGHHMALLCQPGAPLSTMARNAGLPVYHINMH    60

Query:   60 RGGLAGYLKSTFAYARMLRREQPDIIDCQMARVVPACALAAKIVSPKTKIICHSHGLDAA   119
              G   L     +L+RE D+++      A AA++   +T++I  S  L A
Sbjct:   61 --GPWRVLNGIHTVQHLLQRETFDVVNTTSHVDTLIAAAAARLT--RTRLIVRSRHLMAP   116

Query:  120 TYPKTAKLFDKLGAYIIGNCICHEREKLIRHGFPAGRIAYA---------YNTPPEFHFRK   170
             K+    + L     +I   +H R+ LI+ G   RI           +T PE +++
Sbjct:  117 I--KSQLTYTYLPHRVITVSQHRDLLIKQGIQPTRIGIVPPITA-QPPWMDTDPEHAWQR   174

Query:  171 TEK-------------ECAVLGTLSRLDTRAVHLMLDILKKMVGRNIPVRLNMAGIGEE    217
             ++             ++G ++ L   +   +LD + +   N  + L +AG GE
Sbjct:  175 LQQTRHVVRTELGFNDNDIIVGCVAVLREAKGHRELLDAIAPLCQANPRLHLVIAGDGEP   234

Query:  218 -MDNLKAQAKRLGIEDKVTFLGGVRDLTGYFKEVDILVNTPHCVGDHGAGVGNNILEAGL   276
              M +L A   K L +E ++  LG   D         DI    +       G     LEA
Sbjct:  235 VMQHLLAHRKTLTLETQIHLLGYRHDAPRLMSGFDIFA-----LATQKEAAGTVFLEAAQ   289

Query:  277 YDTPVVTYNMAGISEMVITGQTGYCIPFGDDEAFIEAVDTLIKHPELRSQNGKA        330
             P++      + G+ EM+  G     + G+  A     A+ TL+ + + R  MG+A
Sbjct:  290 AGIPIIATRVGGVPEMLQEGTNAILVTPGNQTALTNALHTLVTNNQQRHSMGRA        343
```

A homolog was found in serogroup A *N. meningitidis* but not in serogroup B, so NGS30 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 31

A DNA sequence was identified in *N. gonorrhoeae* <SEQ ID 61> which encodes amino acid sequence <SEQ ID 62; NGS31>. Analysis of this protein sequence reveals the following:

GvH: Examining signal sequence (von Heijne)   Signal Score
(−7.5): −5.36

Possible cleavage site: 16
>>> Seems to have no N-terminal signal seq.
Amino Acid Composition of Predicted Mature Form:
  calculated from 1
ALOM: Finding transmembrane regions (Klein et al.)
  count: 0   value: 3.50   threshold: 0.0
  PERIPHERAL Likelihood = 3.50
  modified ALOM score: −1.20
Rule: cytoplasmic protein
*** Reasoning Step: 2
----- Final Results -----
  bacterial cytoplasm --- Certainty= 0.299(Affirmative) < succ>

The protein has homology with the following sequences in the databases:

```
gb|AAB49297.1|(U84350) hypothetical hydroxylase a [Amycolatopsis
orientalis]
Length = 491
Score = 111 bits (278), Expect = 1e-23
Identities = 87/269 (32%), Positives = 123/269 (45%), Gaps = 15/269 (5%)

Query:    1 LKNGAAFSWGSRYTEFDF----TDKFSDGPGTVYQVRRAVRDKILIEEAAKQGVEVRFGH   56
            +K G   F WG+R   + F     + K  +     YQV RA FD IL++ A  +GV VR  G
Sbjct:   73 IKRGGTFRWGARPEPWTFHFGISAKMAGSTSHAYQVERAKFDDILLKNAKSKGVVVREGC   132

Query:   57 GVTAFDNSGDFARLNIETDT-GESYELTAKFVLDASGY-GRVLPRLLNLETPSHLPPRQT   114
                V    G+              TD G ++E++A+FV+DASG    R+   ++           S
Sbjct:  133 SVNDVVEDGERVTGARYTDADGNAHEVSARFVIDASGNKSRLYTKVNGRNYSEFFRSLA   192

Query:  115 HFTHIDDNITHPKFDRNKILITTHPQHRDVWIWLIPFGDNRCSVGVV---GTPKLAGES   171
             F + +      P+    IL      W W I P  D   SVG V        DK+ G+
Sbjct:  193 LFGYFEGGKRLPEPVSGNILSVAFDSG---WFWYIPLSDTLTSVGAVVRREDADKIQGDR   249
```

```
Query: 172 ETVLKKFVYECPHLSEILDKAVWENDFPFRSIQ---GYSANVKSLHGEHFALLGNAAEFL 228
            E   L   + ECP++SE L   A        +  ++   YS  S       L+G+AA F+
Sbjct: 250 EKALNTLIAECPLISEYLSNATRVTRYGELRVRKDYSYQQDSYWRPGMVLVGDAACFV   309

Query: 229 DPVFSSGVTIALHSAELAADLLTKQLKGE                                257
            DPVFSSGV +A +SA LAA  +   L G+
Sbjct: 310 DPVFSSGVHLATYSALLAARSINSVLAGD                                338
```

A homolog (amino acids 280-341) was found in serogroup A *N. meningitidis* but not in serogroup B, so NGS31 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 32

A DNA sequence was identified in *N. gonorrhoeae* <SEQ ID 63> which encodes amino acid sequence <SEQ ID 64; NGS32>. Analysis of this protein sequence reveals the following:

Signal Score (−7.5): −3.49
    Possible cleavage site: 38
>>> Seems to have no N-terminal signal seq.
Amino Acid Composition of Predicted Mature Form:
    calculated from 1
ALOM: Finding transmembrane regions (Klein et al.)
    count: 0    value:    7.80    threshold:    0.0

PERIPHERAL Likelihood =    7.80
    modified ALOM score:    −2.06
Rule: cytoplasmic protein
*** Reasoning Step: 2
----- Final Results -----
    bacterial cytoplasm --- Certainty= 0.278(Affirmative) < succ>

The protein has homology with the following sequences in the databases:

```
fastidiosa (strain 9a5c)
gb|AAF83310.1|AE003899_2 (AE003899) phage-related repressor protein
[Xylella fastidiosa]
Length = 143
Score = 87.0 bits (214), Expect = 2e-16
Identities = 40/71 (56%), Positives = 54/71 (75%)

Query:   1 MFSGEQLGQAISEAIKRKNVSQKEVADHFGVKQPSVSGWIKNGRIDKKHLDKLIDYFSDV   60
            M +GEQLG+AI +A++ K V+  ++A+HFGVK PSV GWIK GRI K+ L   L   YFSDV
Sbjct:   1 MLTGEQLGRAIKQAMQLKGVTPTKMAEHFGVKAPSSVYGWIKEGRISKEKLPSLWSYFSDV   60

Query:  61 VTPSHFGIETF                                                   71
            V P+H+G+E +
Sbjct:  61 VGPTHWGLEAW                                                   71

>sp|P18680|RPC1_BPHK0 26 KD REPRESSOR PROTEIN (REGULATORY PROTEIN CI)
emb|CAA34222.1|(X16093) cI gene product (AA 1-208) [Bacteriophage HK022]
Length = 235
Score = 80.5 bits (197), Expect = 2e-14
Identities = 60/200 (30%), Positives = 99/200 (49%), Gaps = 15/200 (7%)

Query:  22 QKEVADHFGVKQPSVSGWIKNGRIDKKHLDKLIDYFSDVVTPSHF--------GIETFRV   73
            Q ++A    V  ++S W      1 +K  DK+    S +  T + +        GI    +
Sbjct:  29 QADLARLKVTPKAISKFNGESIPRK--DESLASVLGTTAAYLHGYADDDGITVNHL      86

Query:  74 LKSNEQSSIRFPRLNAEATCGAGT-INDHYIEVVDYVTVAAAWAREKLGGNLNK-IQVIT  131
            +SN+       R   L+ +A+ G GT  +++ +IE  +        AR     G   +  ++VIT
Sbjct:  87 SRSNDY--YRVDVLDVQASAGPGTMVSNEFIEKIRAIEYTTEQARILFNGRPQESVKVIT  144

Query: 132 ARGDSMEPTIENGDVMFVDTAVEAFDGDGLYLLWYIDGLKAKRLQSTVGGGLMIISDNSS  191
            RGDSME  TI   GD +FVD ++    FDGDG+Y+   Y    +  KRLQ       L +ISDN++
Sbjct: 145 VRGDSMEGTINPGDEIFVDVSITCFDGDGIYVFVYGKTMHVKRLQMQ-KNRLAVISDNAA  203

Query: 192 YRTETVRGEDLNAVRIIGRI                                          211
            Y    +      +    + I+ ++
Sbjct: 204 YDRWYIEEGEEEQLHILAKV                                          223
```

Based on this analysis, it was predicted that this protein from *N. gonorrhoeae*, and its epitopes, could be useful antigens for vaccines or diagnostics.

EXAMPLE 33

A DNA sequence was identified in *N. gonorrhoeae* <SEQ ID 65> which encodes amino acid sequence <SEQ ID 66; NGS33>. Analysis of this protein sequence reveals the following:

```
GvH: Examining signal sequence (von Heijne)
        Signal Score (-7.5): -4.87
        Possible cleavage site: 31
>>> Seems to have no N-terminal signal seq.
Amino Acid Composition of Predicted Mature Form:
    calculated from 1
ALOM: Finding transmembrane regions (Klein et al.)
        count:  0   value:  4.88 threshold:  0.0
        PERIPHERAL Likelihood =   4.88
        modified ALOM score:   -1.48
Rule: cytoplasmic protein
*** Reasoning Step: 2
----- Final Results -----
        bacterial cytoplasm --- Certainty= 0.313(Affirmative) < succ>
```

The protein has homology with the following sequences in the databases:

```
gb|AAF31132.1|(AF069529) Gp54 [Bacteriophage HK97]
Length = 273
Score = 47.4 bits (111), Expect = 3e-04
Identities = 33/123 (26%), Positives = 52/123 (41%), Gaps = 20/123 (16%)

Query: 221 NGGLSGKPKNANVPRRRKTHGVPLQEIADLYNEVLGGRLPSVQVLNDTRKRAIANRWCEM  280
           NGG  G+ K    P RRK    +  +   + YN  +G RLP    +N+ RKR +  +
Sbjct: 160 NGGGDGQVK----PERRKAERIDYESFLNAYNTEVGDRPHAVAVNEKRKRRL-KKIIPQ  214

Query: 281 LGTAAPNGKVRFGDKETGIAFAGFFRKVA--MNPFWMGENQTGFAVGFDWIFKAGNFVK  338
           L T    +G           F  + R     PF+ G+N TG+ FD++ +    +
Sbjct: 215 LKTPNVDG------------FRAYVRAFVHQAKPFYFGDNDTGWTADFDYLLREDSLTG  261

Query: 339 ILE  341
           + E
Sbjct: 262 VRE  264
```

Based on this analysis, it was predicted that this protein from *N. gonorrhoeae*, and its epitopes, could be useful antigens for vaccines or diagnostics.

EXAMPLE 34

A DNA sequence was identified in *N. gonorrhoeae* <SEQ ID 67> which encodes amino acid sequence <SEQ ID 68; NGS34>. Analysis of this protein sequence reveals the following:

```
GvH: Examining signal sequence (von Heijne)
        Signal Score (-7.5): -5.65
        Possible cleavage site: 50
>>> Seems to have no N-terminal signal seq.
Amino Acid Composition of predicted Mature Form:
    calculated from 1
ALOM: Finding transmembrane regions (Klein et al.)
        count:  0   value:  3.76 threshold:  0.0
        PERIPHERAL Likelihood =   3.76
        modified ALOM score:   -1.25
Rule: cytoplasmic protein
*** Reasoning Step: 2
----- Final Results -----
        bacterial cytoplasm --- Certainty= 0.310(Affirmative)
            < succ>
        bacterial periplasmic space --- Certainty= 0.000(Not Clear)
            < succ>
        bacterial outer membrane --- Certainty= 0.000(Not Clear)
            < succ>
        bacterial inner membrane --- Certainty= 0.000(Not Clear)
            < succ>
```

The protein has homology with the following sequences in the databases:

```
>pir||H82649 hypothetical protein XF1674 XF1569 [imported]-
Xylella fastidiosa (strain 9a5c)
gb|AAF84378.1|AE003986_8 (AE003986) hypothetical protein
[Xylella fastidiosa]
gg|AAF84483.1|AE003993_2 (AE003993) hypothetical protein
[Xylella fastidiosa]
Length = 316
Score = 167 bits (424), Expect = 2e-40
Identities = 108/308 (35%), Positives = 152/308 (49%), Gaps = 30/308 (9%)

Query:  10 ETSVIRSLSSASLYMFTRRMFYQRRGYVWQRANHHAPICNLERVFTIGETKRLIINIPPR   69
           E +VI++  A    FTR F QR+   ++   HH I   ++ V  G  K ++IN+PP
Sbjct:  10 EQAVIKARCEADHLFFTRYFFKQRQQLRFRVNWHHHVIAGVVDDVIAGRRKDVVINVPPG   69

Query:  70 YSKTEIAVVNFIAWAMGRVPDCEFIHASYSAALAVNNSVQIRNLVQHEEYRAIFP-DLAL  128
           +SKTE+  +N +A +    P    F+H SYS  LA+ NS    R +VQ +EYRA++P ++A
Sbjct:  70 SSKTELVAINVMARGLALNPYARFLHISYSDDLALLSETAREIVQSDEYRALWPLEIAD  129

Query: 129 AGESGHHWKTT-----AGGVMYXXXXXXXXXXXXXXXRHREGFGGCIIIDDPHKADEARSE  183
           +S   W         AGGV Y                G+  G III DDP K ++A S+
Sbjct: 130 DAKSKKRWVVDGKKAGGV-YAVSLGGQVTGFRAGHAPGWQGAIIIDDPLKVEDAYSK     188

Query: 184 VRRQNVIDWFQNTVESRKNSPDTPIILIMQRLHEKDLAGWLLDGGNGEEWEHLCLPAIQE  243
           R        +TV+SRK SPDTPII+IMQRL + D   G++  GG      WE + +PA+ +
```

```
                               -continued
Sbjct:  189 TGRSKANRKLVSTKSRASPDTPIIVIMQRLAQDDPTGFIQSGGFPGAWECIEIPALID  248

Query:  244 DG----------------------TALWPEKHDIETLRREQAAPWFAGQYLQKPAPP     280
            D                      + WP K  +  L  +E     YVF+GQY Q+P+P
Sbjct:  249 DAYVSRLPEHVQGQVVRDAQDQDGRYSYWPYKEPLAELLALEATDRYVFSGQYQQRPSPL  308

Query:  281 DGGTFKPD                                                    288
            GG  K D
Sbjct:  309 GGGIIKGD                                                    316
```

Based on this analysis, it was predicted that this protein from *N. gonorrhoeae*, and its epitopes, could be useful antigens for vaccines or diagnostics.

EXAMPLE 35

A DNA sequence was identified in *N. gonorrhoeae* <SEQ ID 69> which encodes amino acid sequence <SEQ ID 70; NGS35>. Analysis of this protein sequence reveals the following:

---

GvH: Examining signal sequence (von Heijne)
    Signal Score (-7.5): -1.07
    Possible cleavage site: 40
>>> Seems to have no N-terminal signal seq.
Amino Acid Composition of Predicted Mature Form:
    calculated from 1
ALOM: Finding transmembrane regions (Klein et al.)
    count: 0   value:   1.64 threshold:   0.0
    PERIPHERAL Likelihood =   1.64
    modified ALOM score:   -0.83
Rule: cytoplasmic protein
*** Reasoning Step: 2
----- Final Results -----
    bacterial cytoplasm --- Certainty= 0.020(Affirmative) < succ>

---

The protein has homology with the following sequences in the databases:

A homolog (amino acids 641-700) was found in serogroup A *N. meningitidis* but not in serogroup B, so NGS35 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 36

A DNA sequence was identified in *N. gonorrhoeae* <SEQ ID 71> which encodes amino acid sequence <SEQ ID 72; NGS36>. Analysis of this protein sequence reveals the following:

---

GvH: Examining signal sequence (von Heijne)
    Signal Score (-7.5): 4.3
    Possible cleavage site: 26
>>> Seems to have a cleavable N-term signal seq.
Amino Acid Composition of Predicted Mature Form:
    calculated from 27
ALOM: Finding transmembrane regions (Klein et al.)
    count: 0   value:   1.70 threshold:   0.0
    PERIPHERAL Likelihood =   1.70
    modified ALOM score:   -0.84
Score for OM-PP discrimination:   0.02

---

```
>ref|NP_047925.1|gp34 [Bacteriophage phi-C31]
emb|CAA07104.1|(AJ006589) gp34 [Bacteriophage phi-C31]
Length = 457
Score = 59.7 bits (143), Expect = 1e-07
Identities = 68/272 (25%), Positives = 117/272 (43%), Gaps = 49/272 (18%)

Query:  226 GYSPVEQIIMTVNIALKRQVHALEYYTAGSVPDALVGVPETWSADDIRRFQEYWDLLLSG  285
            G SP+      +++ AL Q +  +++  G++P A+V VP T S + + R +E W    SG
Sbjct:  192 GCSPISYARESIGLALAAQKYGSKFFANGGAMPGAVVEVPGTMSKEGLARAREAWRAANSG 251

Query:  286 -----------ETAQRRKMRFVPGELSRNFRETRQPPLKDVYDEWLARVVCFAFSVEPTP  334
                       E A+  K+   P E   F +T+Q  + ++     AR+    F V P
Sbjct:  252 VDNAHRVALLTEGAKFSKVAMSPDEAQ--FLQTRQFQVPEI-----ARI----FGVPPH-  299

Query:  335 FVAQVNRSVAETS--REQSLSDGMGSLKNWVKALIDDVLARYMDMAA--YEFVWKGEESL  390
            ++    S + S    EQ+++  M SL+ W++ +         A  + FV    + +
Sbjct:  300 LISDATNSTSWGSGLAEQNIAFTMFSLRPWLERIEAGFNRLLFAETADRFRFVKFNLDEI  359

Query:  391 N---PKEQAEIYAIYKNAGILTADEIRAELGKEPLP-GQG--------------QPEPDK  432
                PKE+ E++++    GI + DE+RA       PLP G G                +PEP+
Sbjct:  360 KRGAPKERMELWSLGLQNGIYSIDEVRAAEDMTPLPDGLGEKYRVPLNLGEVGEEPEPEP  419

Query:  433 QDG----RKPEEPPNQGAEKLGKSESPMSEDE                             460
                     P E P++   E   GK +    +E
Sbjct:  420 APAPPAIEPPAEEPDEEPEPEGKPDDEGATEE                             451
```

Rule: outer membrane or periplasmic protein
Score for OM-PP discrimination: 0.02
Rule: outer membrane or periplasmic protein
*** Reasoning Step: 2
Outer membrane?  score: 0.00213559
Outer membrane?  score: 0.00213559

----- Final Results -----
bacterial outer membrane --- Certainty= 0.232(Affirmative)
< succ>

The protein has homology with the following sequences in the databases:

```
>pir||D82437 TonB receptor-related protein VCA0625 [imported]-Vibrio
cholerae (group O1 strain N16961)
gb|AAF96526.1|(AE004392) TonB receptor-related protein [Vibrio cholerae]
Length = 784
Score = 103 bits (256), Expect = 2e-20
Identities = 104/427 (24%), Positives = 162/427 (37%), Gaps = 100/427 (23%)

Query:    31 NTEQQKELNTIVVHGKRS-ADQKGADDVYYKNVSNAYVGKEYLERYRVQSAGDVLKGLNG    89
             NTEQ   + T+ VHG+    DQ+  D            L++ R   D+  G+
Sbjct:    57 NTEQAVD-ETVTVHGQSILTDQRTRSD---------------LDkVRGIANADIFSGITS   100

Query:    90 VYNMNTRTAGGAITPNIRGITGKGRIPVTIDGTEQTIDVWMNNYGVGDRNYLDPALFRSI   149
             V + N     GA+   IRG+ G+GR+P+  IDG+ Q+        GV DR Y+D  L  S+
Sbjct:   101 VQSNNMHNEAGALDIGIRGVQGEGRVIFIDGSLQSTHTSRGYQGVSDRTYIDTDLLSSL   160

Query:   150 AVEKSPALTRG--VKSGVGGAMSIRTIEPSDIIPEGRNWGIEVKTEFSGNTVAQKNDLRQ   207
              V K   +       VGG ++  T+   DII + +  +G+ +K
Sbjct:   161 TVNKGATIESSPYASGAVGGVVNATTLGIKDIIKDDQAFGVVLK----------------   204

Query:   208 FLGRDYRTLSPIGATADGVSGMPDVLTGYTGKPSPTALLLDEGIADTKFSGGKSHTNFKD   267
              A A+  +    PDV   Y+ +       LDE    + F  G
Sbjct:   205 -------------ARANNHNRTPDVSGDYSEQGQ---YALDERGEHSAFKHG--------   240

Query:   268 DRQLMLSAAFKTDITDGLAAYSHRQKGNYYAGKRGYQSYLNNPI--YGADACYDQYPDKS   325
                LML  ++ +  + +  AYS R KGN++AGK+GY+ Y    P+   G +      + S
Sbjct:   241 --SLMLGLGYQAESFTVLAYSKRSKGNHFAGKKGYEEY-QEPVVGQGQEVVNTSFESDS   297

Query:   326 WREKDILCKSASLVPNMAVLFRPGEEIMNSHTDTKILLLKNNWYLPDNQKISLQYMDNK   385
             W K       S     N     +R        H    +L  WY           Y D K
Sbjct:   298 WLFK---LASDTGTAHNADFNYR--------HHAQKAGEVLMAYWYKSSEDWEGNPYPDGK   347

Query:   386 IGFGEINPLITAWILGFAEQSLNEPVQQAPGIGTKIDSKTYKIGYEWKPQNNKWIDLQAD   445
                  +   W LG A+  +                      TY   Y ++P ++ W++L A+
Sbjct:   348 -------DRMPQWGLGTAKVN------------------TYSANYYQP-DHPWLNLNAN   381

Query:   446 MWRVKTD                                                       452
             W  + D
Sbjct:   382 FWYTEAD                                                       388

Score = 94.7 bits (234), Expect = 5e-18
Identities = 80/290 (27%), Positives = 126/290 (42%), Gaps = 37/290 (12%)

Query:   929 SYDLDNHLFARYASRFPSLYELTAATGSGGLYGSETVAEYS----LKPEKSTNWEV     984
             +Y L   +LF   +R  R PSLYE  T          S  V  Y+    +KPE++  N  EV
Sbjct:   514 TYALTPSTQLFLKSSRTYRMPSLYETTL---------SNEVFSYNPYNPIKPEQAWNNEV   564

Query:   985 GYNFNFAPHFAKLRQGDLRLTYYSNKIKNQIDTSN--EDGGMIQ---------YDKAVSK  1033
             G F     +   + +L ++Y+ N  IK+ I     +  GM +             YDK
Sbjct:   565 GVQFMASNSVLQDDRLNLSVSYFRNSIKDFISGGRLAKTPGMSEWQANFTFTNYDKLQLS   624

Query:  1034 GVELQSRLDSGRFFASFGGTYRLKHMVCDKGIAFKFDYYLQRVPECLEGGFGLSRFFQSL  1093
             G EL +       + F  T      +C   A         C     GF      +
Sbjct:   625 GWELGAHYQYAWILYTHPAATLYSETKICSVQQA-----QYAESDTCNSLGFAWGLTPTRI   679

Query:  1094 QPKYSLTLDVGTRFFNEKLELGMRAIHHSKAERRNYDKLIADGAGQVYARNGKPYGWHAA  1153
             PK +L L+VGT+FFN+ L+ G++     +HS     + N     +A  A                Y
Sbjct:   680 PPKQNLYLNVGTKFFNDTLDSGVSYHSG--KSNPSDWLAGTAANPILEIPSDY-----   732

Query:  1154 TLLDAYARYRIGKHIDLNFSVTNLANRYYLDPMSSTPVPGPGRTITFGIK           1203
              +D Y++Y +    +   L F++  N+ +RY + P S     +P PGRTIT G +
Sbjct:   733 -TIDLYSQYELNANTQIFFAINNVTDRYQVRPGSVVSMPDPGRTITLGFE            781
```

Based on this analysis, it was predicted that this protein from *N. gonorrhoeae,* and its epitopes, could be useful antigens for vaccines or diagnostics.

EXAMPLE 37

A DNA sequence was identified in *N. gonorrhoeae* <SEQ ID 73> which encodes amino acid sequence <SEQ ID 74; NGS37>. Analysis of this protein sequence reveals the following:

```
GvH: Examining signal sequence (von Heijne)
    Signal Score (-7.5): 4.47
    Possible cleavage site: 21
>>> Seems to have a cleavable N-term signal seq.
Amino Acid composition of Predicted Mature Form:
    calculated from 22
ALOM: Finding transmembrane regions (Klein et al.)
    count: 0   value:  7.21 threshold:  0.0
    PERIPHERAL Likelihood =   7.21
    modified ALOM score:   -1.94
Score for OM-PP discrimination: 16.42
Rule: outer membrane or periplasmic protein
Score for OM-PP discrimination: 16.42
Rule: outer membrane or periplasmic protein
*** Reasoning Step: 2
Outer membrane?   score: 1.64214
Outer membrane?   score: 1.64214
----- Final Results -----
        bacterial outer membrane --- Certainty= 0.938(Affirmative)
        < succ>
```

The protein has homology with the following sequences in the databases:

The protein was expressed in *E. coli* as an insoluble 32.45 kDa His-fusion product and then purified.

Based on this analysis, it was predicted that this protein from *N. gonorrhoeae,* and its epitopes, could be useful antigens for vaccines or diagnostics.

EXAMPLE 38

A DNA sequence was identified in *N. gonorrhoeae* <SEQ ID 75> which encodes amino acid sequence <SEQ ID 76; NGS38>. Analysis of this protein sequence reveals the following:

```
GvH: Examining signal sequence (von Heijne)
    Signal Score (-7.5): 0.34
    Possible cleavage site: 24
>>> Seems to have a cleavable N-term signal seq.
Amino Acid Composition of Predicted Mature Form:
    calculated from 25
ALOM: Finding transmembrane regions (Klein et al.)
    count: 0   value:  3.98 threshold:  0.0
    PERIPHERAL Likelihood =   3.98
    modified ALOM score:   -1.30
Score for OM-PP discrimination: 2.87
Rule: outer membrane or periplasmic protein
Score for OM-PP discrimination: 2.87
Rule: outer membrane or periplasmic protein
*** Reasoning Step: 2
Outer membrane?   score: 0.287446
Outer membrane?   score: 0.287446
----- Final Results -----
        bacterial outer membrane --- Certainty= 0.607(Affirmative)
        < succ>
```

The protein has homology with the following sequences in the databases:

```
>sp|Q03155|AIDA_ECOLI ADHESIN AIDA-I PRECURSOR
pir||S28634 adhesin AIDA-I precursor-Escherichia coli plasmid pIB6
emb|CAA46156.1|(X65022) AIDA-I [Escherichia coli]
Length = 1286
Score =  35.8 bits (81), Expect = 0.67
Identities = 34/138 (24%), Positives = 62/138 (44%), Gaps = 16/138 (11%)

Query:    3 ASQLTLAVLLAAAFGSAYAVEVKGGDSSKGQLIQAAESDFLPFGSGAADIKVSTGNGLSK   62
            A   L + + + G+A+AV + G  SS G  + + E+ +  G G ++  V++G    ++
Sbjct:   31 AKNTLLVLAWSTIGNAPAVNISGTVSS-GGTVSSGETQIVYSGRGNSNATVNSGG-TQ    87

Query:   63 SINLEAGPAQRIRNKYGNAPINGGNQNTNVNGAANSRYLQPGDINPIA--GWFSKTRLA-  119
            +N          N         + G+QN   +GA  S  +  G I ++   G  S T L+
Sbjct:   88 IVNNGGKTTATTVN-------SSGSQNVGTSGATISTIVNSGGIQRVSSGGVASATNLSG  140

Query:  120 ---QVWYEKRANNTEVFS                                            134
               ++    A+NT +FS
Sbjct:  141 GAQNIYNLGHASNTVIFS                                            158
```

```
>sp|Q03155|AIDA_ECOLI ADHESIN AIDA-I PRECURSOR
 pir||S28634 adhesin AIDA-I precursor-Escherichia coli plasmid pIB6
 emb|CAA46156.1|(X65022) AIDA-I [Escherichia coli]
          Length = 1286
 Score = 35.8 bits (81), Expect = 0.67
 Identities = 34/138 (24%), Positives = 62/138 (44%), Gaps = 16/138 (11%)

Query:   3 ASQLTLAVLLAAAFGSAYAVKGGDSSKGQLIQAAESDFLPFGSGAADIKVSTGNGLSK   62
           A    L +++  G+A+A+V + G  SS G  ++ E+  +  G G ++  V++G   ++
Sbjct:  31 AKNTLLVLAVVSTIGNAFAVNISGTVSS-GGTVSSGETQIVYSGRGNSNATVNSGG--TQ   87

Query:  63 SINLEAGPAQRIRKYGNAPINQGNQNTNVNGAANSRYLQPGDINPIA--GWFSKRLA-   119
             +N       N        + G+QN  +GA  S +  GI ++   G S T L+
Sbjct:  88 IVNNGGKTTATTVN-------SSGSQNVGTSGATISTIVNSGGIQRVSSGGVASATNLSG   140

Query: 120 ----QVWYEKRANNTEVFS   134
               ++       A+NT +FS
Sbjct: 141 GAQNIYNLGHASNTVIFS   158

>pir||G81213 conserved hypothetical protein NMB0313 [imported]-Neisseria
 meningitidis (group B strain MD58)
 gb|AAF40758.1|(AE002388) conserved hypothetical protein [Neisseria
 meningitidis MC58]
          Length = 488
 Score = 84.3 bits (207), Expect = 3e-15
 Identities = 111/498 (22%), Positives = 185/498 (36%), Gaps = 35/498 (7%)

Query:   7 LLFLPLCTVCLAAPSNDAADERRRLLDEGSRQTQQYRESGW--LDTEQARGEVEENDGY   64
           +L LPL       S    A+E  R  D  SR  + +E+     +D E+  G+V  E    +
Sbjct:  19 MLLLPLLA------SAAYAEETPREPDLRSRPEFRLHEAEKPIDREKPGQVREKGKVL   72

Query:  65 SIGGEIYQVGDTAEELESAIYHALNARQWHKVRQFAARYAKLPRHKPALIHLADALQKRD   124
             I GE        E L  A+Y A+ +    +R      Y+   +   L   A   +   +
Sbjct:  73 QIDGETLL--KNPELLSRAMYSAVVSNNIAGIRVILPIYLQQAQQDKMLALYAQGILAQA   130

Query: 125 EGDFRAAGNSFQTALEAEPDNPRLLLEAGRFYAEDNQNKESAAAFEKVLKTDIPAETRPI   184
             +G + A +  + + A+PD P + +        E+    QN+  +A    F+++   ++P +
Sbjct: 131 DGRVKEAISHYRELIAAQPDAPAVRMRLAAALFENRQNEAAADQFDRLKAENLPPQLMEQ   190

Query: 185 VENYLSELGKRRRWHGQISLGYGYNSNVNQGNGINQCVWEIAGMCLMERTLPAPTDSTFS   244
             VE Y   L +R W            N+NQ    Q         + T P    D T
Sbjct: 191 VELYRKALRERDAWKVNGGFSVTREHNINQAPKRQQ---------YGKWTFPKQVDGTAV   241

Query: 245 SYSATAEKTVPLKGNHGVQVRGVLYGNRYTEKDKDSAAMPDYGYNGSLYAGYAYADARS   304
            +Y   AEK     LK        G +G Y    K        +    +  G +AD R
Sbjct: 242 NYRLGAEKKWSLKNGWYTTAGGDVSGRVYPGNKK-------FNDMTAGVSGGIGFADRRK   294

Query: 305 SFSLLPYFEYDFRNRHTHYRAWGADADWSRTLSPHNRINSHAGAKKTGYGGQSKTYFADF   364
              L + E       +   GA  ++R +P W+  S A   + G     ++   +D
Sbjct: 295 DAGLAVFHERRTYGNDAYSYTNGARLYFNRWQTPKWQTLSSA---EWGRLKNTRRARSDN   351

Query: 365 KQYELGAGAEFSITLKSGLLVNFDAAPKAYP-EKSSSSKEYTARLGAYRLFSGGTYLNAV   423
            ++       F  +    +  D R+ P ++ +      Y  R A+    GG+ L+++
Sbjct: 352 THLQISNSLVFYRNARQYMGGLDFYRERNPADRGDNFNRYGLRF-AWGQEWGGSGLSSL   410

Query: 424 LLY--RRSLYDAASFVSDNK--RRRDKQYIMMAAAGFPQWNIKGVYPELRFRRTIAHSNA   479
           L    + Y+    F S K  RRRDK+        +    + KG+ P L       SN
Sbjct: 411 LRLGAAKRHYEKPGFFSGFKGERRRDKELNTSLSLWHRALHFKGITPRLTLSHRETRSND   470

Query: 480 VYYRYRQNEWLLGFKYRF   497
            V+  Y +N   +F  F
Sbjct: 471 VFNEYEKNRAFVEFNKTF   488

>pir||C81790 conserved hypothetical protein NMA2174 [imported]-
 Neisseria meningitidis (group A strain Z2491)
 emb|CAB85386.1|(AL162758) conserved hypothetical protein [Neisseria
 meningitidis Z2491]
          Length = 490
 Score = 84.0 bits (206), Expect = 4e-15
 Identities = 111/498 (22%), Positives = 185/498 (36%), Gaps = 35/498 (7%)

Query:   7 LLFLPLCTVCLAAPSNDAADERRRLLDEGSRQTQQYRESGW--LDTEQARGEVEENDGYI   64
           +L LPL       S    A+E  R  D  SR  + +E+     +D E+  G+V  E    +
Sbjct:  21 MLLLPLLA------SAAYAEETPREPDLRSRPEFRLHEAEVKPIDREKVPGQVREKGKVL   74

Query:  65 SIGGEIYQVGDTAEELESAIYHALNARQWHKVRQFAARYAKLPRHKPALIHLADALQKRD   124
             I GE        E L  A+Y A+ +    +R      Y+   +   L   A   +   +
Sbjct:  75 QIDGETLL--KNPELLSRAMYSAVVSNNIAGIRVILPIYLQQAQQDKMLALYAQGILAQA   132

Query: 125 EGDFRAAGNSFQTALEAEPDNPRLLLEAGRFYAEDNQNKESAAAFEKVLKTDIPAETRPI   184
```

```
                +G   + A + ++   + A+PD P + +           E+ QN+ +A  F+++     ++P +
Sbjct:  133 DGRVKEAISHYRELIVAQPDAPAVRMRLAAALFENRQNEAAADQFDRLKAENLPPQLMEQ  192

Query:  185 VENYLSELGKRRWHGQISLGYGYNSNVNQGNGINQCVWEIAGMCLMERTLPAPTDSTFS  244
            VE Y    L  +R   W            N+NQ    Q             + T P    D T
Sbjct:  193 VELYRRKALRERDAWKVNGGFSVTREHNINQAPKRQQ---------YGKWTFPKQVDGTAV 243

Query:  245 SYSATAEKTVPIKGNHGVQVGVLYGNRYTEKSDYGYRNGSLYAGYAYADARS  304
            +Y    AEK    LK        G +G  Y      K        +   + G  +AD R
Sbjct:  244 NYRLGAEKKWSLKNGWYTTAGGDVSGRVYPGNKK-------FNDMTAGVSGGIGFADRRK  296

Query:  305 SFSLLPYFEYDFRNRHTHYRAWGADADWSRTLSPHRINSHAGAKKTGYGGQSKTYFADF  364
              L    + E          +       GA       ++R   +P W+  S A    +G      ++   +D
Sbjct:  297 DAGLAVFHERRTYGNDAYSYTNGARLYFNRWQTPKWQTLSSA---EWGRLKNTRRARSDN  353

Query:  365 KQYELGAGAEFSITLKSGLLVNFDAARKAYP-EKSSSSKEYTARLGAYRLFSGGTYLNAV  423
              ++       F     +       +     D  R+   P ++   +    Y   R   A+      GG+ L+++
Sbjct:  354 THLQISNSLVFYRNARQYWMGGLDFYRERNPADRGDNFNRYGLRF-AWGQEWGGSGLSSL  412

Query:  424 LLY--RRSLYDAASFVSDNK--RRRDKQYIMMAAAGFPQWNIKGVYPELRFRRTIAHSNA  479
            L    + Y+    F S  K    RRRDK+       +      + KG+ P L            SN
Sbjct:  413 LRLGAAKRHYEKPGFFSGFKGERRRDKELNTSLSLWHRALHFKGITPRLTLSHRETRSND  472

Query:  480 VYYRYRQNEWLLGFKYRF  497
            V+   Y +N    + F   F
Sbjct:  473 VFNEYEKNRAFVEFNKTF  490
```

The protein was expressed in *E. coli* as an insoluble 52.03 kDa His-fusion product and then purified.

Based on this analysis, it was predicted that this protein from *N. gonorrhoeae*, and its epitopes, could be useful antigens for vaccines or diagnostics.

EXAMPLE 39

A DNA sequence was identified in *N. gonorrhoeae* <SEQ ID 77> which encodes amino acid sequence <SEQ ID 78; NGS39>. Analysis of this protein sequence reveals the following:

---

GvH: Examining signal sequence (von Heijne)
  Signal Score (−7.5): −5.38

Possible cleavage site: 18
  >>> Seems to have no N-terminal signal seq.
Amino Acid Composition of Predicted Mature Form:
  calculated from 1
ALOM: Finding transmembrane regions (Klein et al.)
  count: 0    value: 7.16 threshold: 0.0
  PERIPHERAL Likelihood = 7.16
  modified ALOM score: −1.93
Rule: cytoplasmic protein
*** Reasoning Step: 2
----- Final Results -----
  bacterial cytoplasm --- Certainty= 0.325(Affirmative) < succ>

---

The protein has homology with the following sequences in the databases:

```
>ref|NP_052685.1|serine protease EspP [Eseherichia coli]
pir||T00317 probable serine proteinase espP, extracellular-Escherichia coli
plasmid pO157
pir||T42120 probable serine proteinase espP, extracellular-Escherichia coli
plasmid pO157
emb|CAA66144.1|(X97542) putative exoprotein-precursor [Escherichia coli]
dbj|BAA31836.1|(AB011549) serine protease EspP [Escherichia coli]
gb|AAC70088.1|(AF074613) putative exoprotein-precursor [Escherichia coli
O157:H7]
        Length = 1300

Score = 58.9 bits (141), Expect = 2e-07
 Identities = 153/687 (22%), Positives = 248/687 (35%), Gaps = 106/687 (15%)

Query:  194 DLTVENKTLSDA---EFGVYALNTSMVNLSSKDNNEVKSTQVGLYSQDGGSINVDR---  247
            D       +NT +DA           Y  N ++  +LS   D   E    + + G           +V R
Sbjct:  595 DYVAGMQNTEADAVKQNGNAYKTNNAVSDLSQPDW-ETGTFRFGTLHLENSDFSVGRNAN  653

Query:  248 --------KDNIIEGDAVALVGKGGSQNIRAS----RTLISSKSLGIHAEQAAKIAITG  295
                    K NI   GD     A +           +NI          R N++     S G     E            IT
Sbjct:  654 VIGDIQASKSNITIGDTTAYIDLHAGKITGDGFGFRQNIVRGNSQG---ETLFTGGITA  710

Query:  296 ASNTIHASNAAIRSLDKSEVKIDGQITIDSNVANLARQDGSIH---LNYKDDTRITGATV  352
              +TI      + A                ++  + TI+ N  A++  Q G          ++      +   +TG
Sbjct:  711 EDSTIVIKDKAKALFSNYVYLLNTKATIE-NGADVTTQSGMFSTSDISISGNLSMTGNPD  769

Query:  353 SDKGLVAIKPLNNTNIVADTIHYKGDVLAVNKGKVELDF----TPNILLAGRLDNFSGLT  408
            D              LN+ + +           +   ++A NK    V D        + I+         + S L+
Sbjct:  770 KDNKFEPSIYLNDASYLLTPDSAR--LVMASWGPIHSTKSASIMPGHDESPLSQLS  827
```

-continued

```
Query:    409 DSKHKNLFENYVANLDSKSAGEINFNLAKDAL----WTMTGQSWLDKLEGQGTIDFNNDA 464
              D  K L  +   D   G +N  A  +      W +TG S  L+   ++ +  D+
Sbjct:    828 DRTSKGLALGLLGGFDVSYRGSVNAPSASATMNNTWWQLTGDSALKTLKSTNSMVYFTDS 887

Query:    465 KTSGR--ALHIGELAGANK-FLMHLNKDGIHSDMLYVKKGTSTPQEVVVKNLSEVLDSMN 521
              + +     L + ELA +N + M  N       SD L VKK  S     ++   L + L
Sbjct:    888 ANNKKFHTLTVDELATSNSAYAMRTNLS--ESDKLEVKKHLSGENNIL---LVDFLQKPT 942

Query:    522 YGERLRFATVTNSKNEFVNGKKYIDDTHLMEDALTVEYSAHNGXXXXXXXXXXXSFNGSEM 581
              ++L    V+  K+    N K     T    D  V
Sbjct:    943 PEKQLNIELVSAPKTNENFKASKQTIGFSDVTPV------------------------ 978

Query:    582 TAEKAGDPYVNKTYTDNRQNVYLVKQATGNPSRNVKNINDMFDSTAHYAFT--LDTYAKR 639
              +  DD +  T++   N    K+AT N +         S  + AF   ++   KR
Sbjct:    979 ITTRETDDKI--TWSLTGYNTVANKEATRNAAA--------LFSVPYKAFLNEVNNLNKR 1028

Query:    640 EGERAFSTLDKKEGDWIRLTHTRVIQSNAFRFHNNDFEIGYDRFSLNEQEKKRKWGISLD 699
              G+    ++ + G W R+       S   F   +  ++G D+      K    G+ L
Sbjct:   1029 MGD--LRDINGEAGAWARIMSGTGSASGGFSDNYTHVQVGVDK-------KHELDGLDLF 1079

Query:    700 YGHGRTSLWNTFGKD----KIRKYELALYNTTQYIDKEGDETGYIDNVLKIGKLRNRVIA 755
                 G   T   ++   D    K +      LY +  +       D  YID + K     N   A
Sbjct:   1080 TGFTVTHTDSSASAFSGKTKSVGAGLYASAMF-----DSGAYIDLIGKYVHHDNEYTA 1134

Query:    756 RNHMGQLWGKGKYSNTLFSISTEYGRRKFLDDDKLWRITPQVQLQYSLRGTGYRI-DNG 814
                    G   G   YS  +      E G R  + +D   W I PQ +L Y  + G  +    D G
Sbjct:   1135 -TFAGL--GTRDYSTHSWYAGAEAGYRYHVTEDA-W-IEPQAELVYGSVSGKQFAWKDQG 1189

Query:    815 INVNLSHA--NSLIGRLGLDVVRKFDG 839
              +++++       N LIGR G+DV + F G
Sbjct:   1190 MHLSMKDKDYNPLIGRTGVDVGKSFSG 1216

Score = 36.6 bits (83), Expect = 1.2
Identities = 97/412 (23%), Positives = 164/412 (39%), Gaps = 83/412 (20%)

Query:     63 DNIVTMKSGDADADYVNNSKVLTETPYYKSKRGSNGIFAYGDKSLVKLIGEIVK--SE 120
              D V    G +   ++ SK    Y  +G    + A+    S V   +N   +   +E
Sbjct:    163 DKFVVETRGATEGADISLSKQQALERYGVNYKGEKKLIAFRAGSGVVSVKKNGRITPFNE 222

Query:    121 ISEKSKALNGGFRHIGIYS-W---QNAKVE----LSSKSDN--------------IVQGG 158
              +S K + LNG F HI  +S W    N + +    ++++ D+             +V G
Sbjct:    223 VSYKPEMLNGSFVHIDDWSGWLILTNNQFDEFNNIASQGDSGSALFVYDNQKKKWVVAGT 282

Query:    159 IWGLYS----NNSSISLKGKNNVISNPKYNVFAYKKAKVDLTVENKNTLSDAEFGVYALN 214
              +WG+Y+      N +   K        I  N K N  ++Y    VD++      T+  +  +    +
Sbjct:    283 VWGIYNYANGKNHAAYSKWNQTTIDNLK-NKYSY---NVDMSGAQVATIENGK--LTGTG 336

Query:    215 TSMVNLSSKDNNEVKSTQVGLYSQ----DGGSINVDRKDNIIEGDAVALVGKG-----GS 265
              +   ++ +KD        + L S     GG + D+K   + GD       G G        GS
Sbjct:    337 SDTTDIKNKDLIFTGGGDILLKSSFDNGAGGLVFNDKKTYRVNGDDFTFKGAGVDTRNGS 396

Query:    266 Q---NIR-ASRTNL--ISSKSLGIHAEQAAK------IAITGASNTIHASNAAIRSLDKS 313
                   NIR  ++ NL   I   +L +    Q       +  I GA   T      +N   I S D
Sbjct:    397 TVEWNIRYDNKDNLHKIGDGTLDVKTQNTNLKTGEGLVILGAEKTF--NNIYITSGD-G 453

Query:    314 EVKIDGQITIDSNVAN---LARQDGSIHLN-YKDDTRITGATSDKGLV--------AIK 361
              V+++ + +      N     A+  G++  LN Y         AT  D G V              +I
Sbjct:    454 TVRLNAENALSGGEYNGIFFAKNGGTLDLNGYNQSFNKIAAT--DSGAVITNTSTKKSIL 511

Query:    362 PLNNTNIVADTIHYKG-----DVLAVNKGKVELDFTPNILLAGRLDNFSGLT 408
              LNNT   AD I++       DVL  ++ K E        ++L G +D  + ++
Sbjct:    512 SLNNT---ADYIYHGNINGNLDVLQHHETKKE---NRRLILDGGVDTTNDIS 557
```

The protein was expressed in *E. coli* as an insoluble 95.92 kDa His-fusion product and then purified.

Based on this analysis, it was predicted that this protein from *N. gonorrhoeae,* and its epitopes, could be useful antigens for vaccines or diagnostics.

EXAMPLE 40

A DNA sequence was identified in *N. gonorrhoeae* <SEQ ID 79> which encodes amino acid sequence <SEQ ID 80; NGS40>. Analysis of this protein sequence reveals the following:

GvH: Examining signal sequence (von Heijne)
    Signal Score (−7.5): −4.18
    Possible cleavage site: 17
>>> Seems to have no N-terminal signal seq.
Amino Acid Composition of Predicted Mature Form:
    calculated from 1
ALOM: Finding transmembrane regions (Klein et al.)
    count: 0   value: 7.05   threshold: 0.0
    PERIPHERAL Likelihood =   7.05
    modified ALOM score:   −1.91
Rule: cytoplasmic protein -continued \*\*\* Reasoning Step: 2
----- Final Results -----
    bacterial cytoplasm --- Certainty= 0.108(Affirmative) < succ>

The protein has no homology with sequences in the databases.

Based on this analysis, it was predicted that this protein from *N. gonorrhoeae*, and its epitopes, could be useful antigens for vaccines or diagnostics.

EXAMPLE 41

A DNA sequence was identified in *N. gonorrhoeae* <SEQ ID 81> which encodes amino acid sequence <SEQ ID 82; NGS41>. Analysis of this protein sequence reveals the following:

GvH: Examining signal sequence (von Heijne)
    signal Score (-7.5): -2.47
    Possible cleavage site: 17
>>> May be a lipoprotein
Amino Acid Composition of Predicted Mature Form:
    calculated from 16
ALOM: Finding transmembrane regions (Klein et al.)
    count: 0   value:   7.37 threshold:   0.0
    PERIPHERAL Likelihood =   7.37
    modified ALOM score:   -1.97
Rule: inner or outer membrane protein
Rule: inner or outer membrane protein
\*\*\* Reasoning Step: 2
Lipoprotein?
Inner membrane?
----- Final Results -----
    bacterial outer membrane --- Certainty= 0.790(Affirmative)
    < succ>

The protein has no homology sequences in the databases.

Based on this analysis, it was predicted that this protein from *N. gonorrhoeae*, and its epitopes, could be useful antigens for vaccines or diagnostics.

EXAMPLE 42

A DNA sequence was identified in *N. gonorrhoeae* <SEQ ID 83> which encodes amino acid sequence <SEQ ID 84; NGS42>. Analysis of this protein sequence reveals the following:

GvH: Examining signal sequence (von Heijne)
    Signal Score (-7.5): -5.2
    Possible cleavage site: 14
>>> Seems to have no N-terminal signal seq.
Amino Acid Composition of Predicted Mature Form:
    calculated from 1
ALOM: Finding transmembrane regions (Klein et al.)
    count: 0   value:   6.58 threshold:   0.0
    PERIPHERAL Likelihood =   6.58
    modified ALOM score:   -1.82
Rule: cytoplasmic protein
\*\*\* Reasoning Step: 2
----- Final Results -----
    bacterial cytoplasm --- Certainty= 0.514(Affirmative) < succ>

The protein has no homology with sequences in the databases.

Based on this analysis, it was predicted that this protein from *N. gonorrhoeae*, and its epitopes, could be useful antigens for vaccines or diagnostics.

EXAMPLE 43

A DNA sequence was identified in *N. gonorrhoeae* <SEQ ID 85> which encodes amino acid sequence <SEQ ID 86; NGS43>. Analysis of this protein sequence reveals the following:

GvH: Examining signal sequence (von Heijne)
    Signal Score (-7.5): -4.34
    Possible cleavage site: 39
>>> Seems to have no N-terminal signal seq.
Amino Acid Composition of Predicted Mature Form:
    calculated from 1
ALOM: Finding transmembrane regions (Klein et al.)
    count: 2   value:   -4.78 threshold:   0.0
    INTEGRAL   Likelihood =   -4.78   Transmembrane 1881-1897 (1876-1898)
    INTEGRAL   Likelihood =   -1.01   Transmembrane 1966-1982 (1966-1982)
    PERIPHERAL Likelihood =   1.91
    modified ALOM score:   1.46
Rule: cytoplasmic membrane protein
\*\*\* Reasoning Step: 2
----- Final Results -----
    bacterial inner membrane --- Certainty= 0.291(Affirmative)
    < succ>

The protein has no homology with sequences in the databases.

Based on this analysis, it was predicted that this protein from *N. gonorrhoeae*, and its epitopes, could be useful antigens for vaccines or diagnostics.

EXAMPLE 44

A DNA sequence was identified in *N. gonorrhoeae* <SEQ ID 87> which encodes amino acid sequence <SEQ ID 88; NGS44>. Analysis of this protein sequence reveals the following:

GvH: Examining signal sequence (von Heijne)
    Signal Score (-7.5): -3.49
    Possible cleavage site: 58
>>> Seems to have no N-terminal signal seq.
Amino Acid Composition of predicted Mature Form:
    calculated from 1
ALOM: Finding transmembrane regions (Klein et al.)
    count: 1   value:   -1.33 threshold:   0.0
    INTEGRAL   Likelihood =   -1.33   Transmembrane 141-157 (140-157)
    PERIPHERAL Likelihood =   2.54
    modified ALOM score:   0.77
Rule: cytoplasmic membrane protein
\*\*\* Reasoning Step: 2
----- Final Results -----
    bacterial inner membrane --- Certainty= 0.153(Affirmative)
    < succ>

The protein has no homology with sequences in the databases.

Based on this analysis, it was predicted that this protein from *N. gonorrhoeae*, and its epitopes, could be useful antigens for vaccines or diagnostics.

EXAMPLE 45

A DNA sequence was identified in *N. gonorrhoeae* <SEQ ID 89> which encodes amino acid sequence <SEQ ID 90; NGS45>. Analysis of this protein sequence reveals the following:

GvH: Examining signal sequence (von Heijne)
    Signal Score (-7.5): -4.07
    Possible cleavage site: 46

```
>>> Seems to have no N-terminal signal seq.
Amino Acid Composition of Predicted Mature Form:
  calculated from 1
ALOM: Finding transmembrane regions (Klein et al.)
     count: 0   value:  2.07 threshold:  0.0
     PERIPHERAL Likelihood =  2.07
     modified ALOM score:  -0.91
Rule: cytoplasmic protein
*** Reasoning Step: 2
----- Final Results -----
       bacterial cytoplasm --- Certainty= 0.333(Affirmative) < succ>
```

The protein has homology with the following sequences in the databases:

```
>ref|NP_049512.1|putative portal protein [Bacteriophage 933W]
ref|NP_050550.1|hypothetical protein [Bacteriophage VT2-Sa]
gb|AAD25457.1|AF125520_52 (AF125520) putative portal protein
[Bacteriophage 933W]
dbj|BAA84334.1|(AP000363) hypothetical protein [Bacteriophage VT2-Sa]
dbj|BAA94158.1|(AP000422) portal protein [Escherichia coli] O157:H7]
Length = 714
Score = 314 bits (805), Expect = 2e-84
Identities = 213/658 (32%), Positives = 327/658 (49%), Gaps = 22/658 (3%)

Query:   7 ETGVLPDKNGEPLTIG---EYRLFVGEMMNQPAWRAVADKEMDYADGRQLDNELLQKQR    62
           ET + KN    T    + +    ++ +QP WR  A+K    Y DG QL   E+LQ   +
Sbjct:   4 ETNTMATKNDNGATPRFSQRQLQALCSDIDSQPKWRDAANKACAYYDGDQLPPEVLQVLK    63

Query:  63 ELGLPPAVENLITPTLLSVQGYEATIRTDWRVTADGETGGRD-VADALNFKLNRAERQSR   121
            + G P  + NLI PT+   V G EA   RTD  V +D      + +A+A+N +     A R
Sbjct:  64 DRGQPMTIHNLIAPTVDGVLGMAKTRTDLVVMSDEPDDETEKLAEAINAEFADACRLGN   123

Query: 122 ADKACSDAFRGQIACGIGWVTRNPNPFEFPYECGVIHRNAIHWDMKSYKYDLSDARWL    181
             +KA SDA+   QI  G+ WVEV RN +PF    ++    + RN + WD  S + DLSD RWL
Sbjct: 124 MNKARSDAYAEQIKAGLSWVEVRRNSDPFGPEFKVSTVSRNEVFWLSREADLSDCRWL    183

Query: 182 IRRWLLPERLAQFFPEYAGHFKAMGRGGSDWR-ISGELDGGGNTGLADAWGISGRNTV    240
            +RRRW+  +       FP  G  + +        DWR      +  G  +L  AW
Sbjct: 184 MRRRWMDTDEAKATFP---GMAQVIDYAIDDWRGFVDTTVTEOQPSPLMSAWEEYQSWDR    240

Query: 241 SEEFWFNETTRELAVAEVWYRRWVTADCLRDKKTGRTVEFDGANPNHREMAANGAV-LFA   299
           +  W      R + +   V+YR +     + +    GR V FD  N         A+G V +
Sbjct: 241 QQNEWLQRERRRVLLQVVYYRTFERLPVI-ELSNQRVVAFDKNNLMQAVAVASGRVQVKV    299

Query: 300 ASVPRMRRAFVVGDLVVRDEPTPYPHQKFPYPFFGFREDNTGIPYVRNMKYAQDNLN    359
              V R+R A+ VG   + D P   P    FP VPF+G++R+D TG PYG +    AQD +N
Sbjct: 300 GRVSRIREAWFVGPHFIVDRPCSAPQGMFPLVPFWGYRKDKTGEPYGLISEAIPAQDEVN    359

Query: 360 STNSKLRWGLSAIRTVRTKGIVDMSDEQFRRNIARVDADIVLNKIEAAQPGAR--FDVSR    417
                 KL  W L A R + +   +SD       I R D    I LN  +  Q         F V +
Sbjct: 360 FRRIKLTWLLQAKRVIMDEDATQLSDNDLMEQIERPDGIIKLNPVRKNQKSVADVFRVEQ    419

Query: 418 DFELSAQHWQMLQDSRATIRQISGITPSVGNRGNATSGRQESIQVEQSNQSLGLVMDNF    477
           DF++++Q +Q++Q+S   I+    G+   +F+G      ATSG    S   VEQ      +L    + DN+
Sbjct: 420 DFQVASQQFQVMQESEKLIQDTMGVYSAFLGQDSGATSGVAISNLVEQGAPLAEINDNY    479

Query: 478 RQSRSLVGELLLAMIIEDLGS-DEQTVVIEGDAVTQGRTVVINRPETDPVTGKAYLSNDL   536
            + +    VG LLLA +++DL         VVI   D      + +T+V+N  E  D         L++ND+
Sbjct: 480 QFACQQVGRLLLAYLLDDLKKRRNHAVVINRDDRQRRQTIVLN-AEGD----NGELTNDI    534

Query: 537 QNIRLKVALEDVPSTNSYRSQQLGAMSEAVKSLPPEYQAAVLPFMVSLMDIPFKDKVIEK   596
            +   +AL  V  T   ++++Q   MSE ++  LPP+ QA  VL     V+L+D+P K + +E+
Sbjct: 535 SRLNTHIALAPVQQTPAFKAQLAQHMSEVIQGLPPQVQAVVLDLWVNLLDVPQKQEFVER    594

Query: 597 IK-EVRVQETPEQI--EARIAQAVQDALAKSGNDIKRRELALKEQRTASEIKEIEARA    651
           I+ +    ++P+++    E +     A Q AL +       +++ RE+A +  +  ++         A  A
Sbjct: 595 IRAALGTPKSPDEMTPEEQEVAAQQQALQQQQAELQMREMAGRVAKLEADAARAHAAA    652
```

Based on this analysis, it was predicted that this protein from *N. gonorrhoeae,* and its epitopes, could be useful antigens for vaccines or diagnostics.

EXAMPLE 46

A DNA sequence was identified in *N. gonorrhoeae* <SEQ ID 91> which encodes amino acid sequence <SEQ ID 92; NGS46>. Analysis of this protein sequence reveals the following:

```
GvH: Examining signal sequence (von Heijne)
     Signal Score (-7.5): -3.25
     Possible cleavage site: 37
>>> Seems to have no N-terminal signal seq.
Amino Acid Composition of Predicted Mature Form:
     calculated from 1
ALOM: Finding transmembrane regions (Klein et al.)
     count: 0   value:  4.77 threshold:  0.0
     PERIPHERAL Likelihood =  4.77
     modified ALOM score:   -1.45
Rule: cytoplasmic protein
*** Reasoning Step: 2
----- Final Results -----
     bacterial cytoplasm --- Certainty= 0.281(Affirmative) < succ>
```

The protein has homology with the following sequences in the databases:

Based on this analysis, it was predicted that this protein from *N. gonorrhoeae,* and its epitopes, could be useful antigens for vaccines or diagnostics.

EXAMPLE 47

A DNA sequence was identified in *N. gonorrhoeae* <SEQ ID 93> which encodes amino acid sequence <SEQ ID 94; NGS47>. Analysis of this protein sequence reveals the following:

```
GvH: Examining signal sequence (von Heijne)
     Signal Score (-7.5): -4.87
     Possible cleavage site: 31
>>> Seems to have no N-terminal signal seq.
Amino Acid Composition of Predicted Mature Form:
     calculated from 1
ALOM: Finding transmembrane regions (Klein et al.)
     count: 0   value:  4.88 threshold:  0.0
     PERIPHERAL Likelihood =  4.88
     modified ALOM score:   -1.48
Rule: cytoplasmic protein
*** Reasoning Step: 2
----- Final Results -----
     bacterial cytoplasm --- Certainty= 0.313(Affirmative) < succ>
```

The protein has homology with the following sequences in the databases:

```
>sp|P44184|YE10_HAEIN HYPOTHETICAL PROTEIN HI1410
pir||E64028 hypothetical protein HI1410-Haemophilus influenzae (strain Rd
KW20)
gb|AAC23058.1|(U32820) H. influenzae predicted coding region HI1410
[Haemophilus influenzae Rd]
Length = 394
Score = 150 bits (379), Expect = 3e-35
Identities = 75/168 (44%), Positives = 114/168 (67%), Gaps = 2/168 (1%)

Query:  57 REIQKSMRDSVHRLLKDIWAQLGLGHYEITDFEIRGANGTLFVFSGLQSHTVDSIKSFE   116
            REIQKS+ DSV ++L D++  L L  F+++   +I G NG+ F F+GL+++ + SIKS
Sbjct:   3 REIQKSISDSVIQMLADQIEMLSLQAFVQKTQIIGQNGSRFTFAGLKTN-ITSSIKSMT    61

Query: 117 GIDIVWVEEGHGVSKKSWDVLTPTIRKEGSEIWITLWPDMETDETYRRFIAMPSEDTWLC   176
            GID+VWVEEG  VSK+SWD+L PTIR++GS+I ++NP     D+TY+RF+  P E
Sbjct:  62 GIDVVWVEEGENVSESWDILIPTIREDGSQIIVSFNPKNILDDTYQRFVIHPPERCKSV   121

Query: 177 EINWRDNPWFPEALNRERLKAQRSMNKEDYGNIWEGRPRNVSEGAVYR             224
            +NW+DNP+FP+L  E ++  R   + E Y +++EG P    S+ A+ +
Sbjct: 122 LVNWQDNPYFPKEL-MEDMEQMRERDYELYRHVYEGEPVADSDLAIIK            168

>ref|NP_050979.1|P18 [Bacteriophage APSE-1]
gb|AAF03961.1|AF157835_18 (AF157835) P18 [Bacteriophage APSE-1]
Length = 469
Score = 117 bits (294), Expect = 2e-25
Identities = 72/233 (30%), Positives = 110/233 (46%), Gaps = 13/233 (5%)

Query:  17 LFKPCRYKVMYXXXXXXXXXXXXXXXXXXXXXXXQRPLRILCAREIQKSMRDSVHRLLKDKVA    76
            +FKP R KV +                        R LC RE   S+ DS H +L+ +V
Sbjct:   1 MFKPKRIKVYFGGRGGMKTVSFAKIALITASMHKRRFLCLREFMNSIEDSGHAVLQAEVE    60

Query:  77 QLGLGHFYEITDEEIRGANGTLFVFSGLQSHTVDSIKSFEGIDIVWVEEGHGVSKKSWDV   136
            LGL + + I +  I G N ++F + +  L +  + SIKS    D+ WVEE   VS+KS D
Sbjct:  61 TLGLQNRFRILNTYIEGINDSIFKYGQL-ARNIASIKSKHDFDVAWVEEAETVSEKSLDS   119

Query: 137 LTPTIRKEGSEIWITLNPDMETDETYRRFIA----------MPSEDTWLCEINWRDNPW   185
            L PTIRK GSE+W + NP   E     Y+RF+            +D ++ ++++ DNPW
Sbjct: 120 LIPTIRKPGSELWFSFNPAEEDGAVYKRFVKPYKELIDTQGYYEDDDLYVGKVSYLDNPW   179

Query: 186 FPEALNRERLKAQRSMNKEDYGNIWEGRPMVSEGAVYRHEIQDAFHSGRVTL          238
              P   L + K +R  N + ++++ G     E A+ + E     +A     + L
Sbjct: 180 LPAELKNDAQKMKRE-NYKKWRHVYGGECDANYEDALIQPEWVEAAIDAHIKL         231
```

```
>ref|NP_037739.1|Gp54 [Bacteriophage HK97]
gb|AAF31132.1|(AF069529) Gp54 [Bacteriophage HK97]
Length = 273
Score = 47.4 bits (111), Expect = 3e-04
Identities = 33/123 (26%), Positives = 52/123 (41%), Gaps = 20/123 (16%)

Query: 242 NGGLSGKPKNANVPRRRKTHGVPLQEIADLYNEVLGGRLPSVQVLNDTRKRAIANRWCEM   301
           NGG G+ K     P RRK    +    +  YN +G RLP     +N+ RKR +  +
Sbjct: 160 NGGGDGQVK----PERRKAERIDYESFLNAYNTEVGDRLPHAVAVNEKRKRRL-KKIIPQ 214

Query: 302 LGTAAPNGKVRFGDKETGLAWFAGFFEKVA--MNPFHGENQTGPAVGFDWIFKAGNFVK   359
           L T  +G              F  + R       PF+ G+N TG+     FD++  +  ++
Sbjct: 215 LKTPNVDG------------FRAYVRAFHQAKPFFGDNDTGWTADFDYLLREDSLTG    261

Query: 360 ILE   362
           + E
Sbjct: 262 VRE   264
```

Based on this analysis, it was predicted that this protein from *N. gonorrhoeae*, and its epitopes, could be useful antigens for vaccines or diagnostics.

EXAMPLE 48

A DNA sequence was identified in *N. gonorrhoeae* <SEQ ID 95> which encodes amino acid sequence <SEQ ID 96; NGS48>. Analysis of this protein sequence reveals the following:

GvH: Examining signal sequence (von Heijne)
    Signal Score (-7.5): -6.85
    Possible cleavage site: 15
>>> Seems to have no N-terminal signal seq.
Amino Acid Composition of Predicted Mature Form:
    calculated from 1
ALOM: Finding transmembrane regions (Klein et al.)
    count: 0   value: 7.16 threshold: 0.0
    PERIPHERAL Likelihood = 7.16
    modified ALOM score: -1.93
Rule: cytoplasmic protein
*** Reasoning Step: 2

-continued

----- Final Results -----
    bacterial cytoplasm --- Certainty= 0.379(Affirmative) < succ>

The protein has homology with the following sequences in the databases:

```
>dbj|BAA36059.1|(D90754) Outer membrane protein P.69 precursor
[Escherichia coli]
Length = 762
Score = 64.7 bits (156), Expect = 1e-09
Identities = 79/292 (27%), Positives = 121/292 (41%), Gaps = 55/292 (18%)

Query:   3 NGARWTVTNDSMLKELDLSEDAQVEFSDNNK----FVKVSVSKLKGDGGVFKMYGDIV--   56
           N + W VT++S L   L LS    V+F+ +         F  ++V  L G+    F M D+V
Sbjct: 289 NNSVWNVTSNSNLDTLALSHST-VDFASHGSTAGTFATLNVENLSGNS-TFIMRADVVGE 346

Query:  57 ----KGESDKLITRKGSEGTHIIEYMDDAKAKTTGREYLKLVENKGNQEDNKASNKASYK  112
               + D L     S G H++   +    TTG E L +V+       D   AS   AS +
Sbjct: 347 GNGVNNKGDLLNISGSSAGNHVLAIRNQGSEATTGNEVLTVVKTT----DGAASFSASSQ 402

Query: 113 LNVRCTEQGGWCFALGESG-------ASKKVNISTDGKRDF-------YLYPD-------- 151
           +      E GG+ +  + ++G        AS    V    T             +  PD
Sbjct: 403 V-----ELGGYLYDVRKNGTNWELYASGTVPEPTPNPEPTPAPAQPPIVNPDPTPEPAPT 457

Query: 152 ---TLTPGASSSVLFGEALYQLNAVSDETLVQRMGEIHADGMPQEDNNVWIKRVGGKFSG 208
              T  T  A   + L     Y LN V  +TL+QRMG++        +D  N+W++   GG
Sbjct: 458 PKPTTTADAGGNYL--NVGYLLNYVENRTLMQRMGDLRNQ---SKDGNIWLRSYGGSLDS 512

Query: 209 SRSDYRVGGYGNRYWGFAGGFNRTGFGDKWIHYKGLMLRHLQSSYASEDYVG         260
           S ++ G+    Y G    G ++        D     Y GL    ++  S++AS  DY G
Sbjct: 513 FASG-KLSGFDMGYSGIQFGGDKR-LSDVMPLYVGL---YIGSTHASPDYSG          559
```

Based on this analysis, it was predicted that this protein from *N. gonorrhoeae*, and its epitopes, could be useful antigens for vaccines or diagnostics.

EXAMPLE 49

A DNA sequence was identified in *N. gonorrhoeae* <SEQ ID 97> which encodes amino acid sequence <SEQ ID 98; NGS49>. Analysis of this protein sequence reveals the following:

| | |
|---|---|
| GvH: Examining signal sequence (von Heijne)<br>    Signal Score (-7.5): -8.37<br>    Possible cleavage site: 15<br>>>> Seems to have no N-terminal signal seq.<br>Amino Acid Composition of Predicted Mature Form:<br>    calculated from 1<br>ALOM: Finding transmembrane regions (Klein et al.)<br>    count: 0  value: 4.93 threshold: 0.0<br>    PERIPHERAL Likelihood = 4.93<br>    modified ALOM score: -1.49<br>Rule: cytoplasmic protein<br>*** Reasoning Step: 2<br>----- Final Results -----<br>        bacterial cytoplasm --- Certainty= 0.355(Affirmative)<br>            < succ><br>        bacterial periplasmic space --- Certainty= 0.000(Not Clear)<br>            < succ><br>        bacterial outer membrane --- Certainty= 0.000(Not Clear)<br>            < succ><br>        bacterial inner membrane --- Certainty= 0.000(Not Clear)<br>            < succ> | GvH: Examining signal sequence (von Heijne)<br>    Signal Score (-7.5): -6.6<br>    Possible cleavage site: 50<br>>>> Seems to have no N-terminal signal seq.<br>Amino Acid Composition of Predicted Mature Form:<br>    calculated from 1<br>ALOM: Finding transmembrane regions (Klein et al.)<br>    count: 0  value: 7.80 threshold: 0.0<br>    PERIPHERAL Likelihood = 7.80<br>    modified ALOM score: -2.06<br>Rule: cytoplasmic protein<br>*** Reasoning Step: 2<br>----- Final Results -----<br>        bacterial cytoplasm --- Certainty=<br>            0.398(Affirmative) < succ><br>        bacterial periplasmic space --- Certainty=<br>            0.000(Not Clear) < succ><br>        bacterial outer membrane --- Certainty=<br>            0.000(Not Clear) < succ><br>        bacterial inner membrane --- Certainty=<br>            0.000(Not Clear) < succ> |

The protein has homology with the following sequences in the databases:

The protein has homology with the following sequences in the databases:

```
gi|11282647|pir|H81959 patch repair protein (EC 3.1.-.-) NMA0429
[imported]-Neisseria meningitidis (group A strain Z2491)
gi|7379179|emb|CAB83728.1|(AL162753) patch repair protein
[Neisseria meningitidis Z2491]
Length = 140
Score = 256 bits (628), Expect = 8e-68
Identities = 131/140 (93%), Positives = 132/140 (93%)

Query:    1 MTDIFTPSKRSFVMSKIHSKETKPEVLVRKFLFSQGFRYRKNDKRYAGKPDIVLPKYKTV   60
            MTDIFT SKRSFVM KIHSKETKPEVLVRKFLF QGFRYRKNDKRY GKPDIVL KYKTV
Sbjct:    1 MTDIFTTSKRSFVMLKIHSKETKPEVLVRFLFFQGFRYRKNDKRYVGKPDIVLSKYKTV   60

Query:   61 VFIHGCFWHGHSCNKGHIPKSNMDFWLEKITKNRERDIKNETELEKIGFKVIVVWECELK  120
            VFIHGCFW+GHSCNKGHIPKSN DFWLEKITKN ERDIKNETELEKIGFKVIVVWECELK
Sbjct:   61 VFIHGCFWYGHSCNKGHIPKSNTDFWLEKITKNCERDIKNETELEKIGFKVIVVWECELK  120

Query:  121 NKAICRERLNRLVEEIKDAV                                          140
            NKAICRERLNRLV EIKDAV
Sbjct:  121 NKAICRERLNRLVREIKDAV                                          140
```

Based on this analysis, it was predicted that this protein from *N. gonorrhoeae*, and its epitopes, could be useful antigens for vaccines or diagnostics.

EXAMPLE 50

A DNA sequence was identified in *N. gonorrhoeae* <SEQ ID 99> which encodes amino acid sequence <SEQ ID 100; NGS50>. Analysis of this protein sequence reveals the following:

```
>gi|11352963|pir||G81959 conserved hypothetical protein NMA0428
[imported]-Neisseria meningitidis (group A strain Z2491)
gi|7379178|emb|CAB83727.1|(AL162753) conserved hypothetical protein
[Neisseria meningitidis Z2491]
Length = 548
Score = 371 bits (954), Expect = e-102
Identities = 189/197 (95%), Positives = 194/197 (97%)

Query:    1 VKGESGVDIENWKNKLPEKEREPVEVILNRLEDSELTNKEQAEVISALHSIIPEYPYYHW   60
            VKGESGVDIE+WKNKLPEKEREPVEVILNRLEDSELTNKEQAEVISALHSIIPEYPYYHW
Sbjct:  350 VKGESGVDIEDWKNKLPEKEREPVEVILNRLEDSELTNKEQAEVISALHSIIPEYPYYHW  409

Query:   61 RHLHQDLHTACNDFYNEKKDYLSAAIEAVKVFEDKVQKQTGLHSIDGRELIEKAFGSKKS  120
            RHLHQDLHTACNDFYNEKKDYLSAAIEAVKVFEDKVQKQTGLHSIDGRELIE+AFGSK S
```

```
-continued
Sbjct: 410 RHLHQDLHTACNDFYNEKKDYLSAAIEAVKVFEDKVQKQTGLHSIDGRELIEQAFGSKKS 469

Query: 121 MLLLTNNKTQAEQNLEDGLEQLACGTWTGFRNPVQHELRANLSPSIFNDKDALDLISLVS 180
            +LLLTNNKT+AEQNLEDGLEQLACGTWTGFRNPVQHELRANLSPSIFNDKDALDLISLVS
Sbjct: 470 ILLLTNNKTKAEQNLEDGLEQLACGTWTGFRNPVQHELRANLSPSIFNDKDALDLISLVS 529

Query: 181 YLLRKVEQTKKRAKPTS                                            197
            YLLRKVEQTKKR+K  S
Sbjct: 530 YLLRKVEQTKKRSKVVS                                            546

>gi|10955124|ref|NP_059780.1|ymh [Agrobacterium tumefaciens]
gi|5738274|gb|AAB91582.2|(AF242881) ymh [Agrobacterium tumefaciens]
Length = 266
Score = 58.7 bits (141), Expect = 5e-08
Identities = 40/127 (31%), Positives = 69/127 (53%), Gaps = 5/127 (3%)

Query:  61 RHLHQDLHTACNDFYNEKKDYLSAAIEAVKVFEDKVQKQTGLHSIDGRELIEKAFGSKKS 120
           R +H D+   C +      +Y  A +EAVK   DK++++TGL + DG  L+++AF
Sbjct: 137 RGVHPDVLRFCREEL-LVDNYFHAVLEAVKSVADKIRQTGL-TDDGAVLVDRAFSGDAP  194

Query: 121 MLLLTNNTQAEQNEDGLEQLACGTWTGFRNPVQHELRANLSPSIFNDKDALDLISLVS   180
           ML  +   ++++E+  + G   L   GT++ FRN    H  R +    S    +DA DL S+ S
Sbjct: 195 MLAINELQSESEKGEQRGFSNLVKGTFSMFRNTTAHAPRIHWQMS---KEDAEDLFSMFS 251

Query: 181 YLLRKVE                                                      187
             + R+++
Sbjct: 252 LMHRRID                                                      258
```

As a homolog was found in serogroup A *N. meningitidis* but not in serogroup B, NGS50 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 51

A DNA sequence was identified in *N. gonorrhoeae* <SEQ ID 101> which encodes amino acid sequence <SEQ ID 102; NGS51>. Analysis of this protein sequence reveals the following:

GvH: Examining signal sequence (von Heijne)
    Signal Score (-7.5): 0.14
    Possible cleavage site: 42

>>> Seems to have no N-terminal signal seq.
Amino Acid Composition of Predicted Mature Form:
    calculated from 1
ALOM: Finding transmembrane regions (Klein et al.)
    count: 0   value: 5.67   threshold: 0.0
    PERIPHERAL    Likelihood = 5.67
    modified ALOM score:   -1.63
Rule: cytoplasmic protein
*** Reasoning Step: 2
----- Final Results -----
    bacterial cytoplasm --- Certainty= 0.145(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

The protein has homology with the following sequences in the databases:

```
>pir||G81959 conserved hypothetical protein NMA0428 [imported]-Neisseria
meningitidis (group A strain Z2491)
emb|CAB83727.1|(AL162753) conserved hypothetical protein [Neisseria
meningitidis Z2491]
Length = 548
Score = 532 bits (1371), Expect = e-150
Identities = 272/285 (95%), Positives = 280/285 (97%)

Query:   1 MSEEKLKMSFEPTVIEHLGVKMYSHTVPAIAELIANAYDACATEVEVRLFDKPEHKIVIK  60
           MSEEKLKMSFEPTVIEHLGVKMYSHTVPAIAELIANAYDACATEVEVRLFDKPEHKIVIK
Sbjct:   1 MSEEKLKMSFEPTVIEHLGVKMYSHTVPAIAELIANAYDACATEVEVRLFDKPEHKIVIK  60

Query:  61 DNGIGMSFDEINDFYLRIGRNRREEKQASPCGRIPTGKKGLGKLALFRLGNKIEISTIQG 120
           DNGIGMSFDEINDFYLRIGRNRREEKQASPCGRIPTGKKGLGKLALF LGNKIEISTIQG
Sbjct:  61 DNGIGMSFDEINDFYLRIGRNRREEKQASPCGRIPTGKKGLGKLALFRLGNKIEISTIQG 120

Query: 121 NERVTFTLDYAEIKKSERIYQPEFQKESVKPNTENGTTITLTELTKKQGYPLDNYVGHLS 180
           NERVTFTLDYAEI++S+ IYQPEF+KESV+ N E+GTTITLTELTKKQGYPLDNYV HLS
Sbjct: 121 NERVTFTIDYAEIRRSKGIYQPEFRKESVESNIESGTTITLTELTKKQGYPLDNYVEHLS 180

Query: 181 RLFDFPAQDFKIKVSLNGSEPRIIDGNLKYNLVTPQFEWEYQDLATNISSLSSKFEQYEY 240
           RLFDFPAQDFKIKVSLNGSEP+IIDGNLKY+LVTPQFEWEYQDLATNISSLSSKFEQYEY
```

```
                                  -continued
Sbjct: 181 RLFDFPAQDFKIKVSLNGSEPKIIDGNLKYDLVTPQFEWEYQDLATNISSLSSKFEQYEY  240

Query: 241 SGLIQGKFITTEKPLKNNMKGITLFANGRMVNMPEFFTDSESSHF                285
           SGLIQGKFITTEKPLKNNMKGITLFANGRMVNMPEFFTDSESSHF
Sbjct: 241 SGLIQGKFITTEKPLKNNMKGITLFANGRMVNMPEFFTDSESSHF                285

>emb|CAC22276.1|(AJ302030) putative heat shock protein [Listeria
monocytogenes]
Length = 181
Score = 70.2 bits (171), Expect = 2e-11
Identities = 57/173 (32%), Positives = 90/173 (51%) , Gaps = 10/173 (5%)

Query:   1 MSEEKLKMSFEPTVIEHLGVKMYSHTVPAIAELIANAYDACATEVEVRLFDKPEHKIVIK   60
           MSE++   + +P ++E LG  +Y++      + ELIANAYDA A   V V     E+K++++
Sbjct:   1 MSEKEYNLDIDPRILELLGPHLYTNIYYILGELIANAYDADAKNVYVIDRIDEENKLIVE   60

Query:  61 DNGIGMSFD--EINDFYLRIGRNRREEKQASPC---GRIPTGKKGLGKLALFRLGNKIEI  115
           D+G GMS++  ++ +F L + +  R        S      R    G+KG+GKLA    +    + I
Sbjct:  61 DDGSGMSYENKDVKNF-LSVAKESRTNAINSYTKLNNRRKMGRKGVGKLASLSVSENVNI  119

Query: 116 STIQGNERVFTLDYAEI-KKSERIYQPEFQKESVKPNTENGTTITLTELTKK          167
           TI+  E+   F L    I KK E I +            +K     +GT I +T   T K
Sbjct: 120 KTIKDGEKSGFVLSRKVINKKLEAINEDTISFIKIK---NHGTAIEMTNPTYK        169
```

As a homolog was found in serogroup A N. meningitidis but not in serogroup B, NGS51 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 52

A DNA sequence was identified in *N. gonorrhoeae* <SEQ ID 103> which encodes amino acid sequence <SEQ ID 104; NGS52>. Analysis of this protein sequence reveals the following:

GvH: Examining signal sequence (von Heijne)
Signal Score (−7.5): −3.5
Possible cleavage site: 49

-continued

>>> Seems to have no N-terminal signal seq.
Amino Acid Composition of Predicted Mature Form:
calculated from 1
ALOM: Finding transmembrane regions (Klein et al.)
count: 0 value: 7.64 threshold: 0.0
PERIPHERAL Likelihood = 7.64
modified ALOM score: −2.03
Rule: cytoplasmic protein
*** Reasoning Step: 2
----- Final Results -----
bacterial cytoplasm --- Certainty= 0.213(Affirmative) < succ>
bacterial periplasmic space --- Certainty= 0.000(Not Clear) < succ>
bacterial outer membrane --- Certainty= 0.000(Not Clear) < succ>
bacterial inner membrane --- Certainty= 0.000(Not Clear) < succ>

The protein has homology with the following sequences in the databases:

2.1.1.73) NMA0427 [imported]-*Neisseria meningitidis* (group A strain Z2491)
gi|7379177|emb|CAB83726.1|(AL162753) modification methylase (cytosine-specific DNA methylase) [*Neisseria meningitidis* Z2491]
Length = 351
Score = 310 bits (794), Expect = 8e-84
Identities = 152/154 (98%), Positives = 153/154 (98%)

```
Query:   1 LGMENGFPKIMAGHQDETDFMHSCAGLSDINLKRLALIPKNGGNRLAFAHIPELQLECFI   60
           LGMENGFPKI+AGHQDETDFMHSCAGLSDINLKRLALIPKNGGNRLAFAHIPELQLECFI
Sbjct: 198 LGMENGFPKIIAGHQDETDFMHSCAGLSDINLKRLALIPKNGGNRLAFAHIPELQLECFI   257

Query:  61 GKDNSFKDTFGRLWWDKPAPTITTKFFSISNGRAFAHPEEDRALSLREGATLQSFPRNYVF   120
           GKDNSFKDTFGRLWWDKPAPTITTKFFSISNGRAFAHPEEDRALSLREGATLQSFPRNYVF
Sbjct: 258 GKDNSFKDTFGRLWWDKPAPTITTKFFSISNGRAFAHPEEDRALSLREGATLQSFPRNYVF   317

Query: 121 KAGSRDKIARLIGNAVPPMYTEKIGRAIVDNIEC                             154
           KAGSRDKIARLIGNAVPPMY EKIGRAIVDNIEC
Sbjct: 318 KAGSRDKIARLIGNAVPPMYAEKIGRAIVDNIEC                             351
```

>gi|1274411|sp|P25265|MTD2_HERAU MODIFICATION METHYLASE HGIDII (CYTOSINE-SPECIFIC METHYLTRANSFERASE HGIDII) (M.HGIDII)
gi|538661|pir||JT0594 site-specific DNA-methyltransferase (cytosine-specific) (EC 2.1.1.73)-*Herpetosiphon aurantiacus*
gi|487731|emb|CAA38941.1|(X55141) methyltransferase [*Herpetosiphon aurantiacus*]
Length = 354

-continued

```
Score = 95.6 bits (237), Expect = 3e-19
Identities = 62/142 (43%), Positives = 82/142 (57%), Gaps = 9/142 (6%)

Query:   12 AGHQDETDFM HSCAGLSDINLKRLALIPKNGGNRLAFAHIP-ELQLECFIGKD-NSFKDT   69
            +G    E D MH+ + L DINL+R+         G    +A  P EL  EC    +    S+
Sbjct:  200 SGGHWEGDSMHAASRLEDINLRRIQHSVPGG----TWADWPEELIAECHKKESGESYGSV  255

Query:   70 FGRLWWDKPAPTITTKFFSISNGEFAHPEEDRALSLREGATLQSFPRNYVFKAGSRDK--  127
            +GR+ WDK APTITT+       NGRF HPE+DRA+SLRE A LQ+FPR+Y F    + K
Sbjct:  256 YGRMEWDKVAPTITTQCNGYGNGRFGHPEQDRAISLRALLQTFPRSYQFAPEGQLKFK   315

Query:  128 -IARLIGNAVPPMYTEKIGRAI                                       148
             ++R IGNAVP         I  ++I
Sbjct:  316 TVSRQIGNAVPVALGRVIAKSI                                       337
```

As a homolog was found in serogroup A *N. meningitidis* but not in serogroup B, NGS52 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 53

A DNA sequence was identified in *N. gonorrhoeae* <SEQ ID 105> which encodes amino acid sequence <SEQ ID 106; NGS53>. Analysis of this protein sequence reveals the following:

---

GvH: Examining signal sequence (von Heijne)
    Signal Score (-7.5): -7.56
    Possible cleavage site: 31
    >>> Seems to have no N-terminal signal seq.
Amino Acid Composition of predicted Mature Form:
    calculated from 1

---

-continued

ALOM: Finding transmembrane regions (Klein et al.)
    count: 0  value: 5.36 threshold: 0.0
    PERIPHERAL  Likelihood = 5.36
    modified ALOM score: -1.57
Rule: cytoplasmic protein
*** Reasoning Step: 2
----- Final Results -----
    bacterial cytoplasm --- Certainty=
    0.189(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>

The protein has homology with the following sequences in the databases:

```
>gi|11256915|pir||F81959 site-specific DNA-methyltransferase (cytosine-
specific) (EC2.1.1.73) NMA0427 [imported]-Neisseria meningitidis (group
A strain Z2491)
gi|7379177|emb|CAB83726.1|(AL162753) modification methylase (cytosine-
specific DNA methylase) [Neisseria meningitidis Z2491]
Length = 351
Score = 247 bits (606), Expect = 5e-65
Identities = 124/149 (83%), Positives = 127/149 (85%)

Query:    1 LQPETLEKELGLKKNDDDLILIGCSPCQYWSVIQTDKRKSEKSKSLLLEFQRFVEYFNPG   60
            LQPETLEKELGLKKNDDDLILIGCSPCQYWSVIQTDKRKSEKSKSLLLEFQRFVEYFNPG
Sbjct:   59 LQPETLEKELGLKKNDDDLILIGCSPCQYWSVIQTDKRKSEKSKSLLLEFQRFVEYFNPG  118

Query:   61 YVVVENVPGILSRMKESGLDNFIKLLEEKGFTVHFGIHNTADYGIPQSRKRFTLIANRIT  120
            YVVVENVPGILSRMKESGLDNFIKLLEEKGFTVHFGIHNTADYGIPQSRKRFTLIANRIT
Sbjct:  119 YVVVENVPGILSRMKESGLDNFIKLLEEKGFTVHFGIHNTADYGIPQSRKRFTLIANRIT  178

Query:  121 KKSWNQSSIRANGLRYAMFWEWKTAFPKL                                149
            K+                L      + FPK+
Sbjct:  179 KEKLEPVKYSGKRLTVRDVLGMENGFPKI                                207

>gi|127441|sp|P25265|MTD2_HERAU MODIFICATION METHYLASE HGIDII (CYTOSINE-
SPECIFIC METHYLTRANSFERASE HGIDII) (M.HGIDII)
gi|538661|pir||JT0594 site-specific DNA-methyltransferase (cytosine-
specific) (EC 2.1.1.73)-Herpetosiphon aurantiacus
gi|48773|emb|CAA38941.1|(X55141) methyltransferase [Herpetosiphon aurantiacus]
Length = 354
Score = 71.9 bits (169), Expect = 4e-12
Identities = 39/105 (37%), Positives = 57/105 (54%), Gaps = 1/105 (0%)

Query:   12 LKKNDDDLILIGCSPCQYWSVIQTDKRKSEKSKSLLLEFQRFVEYFNPGYVVVENVPGIL   71
            L   N+IL+GC+PCQ +S    T K ++       LL EF R  +   P  + +ENVP +
Sbjct:   64 LYPNNQHKILVGCAPCQDFSQY-TKKSRTGTKWQLLTEFSRLIREIEPDIISMENVPEVR  122

Query:   72 SRMKESGLDNFIKLLEEKGFTHFGIHNTADYGIPQSSRKRFTLIA                116
             +   +     +NFI+ LE+ G+ V    + +   DYGIPQ  R R    L A
Sbjct:  123 TFNRGEVFNFIQSLEQLGYWSHSVVHCPDYGIPQQRDRLVLFA                  167
```

As a homolog was found in serogroup A *N. meningitidis* but not in serogroup B, NGS53 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 54

A DNA sequence was identified in *N. gonorrhoeae* <SEQ ID 107> which encodes amino acid sequence <SEQ ID 108; NGS54>. Analysis of this protein sequence reveals the following:

```
GvH: Examining signal sequence (von Heijne)
    Signal Score (-7.5): -6.82
    Possible cleavage site: 50
>>> Seems to have no N-terminal signal seq.
Amino Acid Composition of Predicted Mature Form:
    calculated from 1
ALOM: Finding transmembrane regions (Klein et al.)
    count: 0   value:   6.89 threshold:   0.0
    PERIPHERAL   Likelihood =   6.89
    modified ALOM score:   -1.88
Rule: cytoplasmic protein
*** Reasoning Step: 2
----- Final Results -----
        bacterial cytoplasm --- Certainty=
            0.253(Affirmative) < succ>
        bacterial periplasmic space --- Certainty=
            0.000(Not Clear) < succ>
        bacterial outer membrane --- Certainty=
            0.000(Not Clear) < succ>
        bacterial inner membrane --- Certainty=
            0.000(Not Clear) < succ>
```

The protein has homology with the following sequences in the databases:

Based on this analysis, it was predicted that this protein from *N. gonorrhoeae*, and its epitopes, could be useful antigens for vaccines or diagnostics.

EXAMPLE 55

A DNA sequence was identified in *N. gonorrhoeae* <SEQ ID 109> which encodes amino acid sequence <SEQ ID 110; NGS55>. Analysis of this protein sequence reveals the following:

```
GvH: Examining signal sequence (von Heijne)
    Signal Score (-7.5): -4.46
    Possible cleavage site: 37
>>> Seems to have no N-terminal signal seq.
Amino Acid Composition of Predicted Mature Form:
    calculated from 1
ALOM: Finding transmembrane regions (Klein et al.)
    count: 0   value:   3.02 threshold:   0.0
    PERIPHERAL   Likelihood =   3.02
    modified ALOM score:   -1.10
Rule: cytoplasmic protein
*** Reasoning Step: 2
----- Final Results -----
        bacterial cytoplasm --- Certainty=
            0.311(Affirmative) < succ>
        bacterial periplasmic space --- Certainty=
            0.000(Not Clear) < succ>
        bacterial outer membrane --- Certainty=
            0.000(Not Clear) < succ>
        bacterial inner membrane --- Certainty=
            0.000(Not Clear) < succ>
```

The protein has homology with the following sequences in the databases:

```
gi|1074456|pir||D64155 hypothetical protein HI0597-Haemophilus influenzae
(strain Rd KW20)
gi|1573586|gb|AAC22254.1|(U32741) conserved hypothetical protein [Haemophilus
influenzae Rd]
Length = 272
Score = 188 bits (459), Expect = 2e-47
Identities = 95/100 (95%), Positives = 97/100 (97%)

Query:   1 MNLPFRAMVSDLGGTLLTPEHLVGDLTIDTLRVLEQKGVDIILATGRNHTDMSSILGKIG    60
           MNLPFRAMVSDL GTLLTPEHLVGDLTIDTLR LEQKGVDIILATGRNHTD+SSILGKIG
Sbjct:   1 MNLPFRAMVSDLDGTLLTPEHLVGDLTIDTLRALEQKGVDIILATGRNHTDVSSILGKIG    60

Query:  61 AERAVMITSNGARVRDLQGNLLYSNSLPEELVLELYKTSY                     100
           AERAVMITSNGARVRDLQGNLLYSNSLPEELVLELYKT +
Sbjct:  61 AERAVMITSNGARVRDLQGNLLYSNSLPEELVLELYKTPF                     100
```

A homolog was found in serogroup A *N. meningitidis* but not in serogroup B, so NGS54 protein and nucleic acid are useful for distinguishing between gonococcus and serogroup B *N. meningitidis*.

```
aeruginosa (strain PAO1)
gi|9948791|gb|AAG06104.1|AE004699_9 (AE004699) probable FMN oxidoreductase
[Pseudomonas aeruginosa]
Length = 411
Score = 279 bits (686), Expect = 2e-74
Identities = 157/375 (41%), Positives 228/375 (59%), Gaps 10/375 (2%)

Query:   1 MEEQLAQNDQ-PSEKLVRLYGAWAEGGAGVLVTGNVMVAESGKGSINDVLISDDRALKLM    59
```

-continued

```
              MEE +4   Q PSE4+L+RLY AWA+GGAG+L++GNVMV         V++ DD  LE
Sbjct:  24 MEENMADAAQAPSERLMRLYQAWADGGAGLLISGNVMVDSRAMTPGGVVLEDDAQLEKF   83
Query:  60 KKWAKARTQNDTLLIMQINKAGKQSPAVKTPLAPSAVPL--GMNGFINPPRELSADE    117
             ++WA+            +QINH G+Q  A + +   APSAVPL   GM+    P+ +
Sbjct:  84 RRWARIGRSAGAGFWLGINHPGRQMQANLGQQAWAPSAVPLELGGMSRHFATPKAMDEAM  143

Query: 118 INGLIQQFVQTAKIAEQAGFSGVQIYAVHGYLISQFLSPHHNRRQDQWGGSLENRMRFLL 177
             I  +IQ+F ++ +AE+AGFSGV+I+A HGYL+SQFLSP  NRR D WGGSLENR R LL
Sbjct: 144 IAEVIQRFARSAGLAERAGFSGVEIHHGYLLSQFLSPLSNRRSDAWGGSLENRARLLL   203

Query: 178 ETYTAIRAAGKDFLVGVXLNSADFQKGGFDESESVQVVQKLSEMGIDFIEVSGGNYESP  237
             E   A+RA     F V VKLNSADFQ+GGF   ++ +VV+ L  +G+D +E+SGG+YE+P
Sbjct: 204 EIVRAVRAEVAPGFAVAVKLNSADFQRGGFSADDAREVVRMLDGLGVDLVELSGGSYEAP  263

Query: 238 QMLA-AKDS-TRKREAFFIDYAEKARAASQAPLIITGGFRSQTAMEDALSSGHLDLVGIA  295
              M   A+D  T   REA+F+++A   RAA++ P+++TGG R +    E  L+SG +D+VGI
Sbjct: 264 AMQGEARDGRTLAREAYFVEFARDIRAAARMPVMVTGGIRRRVAEQVLASG-VDMVGIG  322

Query: 296 RPFALVPDLANKMQNRTYQTVQADRIQTGVDKKAGAMLEMNWYMTQMDLIGQGKQSN    355
              A+ P+L   +    Q    I    + +K   ++  M    Q+   + +G+ +N
Sbject:323 TALAIEPNLPRDWRAGKDSAPQLRPI----TWENKPLASLANMAVKFQLRKLSRGRATN   378

Query: 356 PKIVGVESIAENFAG                                              370
             P++    ++    AG
Sbjct: 379 PRVSPLCALLAQQAG                                              393
```

Based on this analysis, it was predicted that this protein from *N. gonorrhoeae*, and its epitopes, could be useful antigens for vaccines or diagnostics.

EXAMPLE 56

A DNA sequence was identified in *N. gonorrhoeae* <SEQ ID 111> which encodes amino acid sequence <SEQ ID 112; NGS56>. Analysis of this protein sequence reveals the following:

GvH: Examining signal sequence (von Heijne)
   Signal Score (–7.5): –4.69
   Possible cleavage site: 54
   >>> Seems to have an uncleavable N-term signal seq
Amino Acid Composition of Predicted Mature Form:
   calculated from 1
ALOM: Finding transmembrane regions (Klein et al.)
   count: 0   value: 4.29   threshold: 0.0
   PERIPHERAL Likelihood = 4.29
   modified ALOM score: –1.36
*** Reasoning Step: 2
----- Final Results -----
   bacterial inner membrane --- Certainty=
   0.042(Affirmative) < succ>
   bacterial periplasmic space --- Certainty=
   0.000(Not Clear) < succ>
   bacterial outer membrane --- Certainty=
   0.000(Not Clear) < succ>
   bacterial cytoplasm --- Certainty=
   0.000(Not Clear) < succ>

The protein has homology with the following sequences in the databases:

```
>gi|7444004|pir||D70029 transcription regulator ArsR family homolog yvbA-
Bacillus subtilis
gi|2635892|emb|CAB15384.1|(Z99121) similar to transcriptional regulator (ArsR
family)
[Bacillus subtilis]
Length = 90
Score = 51.3 bits (118), Expect = 3e-06
Identities = 24/65 (36%), Positives = 42/65 (63%), Gaps = 1/65 (1%)

Query:  15 IFTVLSDENRHQILHVLWKHGRMNVNELTEHLHLSRPAVSHHLKIMLQAGAVAVEQVGKE  74
             +F  +SD  R +IL +L K G M     ++ EH ++S+P++SHHL I+QA   +  + G+
Sbjct:   4 VFKAISDPTRRKILDLL-KGGDMTAGDIAEHFNISHPSISHHLNILKQAEVISDHRKGQF  62

Query:  75 RFYSI                                                         79
             +YS+
Sbjct:  63 IYYSL                                                         67
```

Based on this analysis, it was predicted that this protein from *N. gonorrhoeae*, and its epitopes, could be useful antigens for vaccines or diagnostics.

EXAMPLE 57

A DNA sequence was identified in *N. gonorrhoeae* <SEQ ID 113> which encodes amino acid sequence <SEQ ID 114; NGS57>. Analysis of this protein sequence reveals the following:

GvH: Examining signal sequence (von Heijne)
   Signal Score (–7.5): –2.57

-continued

```
        Possible cleavage site: 55
    >>> Seems to have no N-terminal signal seq.
    Amino Acid Composition of Predicted Mature Form:
        calculated from 1
    ALOM: Finding transmembrane regions (Klein et al.)
        count: 0   value:   5.67 threshold:   0.0
           PERIPHERAL   Likelihood =   5.67
           modified ALOM score:    −1.63
Rule: cytoplasmic protein
*** Reasoning Step: 2
----- Final Results -----
           bacterial cytoplasm --- Certainty=
              0.160(Affirmative) < succ>
           bacterial periplasmic space --- Certainty=
              0.000(Not Clear) < succ>
              bacterial outer membrane --- Certainty=
              0.000(Not Clear) < succ>
              bacterial inner membrane --- Certainty=
              0.000(Not Clear) < succ>
```

The protein has homology with the following sequences in the databases:

```
GvH: Examining signal sequence (von Heijne)
    Signal Score (−7.5): −1.92
    Possible cleavage site: 16
>>> Seems to have no N-terminal signal seq.
Amino Acid Composition of Predicted Mature Form:
    calculated from 1
ALOM: Finding transmembrane regions (Klein et al.)
    count: 0   value:   5.41 threshold:   0.0
       PERIPHERAL   Likelihood =   5.41
       modified ALOM score:    −1.58
Rule: cytoplasmic protein
*** Reasoning Step: 2
----- Final Results -----
           bacterial cytoplasm --- Certainty=
              0.107(Affirmative) < succ>
           bacterial periplasmic space --- Certainty=
              0.000(Not Clear) < succ>
              bacterial outer membrane --- Certainty=
              0.000(Not Clear) < succ>
              bacterial inner membrane --- Certainty=
              0.000(Not Clear) < succ>
```

The protein has homology with the following sequences in the databases:

```
>gi|10444407|gb|AAG17897.1|AF297971_1 (AF297971) restriction endonuclease
R.NgoMIII [Neisseria gonorrhoeae]
Length = 213
Score = 319 bits (818), Expect = 1e-86
Identities = 156/156 (100%), Positives = 156/156 (100%)

Query:    1 LYKQYADWNRLSYNAPIYVGKAVPKGWRQARNSDNALNQSTELFHRLKEHSRSIAAVSDL    60
            LYKQYADWNRLSYNAPIYVGKAVPKGWRQARNSDNALNQSTELFHRLKEHSRSIAAVSDL
Sbjct:   58 LYKQYADWNRLSYNAPIYVGKAVPKGWRQARNSDNALNQSTELFHRLKEHSRSIAAVSDL   117

Query:   61 DPSDFMCRFVIFEGAGSDMIGTIEAALIKLHKPLWNSCDGFGNHDPGKGRYEQAKSDWD   120
            DPSDFMCRFVIFEGAGSDMIGTIEAALIKLHKPLWNSCDGFGNHDPGKGRYEQAKSDWD
Sbjct:  118 DPSDFMCRFVIFEGAGSDMIGTIEAALIKLHKPLWNSCDGFGNHDPGKGRYEQAKSDWD   177

Query:  121 VLHSGRVWADRLNGIPNSYESILENINTHLEIIKRK                          156
            VLHSGRVWADRLNGIPNSYESILENINTHLEIIKRK
Sbjct:  178 VLHSGRVWADRLNGIPNSYESILENINTHLEIIKRK                          213
```

Based on this analysis, it was predicted that this protein from *N. gonorrhoeae*, and its epitopes, could be useful antigens for vaccines or diagnostics.

EXAMPLE 58

A DNA sequence was identified in *N. gonorrhoeae* <SEQ ID 115> which encodes amino acid sequence <SEQ ID 116; NGS58>. Analysis of this protein sequence reveals the following:

```
>gi|10444408|gb|AAG17898.1|AF29797_2 (AF297971) DNA cytosine
methyltransferase M.NgoMIII [Neisseria gonorrhoeae]
Length = 377
Score = 759 bits (1960), Expect = 0.0
Identities = 377/377 (100%), Positives = 377/377 (100%)

Query:    1 MKSLEIFSGAGGLAKGLELAGFQHASFIELNKDACNSLRSNFNPKLVYQGDVADFDLSSQ    60
            MKSLEIFSGAGGLAKGLELAGFQHASFIELNKDACNSLRSNFNPKLVYQGDVADFDLSSQ
Sbjct:    1 MKSLEIFSGAGGLAKGLELAGFQHASFIELNKDACNSLRSNFNPKLVYQGDVADFDLSSQ    60

Query:   61 EGIEVIAGGPPCQPFSLGGKHLAHEDRRDMFPHAVRYVEYYRPKAFIFENVKGLLRKSFA   120
            EGIEVIAGGPPCQPFSLGGKHLAHEDRRDMFPHAVRYVEYYRPKAFIFENVKGLLRKSFA
Sbjct:   61 EGIEVIAGGPPCQPFSLGGKHLAHEDRRDMFPHAVRYVEYYRPKAFIFENVKGLLRKSFA   120

Query:  121 DYFEYILLRLTYPNLGILQNEDWKGHLTRLKEIEFNLYKGIKYKVSYQLLNAADYGVPQK   180
            DYFEYILLRLTYPNLGILQNEDWKGHLTRLKEIEFNLYKGIKYKVSYQLLNAADYGVPQK
Sbjct:  121 DYFEYILLRLTYPNLGILQNEDWKGHLTRLKEIEFNLYKGIKYKVSYQLLNAADYGVPQK   180
```

```
                                  -continued
Query:  181 RERVVIVGIRADLDIDWKFPKRTHSEDRLNWEKYVTGEYWEKHNEPKRFNKDIAEKLQKK  240
            RERVVIVGIRADLDIDWKFPKRTHSEDRLNWEKYVTGEYWEKHNEPKRFNKDIAEKLQKK
Sbjct:  181 RERVVIVGIRADLDIDWKFPKRTHSEDRLNWEKYVTGEYWEKHNEPKRFNKDIAEKLQKK  240

Query:  241 YGIFEPEKKPWQTVRDTLSDIPHPLGNHKITGHEYRDGARIYPGHTGSGIDEPSKTIKAG  300
            YGIFEPEKKPWQTVRDTLSDIPHPLGNHKITGHEYRDGARIYPGHTGSGIDEPSKTIKAG
Sbjct:  241 YGIFEPEKKPWQTVRDTLSDIPHPLGNHKITGHEYRDGARIYPGHTGSGIDEPSKTIKAG  300

Query:  301 GHGVPGGENMIRYDDGTVRYFTSYEAKLLQTFPEEFVISGAWGEAMRQIGNAVPVKLSEI  360
            GHGVPGGENMIRYDDGTVRYFTSYEAKLLQTFPEEFVISGAWGEAMRQIGNAVPVKLSEI
Sbjct:  301 GHGVPGGENMIRYDDGTVRYFTSYEAKLLQTFPEEFVISGAWGEAMRQIGNAVPVKLSEI  360

Query:  361 LGKHLMGVLSEKSSLHN                                              377
            LGKHLMGVLSEKSSLHN
Sbjct:  361 LGKHLMGVLSEKSSLHN                                              377
```

Based on this analysis, it was predicted that this protein from *N. gonorrhoeae*, and its epitopes, could be useful antigens for vaccines or diagnostics.

EXAMPLE 59

A DNA sequence was identified in *N. gonorrhoeae* <SEQ ID 117> which encodes amino acid sequence <SEQ ID 118; NGS59>. Analysis of this protein sequence reveals the following:

```
GvH: Examining signal sequence (von Heijne)
    Signal Score (-7.5): -3.82
    Possible cleavage site: 60
>>> Seems to have no N-terminal signal seq.
Amino Acid Composition of Predicted Mature Form:
    calculated from 1
ALOM: Finding transmembrane regions (Klein et al.)
    count: 0   value:  2.86 threshold:  0.0
    PERIPHERAL   Likelihood =  2.86
    modified ALOM score:    -1.07
Rule: cytoplasmic protein
*** Reasoning Step: 2
----- Final Results -----
         bacterial cytoplasm --- Certainty=
             0.197(Affirmative) < succ>
         bacterial periplasmic space --- Certainty=
             0.000(Not Clear) < succ>
         bacterial outer membrane --- Certainty=
             0.000(Not Clear) < succ>
         bacterial inner membrane --- Certainty=
             0.000(Not Clear) < succ>
```

The protein has homology with the following sequences in the databases:

Based on this analysis, it was predicted that this protein from *N. gonorrhoeae*, and its epitopes, could be useful antigens for vaccines or diagnostics.

EXAMPLE 60

A DNA sequence was identified in *N. gonorrhoeae* <SEQ ID 119> which encodes amino acid sequence <SEQ ID 120; NGS60>. Analysis of this protein sequence reveals the following:

```
GvH: Examining signal sequence (von Heijne)
    Signal Score (-7.5): -3.14
    Possible cleavage site: 16
>>> Seems to have no N-terminal signal seq.
Amino Acid Composition of Predicted Mature Form:
    calculated from 1
ALOM: Finding transmembrane regions (Klein et al.)
    count: 0   value:  2.76 threshold:  0.0
    PERIPHERAL   Likelihood =  2.76
    modified ALOM score:    -1.05
Rule: cytoplasmic protein
*** Reasoning Step: 2
----- Final Results -----
         bacterial cytoplasm --- Certainty=
             0.330(Affirmative) < succ>
         bacterial periplasmic space --- Certainty=
             0.000(Not Clear) < succ>
         bacterial outer membrane --- Certainty=
             0.000(Not Clear) < succ>
         bacterial inner membrane --- Certainty=
             0.000(Not Clear) < succ>
```

The protein has homology with the following sequences in the databases:

```
>gi|11353338|pir||F81882 hypothetical protein NMA1155 [imported] Neisseria
meningitidis (group A strain Z2491)
gi|7379848|emb|CABB4417.1|(AL162755) hypothetical protein NMA1155 [Neisseria
meningitidis Z2491]
Length = 120
Score = 131 bits (329), Expect = 2e-30
Identities = 64/68 (94%), Positives = 67/68 (98%)

Query:    1 LSDISASRAAYMDVQKQYPFETVAVCVLPNHIHAIWTLPPDDADYSLLRRLIKTKFSAYS  60
            +S+ISASRAAYMDVQKQYPFETVAVCVLPNHIHAIWTLPPDDADYSLLRRLIKTKFSAYS
Sbjct:    1 MSNISASRAAYMDVQKQYPFETVAVCVLPNHIHAIWTLPPDDADYSLLRRLIKTKFSAYS  60

Query:   61 PHTKNLGA                                                      68
            P+TKNL A
Sbjct:   61 PYTKNLSA                                                      68
```

```
>gi|11281269|pir||D81804 hypothetical protein NMA1789 [imported]-Neisseria
meningitidis (group A strain Z2491)
gi|7380430|emb|CAB85016.1|(AL162757) hypothetical protein [Neisseria
meningitidis Z2491]
Length = 243
Score = 154 bits (389), Expect 5e-37
Identities = 82/85 (96%), Positives = 82/85 (96%)

Query:  12 MNTKTELQKLLEEDISTLKETLIRVDALPPRYVRSIATPIVRRWLIDKQLNILAKEIGLT   71
           MNTKTELQKLLEEDISTL ETLI  DALPPRYVRSIATPIVRRWLIDKQLNILAKEIGLT
Sbjct:   1 MNTKTELQKLLEEDISTLTETLICADALPPRYVRSIATPIVRRWLIDKQLNILAKEIGLT   60

Query:  72 IELPILDTSLVFEKLSTLENKVNFY                                      96
           IELPILDTSLVFEKLSTLENKVNFY
Sbjct:  61 IELPILDTSLVFEKLSTLENKVNFY                                      85
```

As a homolog was found in serogroup A *N. meningitidis* but not in serogroup B, NGS60 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 61

A DNA sequence was identified in *N. gonorrhoeae* <SEQ ID 121> which encodes amino acid sequence <SEQ ID 122; NGS61>. Analysis of this protein sequence reveals the following:

GvH: Examining signal sequence (von Heijne)
    Signal Score (-7.5): -6.88
    Possible cleavage site: 32
>>> Seems to have no N-terminal signal seq.
Amino Acid Composition of Predicted Mature Form:
    calculated from 1
ALOM: Finding transmembrane regions (Klein et al.)
    count: 0   value:   5.52 threshold:   0.0
    PERIPHERAL   Likelihood =   5.52
    modified ALOM score:   -1.60
Rule: cytoplasmic protein
*** Reasoning step: 2
----- Final Results -----
    bacterial cytoplasm --- Certainty= 0.300(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

The protein has homology with the following sequences in the databases:

As a homolog (amino acids 1-96) was found in serogroup A *N. meningitidis* but not in serogroup B, NGS61 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 62

A DNA sequence was identified in *N. gonorrhoeae* <SEQ ID 123> which encodes amino acid sequence <SEQ ID 124; NGS62>. Analysis of this protein sequence reveals the following:

GvH: Examining signal sequence (von Heijne)
    Signal Score (-7.5): -2.43
    Possible cleavage site: 44
>>> Seems to have no N-terminal signal seq.
Amino Acid Composition of Predicted Mature Form:
    calculated from 1
ALOM: Finding transmembrane regions (Klein et al.)
    count: 0   value:   4.72 threshold:   0.0
    PERIPHERAL   Likelihood =   4.72
    modified ALOM score:   -1.44
Rule: cytoplasmic protein
*** Reasoning Step: 2
----- Final Results -----
    bacterial cytoplasm --- Certainty= 0.324(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

```
>gi|11281269|pir||D81804 hypothetical protein NMA1789 [imported]-Neisseria
meningitidis (group A strain Z2491)
gi|7380430|emb|CAB5016.1|(AL162757) hypothetical protein [Neisseria
meningitidis Z2491]
Length = 243
Score = 193 bits (491), Expect = 5e-49
Identities = 96/101 (95%), Positives = 97/101 (95%)

Query:    1 MAGGVYLGGKIISPIYHSSQEFSGEPIIYAETNIILCPAEKFLTLKRVFHNGNIFNMNQI    60
            MAGGVYLGG+ IS  IYHSSQEFSGEPIIYAETNIILCPAEKFLTLKRVFHNGNIFNMNQI
Sbjct:   86 MAGGVYLGGEFISSIYHSSQEFSGEPIIYAEPNIILCPAEKFLTLKRVFHNGNIFNMNQI   145

Query:   61 ITFLSNKQGGVRFDKNYDKYKTWQVAIEKAANFLKLGNPYN                     101
            ITFLSNKQGGV FDKNYDKYKTWQVAIEKAANFLKLGNPYN
Sbjct:  146 ITFLSNKQGGVHFDKNYDKYKTWQVAIEKAANFLKLGNPYN                     186)
```

A homolog was found in serogroup A *N. meningitidis* but not in serogroup B, so NGS62 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 63

A DNA sequence was identified in *N. gonorrhoeae* <SEQ ID 125> which encodes amino acid sequence <SEQ ID 126; NGS63>. Analysis of this protein sequence reveals the following:

---

GvH: Examining signal sequence (von Heijne)
    Signal Score (-7.5): 0.74
    Possible cleavage site: 24
>>> Seems to have a cleavable N-term signal seq.
Amino Acid Composition of predicted Mature Form:
    calculated from 25
ALOM: Finding transmembrane regions (Klein et al.)
    count: 0   value:   10.72 threshold:   0.0
    PERIPHERAL   Likelihood =   10.72
    modified ALOM score:   -2.64
Score for OM-PP discrimination: -22.14
Rule: outer membrane or periplasmic protein
Score for OM-PP discrimination: -22.14
Rule: outer membrane or periplasmic protein
*** Reasoning Step: 2
Periplasmic space?   Score: 2.21378
Periplasmic space?   Score: 2.21378
----- Final Results -----
    bacterial periplasmic space --- Certainty=
    0.931(Affirmative) < succ>
      bacterial outer membrane --- Certainty=
      0.237(Affirmative) < succ>
      bacterial inner membrane --- Certainty=
      0.000(Not Clear) < succ>
        bacterial cytoplasm --- Certainty=
        0.000(Not Clear) < succ>

---

The protein has homology with the following sequences in the databases:

```
>gi|11284146|pir||B81142 hypothetical protein NMB0912 [imported]-Neisseria
meningitidis (group B strain MD5B)
gi|7226150|gb|AAF41320.1|(AE002443) hypothetical protein [Neisseria
meningitidis MC58]
Length = 208
Score = 51.7 bits (119), expect = 3e-06
Identities = 30/72 (41%), Positives = 40/72 (54%)

Query:   5 LLKNWKPLLILSAIAFFAVSWQLDRAAQYRRGYGAAVSEVSERLKAAAVEHAEHARKSSA   64
           LLK WKP+ +L  I    +W  DRA +YR G  AA +E+S RLK    +E A+ AR +
Sbjct:  43 LLKYWKPVGVLLLIVLIFTAWHFDRAEKYRMGREAAAAEISNRLKDGYIEQAKQARSAEQ  102

Query:  65 AYQAQKAAEEEK   76
           A   A R+  K
Sbjct: 103 KAAAAPAERQTK  114
```

Based on this analysis, it was predicted that this protein from *N. gonorrhoeae*, and its epitopes, could be useful antigens for vaccines or diagnostics.

EXAMPLE 64

A DNA sequence was identified in *N. gonorrhoeae* <SEQ ID 127> which encodes amino acid sequence <SEQ ID 128; NGS64>. Analysis of this protein sequence reveals the following:

---

McG: Examining signal sequence (McGeoch)
    Length of UR: 0
    Peak Value of UR: 2.99
    Net Charge of CR: 4
    Discriminant Score: 5.35
GvH: Examining signal sequence (von Heijne)
    Signal Score (-7.5): -2.53
    Possible cleavage site: 33
>>> Seems to have an uncleavable N-term signal seq
Amino Acid Composition of Predicted Mature Form:
    calculated from 1
ALOM: Finding transmembrane regions (Klein et al.)
    count: 0   value:   3.23 threshold:   0.0
    PERIPHERAL   Likelihood =   3.23
    modified ALOM score:   -1.15
*** Reasoning Step: 2
----- Final Results -----
    bacterial inner membrane --- Certainty=
    0.054(Affirmative) < succ>
    bacterial periplasmic space --- Certainty=
    0.000(Not Clear) < succ>
    bacterial outer membrane --- Certainty=
    0.000(Not Clear) < succ>
      bacterial cytoplasm --- Certainty=
      0.000(Not Clear) < succ>

---

The protein has no homology with sequences in the databases.

Based on this analysis, it was predicted that this protein from *N. gonorrhoeae*, and its epitopes, could be useful antigens for vaccines or diagnostics.

EXAMPLE 65

A DNA sequence was identified in *N. gonorrhoeae* <SEQ ID 129> which encodes amino acid sequence <SEQ ID 130; NGS65>. Analysis of this protein sequence reveals the following:

---

GvH: Examining signal sequence (von Heijne)
    Signal Score (-7.5): -5.61
    Possible cleavage site: 61

-continued

>>> Seems to have no N-terminal signal seq.
Amino Acid Composition of Predicted Mature Form:
    calculated from 1
ALOM: Finding transmembrane regions (Klein et al.)
    count: 0   value:   3.34 threshold:   0.0
    PERIPHERAL   Likelihood =   3.34
    modified ALOM score:   -1.17

-continued

Rule: cytoplasmic protein
*** Reasoning Step: 2
----- Final Results -----
    bacterial cytoplasm --- Certainty=
    0.236(Affirmative) < succ>
    bacterial periplasmic space --- Certainty=
    0.000(Not Clear) < succ>
      bacterial outer membrane --- Certainty=
      0.000(Not Clear) < succ>
      bacterial inner membrane --- Certainty=
      0.000(Not Clear) < succ>

The protein has homology with the following sequences in the databases:

Based on this analysis, it was predicted that this protein from *N. gonorrhoeae,* and its epitopes, could be useful antigens for vaccines or diagnostics.

EXAMPLE 66

A DNA sequence was identified in *N. gonorrhoeae* <SEQ ID 131> which encodes amino acid sequence <SEQ ID 132; NGS66>. Analysis of this protein sequence reveals the following:

GvH: Examining signal sequence (von Heijne)
    Signal Score (–7.5): –3.12
    Possible cleavage site: 53
    >>> Seems to have no N-terminal signal seq.
Amino Acid Composition of Predicted Mature Form:

```
>gi|1175791|sp|P44189|YE18_HAEIN HYPOTHETICAL PROTEIN HI1418
gi|1074769|pir||A64029 hypothetical protein HI1418-Haemophilus influenzae
(strain Rd KW20)
gi|1574254|gb|AAC23068.1|(U32821) H. influenzae predicted coding region
HI1418
[Haemophilus influenzae Rd]
Length = 201
Score = 104 bits (251), Expect = 1e-21
Identities = 58/119 (48%), Positives = 72/119 (59%), Gaps = 4/119 (3%)

Query:  51 LKMQNTISFSFKSQNRTQI-LGAEPFCLGDVAEILQIQNAR---QLPLKDQGIQKSS    106
           +K Q   S F+FK   VR +    E WFC  DV  IL    N+R   Q   K  G+ K
Sbjct:  14 MKNQIQFSTFFKDLPVRTILDPKGEFFCGTDVCHILGYTNSRKALQDHCKQGGVTKRY    73

Query: 107 VATKKGNQELLFINEPNLYRVIFRSRKAEAVFQDWIFEEVIPQIRKTGGYQITPKTTA    165
              TK   +QE+ FINEPNLYR+I +SRK EA   F+ W+FEEV+PQIRKTG YQ+ P+   A
Sbjct:  74 TPTKSADQEMTFINEPNLYRLIIKSRKPEAEPFEAWVFEEVLPQIRKTGKYQLQPQQLA    132

>gi|11281012|pir||A81144 hypothetical protein NMB0900 [imported]-Neisseria
meningitidis (group B strain MD58)
gi|7226137|gb|AAF41308.1|(AE002442) hypothetical protein [Neisseria
meningitidis MC58]
Length = 305
Score = 104 bits (249), Expect = 2e-21
Identities = 73/137 (53%), Positives = 93/137 (67%), Gaps = 2/137 (1%)

Query: 190 YSMIHQRFNVEAVEGIPADKLPEAVAYHALTLHTG-LAGEVPDREPLPAPQPALPISGN    248
            +S +  +F      E +PA++ PE ++ +  + +  G L GEV DREPLPAPQPALPISGN
Sbjct: 164 WSAVKSKFGCSYKE-VPAEQFPELSMGRVAVENGVLYGEVLDREPLPAPQPALPISGN    222

Query: 249 ALADIAAMVYYGTRHIELGKDVSAPLKQLGCKQAVTMWTVWHETRSILKRSVAALEVLRG    308
            AL D+A  V  YG   I++G+DVS PLKQLGC+QAVTMWTVW  ETRS LK +   ALE L
Sbjct: 223 ALYDLAVAVRYGAWAIQMGRDVSLPLKQLGCKQAVTMWTVWAETRSRLKAAANALEALNA    282

Query: 309 YADKDASGRIAACLEGI    325
           +AD   + +I    L  I
Sbjct: 283 HADAEHAAKIRPMLPEI    299

>gi|7460273|pir||T13267 hypothetical protein-Lactococcus lactis phage BK5-T
gi|928839|gb|AAA98590.1|(L44593) ORF266; putative [Lactococcus phage BK5-T]
Length = 266
Score = 75.9 bits (179), Expect = 6e-13
Identities = 42/111 (37%), Positives = 63/111 (55%), Gaps = 3/111 (2%)

Query:  55 NTISVFSFKSQNVRTQILGAEPWFCLGDVAEILQIQNAR---QLPLKDQGIQKSSVATKK    111
           N +  F+F +   VRT ++   EPWF    DVA   +N R   +   +KD   ++S + T
Sbjct:   2 NELQNFNFNNLPVRTVLINDEPWFVGKDVAIAIGYKNFRDALKSHVKDKYKRESRITTPS    61

Query: 112 GNQELLFINEPNLYRVIFRSRKAEAVKFQDWIFEBVIPQIRKTGGYQITPK    162
            G  Q +  I+EP LY++    S+      A FQDW++EEV+P IRK G Y     K
Sbjct:  62 GVQSVTVISEPGLYQLAGESKLPSAEPFQDWEELPTIRKHGAYMTDAK    112
``` calculated from 1
ALOM: Finding transmembrane regions (Klein et al.)
    count: 0    value: 8.96 threshold: 0.0
    PERIPHERAL    Likelihood = 8.96
    modified ALOM score:    −2.29
Rule: cytoplasmic protein
*** Reasoning Step: 2
----- Final Results -----
        bacterial cytoplasm --- Certainty=
        0.402(Affirmative) < succ>
        bacterial periplasmic space --- Certainty=
        0.000(Not Clear) < succ>
            bacterial outer membrane --- Certainty=
            0.000(Not Clear) < succ>
            bacterial inner membrane --- Certainty=
            0.000(Not Clear) < succ>

The protein has no homology with sequences in the databases.

Based on this analysis, it was predicted that this protein from *N. gonorrhoeae,* and its epitopes, could be useful antigens for vaccines or diagnostics.

EXAMPLE 67

A DNA sequence was identified in *N. gonorrhoeae* <SEQ ID 133> which encodes amino acid sequence <SEQ ID 134; NGS67>. Analysis of this protein sequence reveals the following:

GvH: Examining signal sequence (von Heijne)
    Signal Score (−7.5): 5.71
    Possible cleavage site: 22
>>> Seems to have a cleavable N-term signal seq.
Amino Acid Composition of Predicted Mature Form:
    calculated from 23
ALOM: Finding transmembrane regions (Klein et al.)

count: 0    value: 2.81 threshold: 0.0
    PERIPHERAL    Likelihood = 2.81
    modified ALOM score:    −1.06
Score for OM-PP discrimination: −32.34
Rule: outer membrane or periplasmic protein
Score for OM-PP discrimination: −32.34
Rule: outer membrane or periplasmic protein
*** Reasoning Step: 2
Periplasmic space?    Score: 3.23391
Periplasmic space?    Score: 3.23391
----- Final Results -----
        bacterial periplasmic space --- Certainty=
        0.928(Affirmative) < succ>
            bacterial outer membrane --- Certainty=
            0.199(Affirmative) < succ>
            bacterial inner membrane --- Certainty=
            0.000(Not Clear) < succ>
                bacterial cytoplasm --- Certainty=
                0.000(Not Clear) < succ>

The protein has homology with the following sequences in the databases:

```
>gi|7475078|pir||H69834 hypothetical protein yhjQ-Bacillus subtilis
gi|2226189|emb|CAA74479.1|(Y14081) hypothetical protein [Bacillus
subtilis]
gi|2633396|emb|CAB12900.1|(Z99109) yhjQ [Bacillus subtilis]
Length = 108
Score = 32.9 bits (74), Expect = 2.1
Identities = 27/98 (27%), Positives = 44/98 (44%), Gaps = 4/98 (4%)

Query:   54 CLDAGQVCLTHCLSLLTQGDTSMSDCAVAVRQMLALCGAVHDLAAQNSPLTRDAAKVCLE   113
            C+ A    C T CL     Q    +S C   R+   +C      +SP ++   +C+
Sbjct:   15 CMKACNHCFTKCLEESVQ--HHLSGCIRLDRECADICALAVKAMQTDSPFMKEICALCAD   72

Query:  114 ACKQCAKACKEHSAHHAECKACYESCLDCIKECEKLAA                        151
            C+ C   C +H   H   C+AC ++C   C ++C   +AA
Sbjct:   73 ICEACGTECGKHD--HDHCQACAKACFTCAEQCRSMAA                        108

>gi|7479923|pir||T36241 hypothetical protein SCE39.31c-Streptomyces
coelicolor
gi|4582392|emb|CAB40339.1|(AL049573) hypothetical protein [Streptomyces
coelicolor A3(2)]
Length = 136
Score = 30.9 bits (69), Expect = 7.7
Identities = 27/102 (26%), Positives = 43/102 (41%), Gaps = 6/102 (5%)

Query:   54 CLDAGQVCLTHCLSLLTQGDTSMSDCAVAVRQMLALCGAVHDLAAQ----NSPLTRDAAK   109
            C  A    C     CLS T D ++C         +C A   + ++        ++ +TR   +
Sbjct:   34 CAQACTACADACLSEPTVAD--LTKCIRTDMDCADVCTATAAVLSRHTGYDANVTRAVLQ   91

Query:  110 VCLEACKQCAKACKEHSAHHAECKACYESCLDCIKECEKLAA                    151
             C      C   C    C   H+   H   C+  C E+C   C + C++L  A
Sbjct:   92 ACATVCAACGDECARHAGMHEHCRVCAEACRSCEQACQELLA                    133
```

The protein was expressed in *E. coli* as a soluble 14.19 kDa His-fusion product and then purified.

Based on this analysis, it was predicted that this protein from *N. gonorrhoeae,* and its epitopes, could be useful antigens for vaccines or diagnostics.

EXAMPLE 68

A DNA sequence was identified in *N. gonorrhoeae* <SEQ ID 135> which encodes amino acid sequence <SEQ ID 136; NGS68>. Analysis of this protein sequence reveals the following:

```
GvH: Examining signal sequence (von Heijne)
    Signal Score (-7.5): -4.05
    Possible cleavage site: 38
>>> Seems to have no N-terminal signal seq.
Amino Acid Composition of Predicted Mature Form:
    calculated from 1
ALOM: Finding transmembrane regions (Klein et al.)
    count: 0   value:  5.25 threshold:  0.0
    PERIPHERAL   Likelihood =  5.25
    modified ALOM score:   -1.55
Rule: cytoplasmic protein
*** Reasoning Step: 2
----- Final Results -----
        bacterial cytoplasm --- Certainty=
          0.220(Affirmative) < succ>
        bacterial periplasmic space --- Certainty=
          0.000(Not Clear) < succ>
          bacterial outer membrane --- Certainty=
          0.000(Not Clear) < succ>
          bacterial inner membrane --- Certainty=
          0.000(Not Clear) < succ>
```

The protein has homology with the following sequences in the databases:

Based on this analysis, it was predicted that this protein from *N. gonorrhoeae,* and its epitopes, could be useful antigens for vaccines or diagnostics.

EXAMPLE 69

A DNA sequence was identified in *N. gonorrhoeae* <SEQ ID 137> which encodes amino acid sequence <SEQ ID 138; NGS69>. Analysis of this protein sequence reveals the following:

```
GvH: Examining signal sequence (von Heijne)
    Signal Score (-7.5): -5.63
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 0   value:  6.84 threshold:  0.0
    PERIPHERAL   Likelihood =  6.84
    modified ALOM score:   -1.87
Rule: cytoplasmic protein
*** Reasoning Step: 2
----- Final Results -----
        bacterial cytoplasm --- Certainty=
          0.361(Affirmative) < succ>
        bacterial periplasmic space --- Certainty=
          0.000(Not Clear) < succ>
          bacterial outer membrane --- Certainty=
          0.000(Not Clear) < succ>
          bacterial inner membrane --- Certainty=
          0.000(Not Clear) < succ>
```

```
>gi|11353493|pir||A81795 hypothetical protein NMA2214 [imported]-Neisseria
meningitidis (group A strain Z2491)
gi|7380833|emb|CAB85425.1|(AL162758) hypothetical protein [Neisseria
meningitidis Z2491]
Length = 208
Score = 263 bits (673), Expect = 3e-69
Identities = 140/145 (96%), Positives = 143/145 (98%)

Query:    1 LDWRGNKPLGAAELADLKPLYKDFMYWERGLHMYKASAVVPTGYVRVGNTAPLCGEDTQR    60
            LDWRGNKPLGAAELADLKPLYKDFMYWERGLHMYKASAVVPTGYVRVGNTAPL GEDTQR
Sbjct:   44 LDWQGNKPLGAAELADLKPLYKDFMYWERGLHMYKASAVVPTGYVRVGNTAPLVGEDTQR   103

Query   61 YASFWGDGYDVYRQLRWRQIPEKQRKAFKKAAKSKNTVMFAGREYGISKQNLSDVWDDFE   120
           YASFWGDGYDVYRQLRW+QIPEKQRKAFKKAAKSK TVMFAGREYGISKQNLSDVWDDFE
Sbjct:  104 YASFWGDGYDVYRQLRWQQIPEKQRKAFKKAAKSKKTVMFAGREYGISKQNLSDVWDDFE   163

Query:  121 DAMELAKAFPCLSSLFLTKWHKNLYE                                    145
            DAMELAKAFPCLSSLFLTKWHKNLY+
Sbjct:  164 DAMELAKAFPCLSSLFLTKWHKNLYD                                    188

>gi|11280955|pir|B81219 hypothetical protein NMB0273 [imported]-Neisseria
meningitidis (group B strain MD58)
gi|7225497|gb|AAF40727.1|(AE002383) hypothetical protein [Neisseria
meningitidis MC58]
Length = 141
Score = 216 bits (550), Expect = 5e-55
Identities = 117/121 (96%), Positives = 119/121 (97%)

Query:   25 MYWERGLHMYKASAVVPTGYVRVGNTAPLCGEDTQRYASFWGDGYDVYRQLRWRQIPEKQ    84
            MYWERGLHMYKASAVVPTGYVRVGNTAP  CGEDTQRYASFWGDGYDVYRQLRW+QIPEKQ
Sbjct:    1 MYWERGLHMYKASAVVPTGYVRVGNTAPLVGEDTQRYASFWGDGYDVYRQLRWQQIPEKQ    60

Query:   85 RKAFKKAAKSKNTVMFAGREYGISKQNLSDVWDDFEDAMELKAFPCLSSLFLTKWHKNLY   144
            RKAFKKAAKSK TVMFAGREYGISKQNLSDVWDDFEDAMELKAFPCLSSLFLTKWHKNLY
Sbjct:   61 RKAFKKAAKSKKTVMFAGREYGISKQNLSDVWDDFEDAMELKAFPCLSSLFLTKWHKNLY   120

Query:  145 E                                                              145
            +
Sbjct:  121 D                                                              121
```

The protein has homology with the following sequences in the databases:

```
>gi|7464552|pir||C64707 hypothetical protein HP1499-Helicobacter pylori
(strain 26695)
gi|2314683|gb|AAD08545.1|(AE000648) H. pylori predicted coding region
HP1499 [Helicobacter pylori 26695]
Length = 272
Score = 38.2 bits (88), Expect = 0.13
Identities = 34/123 (27%), Positives = 58/123 (46%), Gaps = 10/123 (8%)

Query:    3 EFKPIFGQDFGLSKKEAIRKVLKWLPSHLKFTLMVAQGIQG------FHPKAVFWKNDKN    56
            EF+ I G DF +  ++IR +L    ++ K          +       FHPK  + N K
Sbjct:   54 EFEIIVGLDFKTTDSKSIRFLLDLNKTYKKLRFYCYGDKENNKTDIVFHPKIYMFDNGK-   112

Query:   57 EYYALIGSSNLTHAAFNSNYEAN-ILTKISEQDFIKVKSWADEI--AMKSIPVSEDWLEE  113
            E  ++IGS+NLT     +N+E N I T+      + ++ +  I A      +E++L+
Sbjct:  113 EKTSIIGSTNLTKGGLENNFEVNTIFTEKKPLYYTQLNAIYNSIKYADSLFTPNEEYLQN  172

Query:  114 YQE                                                           116
            Y E
Sbjct:  173 YNE                                                           175
```

A homolog was found in serogroup A *N. meningitidis* but not in serogroup B, so NGS69 protein and nucleic acid are useful for distinguishing between gonococcus and serogroup B *N. meningitidis*.

Based on this analysis, it was predicted that this protein from *N. gonorrhoeae,* and its epitopes, could be useful antigens for vaccines or diagnostics.

EXAMPLE 70

A DNA sequence was identified in *N. gonorrhoeae* <SEQ ID 139> which encodes amino acid sequence <SEQ ID 140; NGS70>. Analysis of this protein sequence reveals the following:

GvH: Examining signal sequence (von Heijne)
    Signal Score (−7.5): −1.18
    Possible cleavage site: 22
    >>> Seems to have a cleavable N-term signal seq.
    Amino Acid Composition of Predicted Mature Form:
        calculated from 23
ALOM: Finding transmembrane regions (Klein et al.)
    count: 0   value: 4.19  threshold: 0.0
    PERIPHERAL  Likelihood = 4.19
    modified ALOM score:  −1.34
Score for OM-PP discrimination: −5.89
Rule: outer membrane or periplasmic protein
Score for OM-PP discrimination: −5.89
Rule: outer membrane or periplasmic protein
*** Reasoning Step: 2
Periplasmic space?   Score: 0.588927
Periplasmic space?   Score: 0.588927

-continued

----- Final Results -----
    bacterial periplasmic space --- Certainty= 0.849(Affirmative) < succ>
    bacterial outer membrane --- Certainty= 0.106(Affirmative) < succ>
    bacterial inner membrane --- Certainty= 0.000(Not Clear) < succ>
    bacterial cytoplasm --- Certainty= 0.000(Not Clear) < succ>

The protein has homology with the following sequences in the databases:

```
>gi|11353344|pir||A81886 hypothetical protein NMA1183 [imported]-Neisseria
meningitidis (group A strain Z2491)
gi|7379875|emb|CAB84445.1|(AL162755) hypothetical protein NMA1183 [Neisseria
meningitidis Z2491]
Length = 74
Score = 58.7 bits (141), Expect = 2e-08
Identities = 30/43 (69%), Positives = 32/43 (73%)

Query:   62 IGGFGGVGGFGGLKPALVYRNFRIIATNRPAATRARPRQTTVA                    104
            +G||G+|G|GGLKP|LVY|N|| IIATNRPAATRA|PR|TTVA
Sbjct:   32 MGNIDGIDGSGGLKPTLVYWNHCIIATNRPAATRAHPRHTTVA                     74
```

Based on this analysis, it was predicted that this protein from *N. gonorrhoeae,* and its epitopes, could be useful antigens for vaccines or diagnostics.

EXAMPLE 71

A DNA sequence was identified in *N. gonorrhoeae* <SEQ ID 141> which encodes amino acid sequence <SEQ ID 142; NGS71>. Analysis of this protein sequence reveals the following:

GvH: Examining signal sequence (von Heijne)
    Signal Score (−7.5): −1.98
    Possible cleavage site: 28
    >>> Seems to have a cleavable N-term signal seq.
    Amino Acid Composition of Predicted Mature Form:

```
calculated from 29
ALOM: Finding transmembrane regions (Klein et al.)
     count: 0   value:  5.04 threshold:  0.0
     PERIPHERAL  Likelihood =  5.04
     modified ALOM score:   −1.51
Score for OM-PP discrimination: −9.17
Rule: outer membrane or periplasmic protein
Score for OM-PP discrimination: −9.17
Rule: outer membrane or periplasmic protein
*** Reasoning Step: 2
Periplasmic space?  Score: 0.916744
Periplasmic space?  Score: 0.916744
----- Final Results -----
        bacterial periplasmic space --- Certainty=
        0.923(Affirmative) < succ>
           bacterial outer membrane --- Certainty=
           0.146(Affirmative) < succ>
           bacterial inner membrane --- Certainty=
           0.000(Not Clear) < succ>
              bacterial cytoplasm --- Certainty=
              0.000(Not Clear) < succ>
```

The protein has no homology with sequences in the databases.

Based on this analysis, it was predicted that this protein from *N. gonorrhoeae*, and its epitopes, could be useful antigens for vaccines or diagnostics.

EXAMPLE 72

A DNA sequence was identified in *N. gonorrhoeae* <SEQ ID 143> which encodes amino acid sequence <SEQ ID 144; NGS72>. Analysis of this protein sequence reveals the following:

```
GvH: Examining signal sequence (von Heijne)
     Signal Score (−7.5): −3.18
     Possible cleavage site: 42
>>> Seems to have an uncleavable N-term signal seq
Amino Acid Composition of Predicted Mature Form:
     calculated from 1
ALOM: Finding transmembrane regions (Klein et al.)
     count: 4   value:  −8.76 threshold:  0.0
     INTEGRAL     Likelihood =  −8.76    Transmembrane
     11-27 (8-37)
     INTEGRAL     Likelihood =  −6.90    Transmembrane
     80-96 (75-102)
     INTEGRAL     Likelihood =  −2.39    Transmembrane
     98-114 (98-114)
     INTEGRAL     Likelihood =  −1.12    Transmembrane
     47-63 (47-64)
     PERIPHERAL   Likelihood =   3.55
     modified ALOM score:   2.25
Rule: cytoplasmic membrane protein
*** Reasoning Step: 2
----- Final Results -----
        bacterial inner membrane --- Certainty=
        0.450(Affirmative) < succ>
        bacterial periplasmic space --- Certainty=
        0.000(Not Clear) < succ>
           bacterial outer membrane --- Certainty=
           0.000(Not Clear) < succ>
              bacterial cytoplasm --- Certainty=
              0.000(Not Clear) < succ>
```

The protein has homology with the following sequences in the databases:

```
>gi|11354095|pir||H81995 probable transmembrane transport protein NMA0047
[imported]-Neisseria meningitidis (group A strain Z2491)
gi|7378822|emb|CAB83364.1|(AL162752) putative transmembrane transport protein
[Neisseria meningitidis Z2491]
Length = 405
Score = 257 bits (658), Expect = 5e-68
Identities = 152/162 (93%), Positives = 154/162 (94%)

Query:    1 MTHTASKTPKLWAVIAAAAFILLITIGMRMTLGLFVQPVVNTTELNIAQFSLIITVFQLM  60
            MTHTASKTPK  W  I AAAAFILLITIGMRMTLGLFVQPVVNTTEL+IAQFSLII VFQLM
Sbjct:    1 MTHTASKTPKFWLTITAAAFILLITIGMRMTLGLFVQPVVNTTELNIAQFSLIITVFQLM  60

Query:   61 WGVLQPLSGALADRFGAFRVLSGGALLLVCACLIASNIPTYWGLMIAVGLLLAFGTGSGG 120
            WGV QPLSGALADRFGAFRVLSGGA+LLVCACLIA NIPTYWGLMIAVGLLLAFGTGSGG
Sbjct:   61 WGVSQPLSGALADRFGAFRVLSGGAVLLVCACLIAPNIPTYWGLMIAVGLLLAFGTGSGG 120

Query:  121 FSIIMGQVAAQVPTHKRGLASGLVNAGGSAGQFLFAPLVQGL                    162
            FSIIMGQVAAQVP HKRGLASGLVNAGGSAGQFLFAPLVQGL
Sbjct:  121 FSIIMGQVAAQVPAHKRGLASGLVNAGGSAGQFLFAPLVQGL                    162

>gi|11351469|pir||F83484 probable MFS transporter PA1286 [imported]- Pseudomo-
nas
aeruginosa (strain PAO1)
gi|9947221|gb|AAG04675.1|AE004558_4 (AE004558) probable MFS transporter
[Pseudomonas aeruginosa]
Length = 399
Score = 72.5 bits (177), Expect = 3e-12
Identities = 53/149 (35%), Positives = 81/149 (53%)

Query:   14 VIAAAAFILLITIGMRMTLGLFVQPVVNTTELNIAQFSLIITVFQLMWGVLQPLSGALAD  73
            ++  + A IL +++G+R   GLF+ P+         F+  I +   L+WG+ QP +GALAD
Sbjct:    8 ILLSGALILALSLGVRHGFGLFLAPMSADFGWGREVFAFAIALQNLVWGLAQPFTGALAD  67

Query:   74 RFGAFRVLSGGALLLVCACLIASNIPTYWGIMIAVGLLLAPGTGSGGFSIIMGQVAAQVP 133
            R+GA R+  G LL       ++     + GL ++ GLL+   G     FS+I+G+ V   VP
Sbjct:   68 RYGAARAVLVGGLLYALGLVLMGLSQSASGLSLSAGLLIGLGLSGTSFSVILGAVGRAVP 127
```

```
Query: 134 THKRGLASGLVNAGGSAGQFLPAPLVQGL                                 162
            +R +A G+ +A GS GQF   P    GL
Sbjct: 128 AEQRSMAMGISSAAGSFGQFAMLPGTLGL                                 156
```

As a homolog was found in serogroup A *N. meningitidis* but not in serogroup B, NGS72 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 73

A DNA sequence was identified in *N. gonorrhoeae* <SEQ ID 145> which encodes amino acid sequence <SEQ ID 146; NGS73>. Analysis of this protein sequence reveals the following:

---

GvH: Examining signal sequence (von Heijne)
  Signal Score (−7.5): −4.26
  Possible cleavage site: 52
>>> Seems to have no N-terminal signal seq.
Amino Acid Composition of Predicted Mature Form:
  calculated from 1

---

ALOM: Finding transmembrane regions (Klein et al.)
  count: 3   value: −3.72  threshold: 0.0
  INTEGRAL       Likelihood = −3.72   Transmembrane
  172-188 (171–190)
  INTEGRAL       Likelihood = −2.97   Transmembrane
  119-135 (114-137)
  INTEGRAL       Likelihood = −1.86   Transmembrane
  209-225 (205-225)
  PERIPHERAL     Likelihood =  4.88
  modified ALOM score:  1.24
Rule: cytoplasmic membrane protein
*** Reasoning Step: 2
----- Final Results -----
    bacterial inner membrane --- Certainty=
    0.249(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>

---

The protein has homology with the following sequences in the databases:

```
>gi|11354095|pir||H81995 probable transmembrane transport protein NMA0047
[imported]-Neisseria meningitidis (group A strain Z2491)
gi|7378822|emb|CAB83364.1|(AL162752) putative transmembrane transport protein
[Neisseria meningitidis Z2491]
Length = 405
Score = 222 bits (567), Expect = 3e-57
Identities = 116/123 (94%), Positives = 117/123 (94%), Gaps = 4/123 (3%)

Query: 103 QGLVVLPEVGWTGTFYVWGAIALLILPVSWWLAGGNNGGNNAAHTQHTQATHGQSLGEAV    162
           QGLVVLPEVGWTGTFYVWGAIALL LPVSWWLA    GGNNAAHTQH QATHGQSLGEAV
Sbjct: 160 QGLVVLPEVGWTGTFYVWGAIALLTLPVSWWLA----GGNNAAHTQHAQATHGQSLGEAV    215

Query: 163 KTAFKTPSYILLHLSFFACGFHIAFLVTHLPTEVALCGLPATVASTSIAIIGLANIAGCV    222
           KTAFKTPSYILLHLSFFACGFHIAFLVTHLPTEVALCGLPATVASTSIAIIGLANIAGC+
Sbjct: 216 KTAFKTPSYILLHLSFFACGFHIAFLVTHLPTEVALCGLPATVASTSIAIIGLANIAGCI    275

Query: 223 FSG                                                           225
           FSG
Sbjct: 276 FSG                                                           278

>gi|11351469|pir||F83484 probable MFS transporter PA1286 [imported]-Pseudomo-
nas
aeruginosa (strain PA01)
gi|9947221|gb|AAG04675.1|AE004558_4 (AE004558) probable MFS transporter
[Pseudomonas aeruginosa]
Length = 399
Score = 54.4 bits (130), Expect = 1e-06
Identities = 37/115 (32%), Positives = 56/115 (48%), Gaps = 10/115 (8%)

Query: 111 VGWTGTFYVWGAIALLILPVSWWLAGGNNGGNNAAHTQHTQATHGQSLGEAVKTAFKTPS    170
           +GW+        G ++ LI+P++   +                 H QSLGEA++ A
Sbjct: 160 LGWSSALLALGLLVALIVPLAGLM----------KDRPLPPQGHEQSLGEALREACAHSG    209

Query: 171 YILLHLSFFACGFHIAFLVTHLPTEVALCGLPATVASTSIAIIGLANIAGCVFSG        225
           + LL L FF CGF +F+  HLP   LPA V +T +A++GL N+ G      +G
Sbjct: 210 FWLLALGFFVCGFQVVFIGVHLPAYLVDQHLPAQVGTTVLALVGLFNVFGTYIAG        264
```

As a homolog was found in serogroup A *N. meningitidis* but not in serogroup B, so NGS73 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 74

A DNA sequence was identified in *N. gonorrhoeae* <SEQ ID 147> which encodes amino acid sequence <SEQ ID 148; NGS74>. Analysis of this protein sequence reveals the following:

GvH: Examining signal sequence (von Heijne)
    Signal Score (-7.5): 0.41
    Possible cleavage site: 30
>>> Seems to have no N-terminal signal seq.
Amino Acid Composition of Predicted Mature Form:
    calculated from 1
ALOM: Finding transmembrane regions (Klein et al.)
    count: 2   value:   -1.49 threshold:   0.0
    INTEGRAL   Likelihood = -1.49   Transmembrane 15-31 (15-31)
    INTEGRAL   Likelihood = -1.28   Transmembrane 8-99 (83-99)
    PERIPHERAL   Likelihood = 1.59
    modified ALOM score: 0.80
Rule: cytoplasmic membrane protein
*** Reasoning Step: 2
----- Final Results -----
    bacterial inner membrane --- Certainty= 0.160(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

The protein has homology with the following sequences in the databases:

As a homolog was found in serogroup A *N. meningitidis* but not in serogroup B, NGS74 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 75

A DNA sequence was identified in *N. gonorrhoeae* <SEQ ID 149> which encodes amino acid sequence <SEQ ID 150; NGS75>. Analysis of this protein sequence reveals the following:

GvH: Examining signal sequence (von Heijne)
    Signal Score (-7.5): -5.2
    Possible cleavage site: 22
>>> Seems to have no N-terminal signal seq.
Amino Acid Composition of Predicted Mature Form:
    calculated from 1
ALOM: Finding transmembrane regions (Klein et al.)
    count: 0   value:   4.45 threshold:   0.0
    PERIPHERAL Likelihood =   4.45
    modified ALOM score: -1.39
Rule: cytoplasmic protein
*** Reasoning Step: 2
----- Final Results -----
    bacterial cytoplasm --- Certainty= 0.237(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

The protein has homology with the following sequences in the databases:

```
>pir||H81995 probable transmembrane transport protein NMA0047 [imported]-
Neisseria meningitidis (group A strain Z2491)
emb|CAB3364.1|(AL162752) putative transmembrane transport protein [Neisseria
meningitidis Z2491]
Length = 405
Score = 148 bits (374), Expect = 2e-35
Identities = 97/106 (91%), Positives = 103/106 (96%)

Query:     1 MVLIYIFSPKTDLNFYIFAAALGFTWLATVAPTAAVTGKLFGTRYLATLFGLVMLTHQIG    60
             M+LIYIFSPKTDLNFYIFAAALGFTWLATV PTA++TGKLFGTRYLATLFGL ML+HQIG
Sbjct:   300 MILIYIFSPKTDLNFYIFAAALGFTWLATVTPTASITGKLFGTRYLATLFGLTMLSHQIG   359

Query:    61 GFLGSYIGGIVITQFGDYGWMWYADAVLAGTAALLVLPVREPRTAA                106
             GFLGSYIGGIVITQFGDYGWMWYADA+LAGTAALL LP+REPRTAA
Sbjct:   360 GFLGSYIGGIVITQFGDYGWMWYADALLAGTAALLNLPIREPRTAA                405

>pir||F83484 probable MFS transporter PA1286 [imported]-Pseudomonas
aeruginosa (strain PAO1)
gb|AAG04675.1|AE004558_4 (AE004558) probable MFS transporter [Pseudomonas
aeruginosa
Length = 399
Score = 59.0 bits (142), Expect = 2e-08
Identities = 40/101 (39%), Positives = 61/101 (59%)

Query:     1 MVLIYIFSPKTDLFYIFAAALGFTWLATVAPTAAVGKLFGTRYLATLFGLVMLTHQIG    60
             +++++++ P +  + Y F  A+G  WL+TV  T      LFG R L+ L G+V L HQ+G
Sbjct:   286 VIVLFLWLPLSVYSAYAFGVAMGLLWLSTVPLTNGTTLFGVRNLSMLGGIVFLFHQLG   345

Query:    61 GFLGSYIGGIVITQFGDYGWMWYADAVLAGTAALLVLPVRE                   101
              FLG ++GG+V  + G Y +W    +L+  AALL   PVRE
Sbjct:   346 AFLGGWLGGVVYDRTGSYDLVWQLSILLSLLAALLNWPVRE                   386
```

```
pir||S04419 type II site-specific deoxyribonuclease (EC 3.1.21.4) NgoPII-
Neisseria gonorrhoeae
emb|CAA368B7.1|(X52661) NgoPII restriction and modification [N. gonorrhoeae]
prf||1613419A NgoPII endonuclease [Neisseria gonorrhoeae]
Length = 278
Score = 240 bits (614), Expect = 4e-63
Identities = 128/129 (99%), Positives = 128/129 (99%)

Query:    1 MNIIDAIINLANNPVVGVNSHSQSNNRANQAGDALEEYVKDLFSGSFNLNETQRIARHAK    60
            MNIIDAIINLANNPVVGV SHSQSNNRANQAGDALEEYVKDLFSGSFNLNETQRIARHAK
Sbjct:    1 MNIIDAIINLANNPVVGVESHSQSNNRANQAGDALEEYVKDLFSGSFNLNETQRIARHAK    60

Query:   61 VFSYLGNNSNPPDAMLRNGDAIEVKKIESKDSALALNSSHPKSKLSVDDSMLTKACKDAE   120
            VFSYLGNNSNPPDAMLRNGDAIEVKKIESKDSALALNSSHPKSKLSVDDSMLTKACKDAE
Sbjct:   61 VFSYLGNNSNPPDAMLRNGDAIEVKKIESKDSALALNSSHPKSKLSVDDSMLTKACKDAE   120

Query:  121 KWEEKDIIY                                                     129
            KWEEKDIIY
Sbjct:  121 KWEEKDIIY                                                     129
```

Based on this analysis, it was predicted that this protein from *N. gonorrhoeae*, and its epitopes, could be useful antigens for vaccines or diagnostics.

EXAMPLE 76

A DNA sequence was identified in *N. gonorrhoeae* <SEQ ID 151> which encodes amino acid sequence <SEQ ID 152; NGS76>. Analysis of this protein sequence reveals the following:

GvH: Examining signal sequence (von Heijne)
  Signal Score (−7.5): −1.73
  Possible cleavage site: 13
>>> Seems to have no N-terminal signal seq.
Amino Acid Composition of Predicted Mature Form:
  calculated from 1
ALOM: Finding transmembrane regions (Klein et al.)
  count: 0   value:   9.39 threshold:   0.0
  PERIPHERAL Likelihood =  9.39
  modified ALOM score: −2.38
Rule: cytoplasmic protein
*** Reasoning Step: 2
----- Final Results -----
  bacterial cytoplasm --- Certainty= 0.272(Affirmative) < succ>

-continued bacterial periplasmic space --- Certainty= 0.000(Not Clear) < succ>
  bacterial outer membrane --- Certainty= 0.000(Not Clear) < succ>
  bacterial inner membrane --- Certainty= 0.000(Not Clear) < succ>

The protein has homology with the following sequences in the databases:

```
pir||S04419 type II site-specific deoxyribonuclease (EC 3.1.21.4) NgoPII-
Neisseria gonorrhoeae
emb|CAA36887.1|(X52661) NgoPII restriction and modification
[N. gonorrhoeae]
prf||1613419A NgoPII endonuclease [Neisseria gonorrhoeae]
Length = 278
Score = 268 bits (687), Expect = 2e-71
Identities = 136/136 (100%), Positives = 136/136 (100%)

Query:    1 LAMVYGIDYCADAECYLKIKNQIKEGIGNIGGIQFAETKELGRVNRIDPLNITYLRVRGM    60
            LAMVYGIDYCADAECYLKIKNQIKEGIGNIGGIQFAETKELGRVNRIDPLNITYLRVRGM
Sbjct:  143 LAMVYGIDYCADAECYLKIKNQIKEGIGNIGGIQFAETKELGRVNRIDPLNITYLRVRGM   202

Query:   61 WGIENPWFVFNYIYQRNMEKSFNFMAIINEDKWNSFNNTDKLLAIQDSKLAISDIKIKNP   120
            WGIENPWFVFNYIYQRNMEKSFNFMAIINEDKWNSFNNTDKLLAIQDSKLAISDIKIKNP
Sbjct:  203 WGIENPWFVFNYIYQRNMEKSFNFMAIINEDKWNSFNNTDKLLAIQDSKLAISDIKIKNP   262

Query:  121 NNPARLRNAKLITYHL                                              136
            NNPARLRNAKLITYHL
Sbjct:  263 NNPARLRNAKLITYHL                                              278
```

Based on this analysis, it was predicted that this protein from *N. gonorrhoeae*, and its epitopes, could be useful antigens for vaccines or diagnostics.

EXAMPLE 77

A DNA sequence was identified in *N. gonorrhoeae* <SEQ ID 153> which encodes amino acid sequence <SEQ ID 154; NGS77>. Analysis of this protein sequence reveals the following:

GvH: Examining signal sequence (von Heijne)
  Signal Score (−7.5): −4.51
  Possible cleavage site: 58
>>> Seems to have no N-terminal signal seq.

-continued

Amino Acid Composition of Predicted Mature Form:
 calculated from 1
ALOM: Finding transmembrane regions (Klein et al.)
 count: 0 value: 3.18 threshold: 0.0
 PERIPHERAL Likelihood = 3.18
 modified ALOM score: −1.14
Rule: cytoplasmic protein
*** Reasoning Step: 2
----- Final Results -----
 bacterial cytoplasm --- Certainty= 0.127(Affirmative) <succ>
 bacterial periplasmic space --- Certainty= 0.000(Not Clear) < succ>
 bacterial outer membrane --- Certainty= 0.000(Not Clear) < succ>
 bacterial inner membrane --- Certainty= 0.000(Not Clear) < succ>

The protein has homology with the following sequences in the databases:

```
>pir|||CTNHP2 site-specific DNA-methyltransferase (cytosine-specific) (EC
2.1.1.73) NgoPII-Neisseria gonorrhoeae
emb|CAA30038.1|(X06965) NgoPII methylase (AA 1-341) [Neisseria
gonorrhoeae]
emb|CAA3688B.1|(K52661) NgoPII restriction and modification [Neisseria
gonorrhoeae]
gb|AAA170419.1|(L14564) cytosine methylase [Neisseria gonorrhoeae]
prf||1613419B NgoPII methylase [Neisseria gonorrhoeae]
Length = 341
Score = 682 bits (1761), Expect = 0.0
Identities = 341/341 (100%), Positives = 341/341 (100%)

Query:   1 MQNSSPTTYNPMKIISLFSGCGGLDLGFEKAGFEIPAANEYDKTIWATFKANHPKTHLIE   60
           MQNSSPTTYNPMKIISLFSGCGGLDLGFEKAGFEIPAANEYDKTIWATFKANHPKTHLIE
Sbjct:   1 MQNSSPTTYNPMKIISLFSGCGGLDLGFEKAGFEIPAANEYDKTIWATFKANHPKTHLIE   60

Query:  61 GDIRKIKEEDFPEEIDGIIGGPPCQSWSEAGALRGIDDARGQLFFDYIRILKSKQPKFFL  120
           GDIRKIKEEDFPEEIDGIIGGPPCQSWSEAGALRGIDDARGQLFFDYIRILKSKQPKFFL
Sbjct:  61 GDIRKIKEEDFPEEIDGIIGGPPCQSWSEAGALRGIDDARGQLFFDYIRILKSKQPKFFL  120

Query: 121 AENVSGMLANRHNGAVQNLLKMFDGCGYDVTLTMANAKDYGVAQERKRVFYIGFRKDLEI  180
           AENVSGMLANRHNGAVQNLLKMFDGCGYDVTLTMANAKDYGVAQERKRVFYIGFRKDLEI
Sbjct: 121 AENVSGMLANRHNGAVQNLLKMFDGCGYDVTLTMANAKDYGVAQERKRVFYIGFRKDLEI  180

Query: 181 KFSFPKGSTVEDKDKITLKDVIWDLQDTAVPSAPQNKTNPDAVNNNEYFTGSFSPIFMSR  240
           KFSFPKGSTVEDKDKITLKDVIWDLQDTAVPSAPQNKTNPDAVNNNEYFTGSFSPIFMSR
Sbjct: 181 KFSFPKGSTVEDKDKITLKDVIWDLQDTAVPSAPQNKTNPDAVNNNEYFTGSFSPIFMSR  240

Query: 241 NRVKAWDEQGFTVQASGRQCQLHPQAPKMEKHGANDYRFAAGKETLYRRMTVREVARIQG  300
           NRVKAWDEQGFTVQASGRQCQLHPQAPKMEKHGANDYRFAAGKETLYRRMTVREVARIQG
Sbjct: 241 NRVKAWDEQGFTVQASGRQCQLHPQAPKMEKHGANDYRFAAGKETLYRRMTVREVARIQG  300

Query: 301 FPDNFKFIYQNVNDAYKMIGNAVPVNLAYEIAAAIKKTLER                    341
           FPDNFKFIYQNVNDAYKMIGNAVPVNLAYEIAAAIKKTLER
Sbjct: 301 FPDNFKFIYQNVNDAYKMIGNAVPVNLAYEIAAAIKKTLER                    341
```

Based on this analysis, it was predicted that this protein from *N. gonorrhoeae*, and its epitopes, could be useful antigens for vaccines or diagnostics.

EXAMPLE 78

A DNA sequence was identified in *N. gonorrhoeae* <SEQ ID 155> which encodes amino acid sequence <SEQ ID 156; NGS78>. Analysis of this protein sequence reveals the following:

GvH: Examining signal sequence (von Heijne)
 Signal Score (−7.5): −8.33
 Possible cleavage site: 24
>>> Seems to have no N-terminal signal seq.
Amino Acid Composition of Predicted Mature Form:
 calculated from 1
ALOM: Finding transmembrane regions (Klein et al.)
 count: 0 value: 2.17 threshold: 0.0
 PERIPHERAL Likelihood = 2.17
 modified ALOM score: −0.93
Rule: cytoplasmic protein
*** Reasoning Step: 2
----- Final Results -----
 bacterial cytoplasm --- Certainty= 0.220(Affirmative) < succ>

-continued bacterial periplasmic space --- Certainty= 0.000(Not Clear) < succ>
 bacterial outer membrane --- Certainty= 0.000(Not Clear) < succ>
 bacterial inner membrane --- Certainty= 0.000(Not Clear) < succ>

The protein has homology with the following sequences in the databases:

```
>pir||H82000 hypothetical protein NMA0089 [imported]-Neisseria meningitidis
(group A strain Z2491)
emb|CAB83405.1|(AL162752) hypothetical protein NMA0089 [Neisseria
meningitidis Z2491]
Length = 226
Score = 422 bits (1085), Expect = e-117
```

-continued
```
Identities = 217/228 (95%), Positives = 220/228 (96%), Gaps = 2/228 (0%)

Query:    1 MERYKNAVRKDKAAELYLLNLSLSRELFHVVSIFEIVLRNKIDICFRQEFKDRNRLYDSI    60
            MERYKNAV KDKAAELYLLNLSLSRELFHVVSIFEIVLRNKIDIC +Q FKD N LY+SI
Sbjct:    1 MERYKNAVGKDKAAELYLLNLSLSRELFHVVSIFEIVLRNKIDICLQQAFKDGNWLYNSI    60

Query:   61 QPQTNPALKYQGCFLRNGTKESAELIKVALSKIQNNSGGKFDHNQLVAGLGFGFWRYLFA   120
            QPQTNPALKYQGCFLRNGTKESAELIKVALSKIQNNSGGKFDHNQLVAGLGFGFWRYLFA
Sbjct:   61 QPQTNPALKYQGCFLRNGTKESAELIKVALSKIQNNSGGKFDHNQLVAGLGFGFWRYLFA   120

Query:  121 GGKDAQFDAAGKVLMKVFPKKPKSTPSVQYNQKWIFRELSNINNFRNRLAHHEPICFSFK   180
            GGKDAQFDA GKVLMKVFPKKPKSTPSVQ+NQKWIFRELSNINNFRNRLAHHEPIC  FK
Sbjct:  121 GGKDAQFDATGKVLMKVFPKKPKSTPSVQHNQKWIFRELSNINNFRNRLAHHEPIC--FK   178

Query:  181 GAIKDTGYARNIHQSIFELLNYMDVDTASVFSHFSDQVIAVCDEIDKL              228
            GAIKDTGYARNIHQSIFELLNYMDVDTASVFSHFSDQVIAVCDEIDKL
Sbjct:  179 GAIKDTGYARNIHQSIFELLNYMDVDTASVFSHFSDQVIAVCDEIDKL              226

>ref|NP_053274.1|Hypothetical gene [Agrobacterium tumefaciens]
 dbj|BAA87659.1|(AB016260) Hypothetical gene [Agrobacterium tumefaciens]
          Length = 380
 Score = 43.6 bits (102), Expect = 0.002
 Identities = 53/215 (24%), Positives = 86/215 (39%), Gaps = 42/215 (19%)

Query:    5 KNAVRKDKAAELYLLNLSLSRELFHVVSIFEIVLRNKIDICFRQEFKDRNRLYDSIQPQT   64
            K   ++ A   LYL N  +++    +  +++ E+ LRN +D         F
Sbjct:   55 KGGNHEEYAMALYLYNARVAKAFLYPLNVAEVTLRNAVDGILVARFG-------------  101

Query:   65 NPALKYQGCFLRNGTKESAELIKVALSKIQNNSGGKFDHNQLVAGLGFGFWRYLFAGGKD  124
              A  +Q   R+ T    L   L K    +G     +Q+VA L F FW   LF
Sbjct:  102 --ANWHQDATFRDQTLTGNGL--ATLDKAIQRAGAGAARDQIVATLTFDFWSNLFR----  153

Query:  125 AQFDAAGKVLMKVPKKPKSTPSVQYNQKWIFRELSN----INNFRNRLAHHEPICFSFK  180
             ++  +  + +      + P +Q+ +    +E+ N    IN FRNR+AHHEP+
Sbjct:  154 PEYGGLWRTTVNI------AFPHLQHGESR--QEIQNINKPINFRNRVAHHEPVL----  201

Query:  181 GAIKDTGYARNIHQSIFELLNYMDVDTASVFSSFS                          215
                 D    +IH  I   L+      +TA+   H S
Sbjct:  202 ----DLNVT-DIHAKIVRLIELRCAETATWMKHHS                          231
```

As a homolog was found in serogroup A *N. meningitidis* but not in serogroup B, so NGS78 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 79

A DNA sequence was identified in *N. gonorrhoeae* <SEQ D 157> which encodes amino acid sequence <SEQ ID 158; NGS79>. Analysis of this protein sequence reveals the following:

---

GvH: Examining signal sequence (von Heijne)
    Signal Score (−7.5): 2.07
    Possible cleavage site: 17
>>> Seems to have a cleavable N-term signal seq.
Amino Acid Composition of Predicted Mature Form:
    calculated from 18
ALOM: Finding transmembrane regions (Klein et al.)
    count: 0   value:  9.49 threshold:  0.0
    PERIPHERAL Likelihood = 9.49
    modified ALOM score: −2.40
Score for OM-PP discrimination: −11.72
Rule: outer membrane or periplasmic protein
Score for OM-PP discrimination: −11.72
Rule: outer membrane or periplasmic protein
*** Reasoning Step: 2
Periplasmic space?  Score: 1.17242
Periplasmic space?  Score: 1.17242
----- Final Results -----

-continued bacterial periplasmic space --- Certainty= 0.932(Affirmative) < succ>
    bacterial outer membrane --- Certainty= 0.240(Affirmative) < succ>
    bacterial inner membrane --- Certainty= 0.000(Not Clear) < succ>
    bacterial cytoplasm --- Certainty= 0.000(Not Clear) < succ>

---

A homolog (amino acids 23-85) was found in serogroup A *N. meningitidis* but not in serogroup B, so NGS79 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 80

A DNA sequence was identified in *N. gonorrhoeae* <SEQ ID 159> which encodes amino acid sequence <SEQ ID 160; NGS80>. Analysis of this protein sequence reveals the following:

---

GvH: Examining signal sequence (von Heijne)
    Signal Score (−7.5): −8.49
    Possible cleavage site: 57
>>> Seems to have no N-terminal signal seq.
Amino Acid Composition of Predicted Mature Form:
    calculated from 1
ALOM: Finding transmembrane regions (Klein et al.)
    count: 0   value:  4.98 threshold:  0.0

```
   PERIPHERAL Likelihood =  4.98
   modified ALOM score: -1.50
Rule: cytoplasmic protein
*** Reasoning Step: 2
----- Final Results -----
        bacterial cytoplasm --- Certainty= 0.428(Affirmative) < succ>
        bacterial periplasmic space --- Certainty= 0.000(Not Clear) < succ>
        bacterial outer membrane --- Certainty= 0.000(Not Clear) < succ>
        bacterial inner membrane --- Certainty= 0.000(Not Clear) < succ>
```

The protein has homology with the following sequences in the databases:

```
>pir||E81080 conserved hypothetical protein NMB1466 [imported]-Neisseria
meningitidis (group B strain MD58)
gb|AAF41823.1|(AE002496) conserved hypothetical protein [Neisseria
meningitidis MC58]
Length = 243
Score = 148 bits (375), Expect = 7e-35
Identities = 82/189 (43%), Positives = 109/189 (57%)

Query: 120 VDRMFNMAGNHFARLGISSGSGVHYWNARDFSEQAFHAEVGYRYRNSRLEWGFRPFVKQNR 179
            + R  N   +HF   GISG GVHYW+  +DFSEQ+     GY+ R+    +G  PFV+QN
Sbjct:   1 MSREINAGRHHFLYGGISGGGVHYWDNKDFSEQSLRLSFGYKNRSVTRSFGIVPFVEQNL  60

Query: 180 LGNNRYTANTGIVLDYSRRLNEKWRSTQSFQYGRKQYHDEYIAKRYNSKTISVSGTFSYY 239
            LG +RY   G    D+S+RL+E+WR T +     K Y ++ A RY+S         T Y
Sbjct:  61 LGGSRYNFVGGFNADFSQRLSERWRLTLNAGNMWKHYQEDRTAARYDSHMPLAGATLMYS 120

Query: 240 AMSAWQLYGGISGNFDNTVEKEQASBRYGVSLGTVKILDGGLGLKLGAGYTKRIFKAPAT 299
            A   W LYGG    + T E EQAS R G+ +G VK  DGGLGL+      YT+R+F AP T
Sbjct: 121 APKDWLLYGGADWSHNITKEAEQASIRKGLRVGAVKTFDGGLGLRANLRYTRRMFDAPGT 180

Query: 300 LIYNFTRRD                                                    308
            ++Y F R+D
Sbjct: 181 IVYRFPRKD                                                    189

>gb|AAD11779.1|(AF118122) putative outer membrane protein OmpU [Neisseria
meningitidis]
Length = 488
Score = 72.1 bits (176), Expect = 7e-12
Identities = 71/300 (23%), Positives = 128/300 (42%), Gaps = 17/300 (5%)

Query:   3 EAADLYRELLSERPDLVYPRFDLGVMLFEDKQYREALVQLHRAE-EVLPPDMRQLAREYI  61
             EA   YREL++ +PD   R L  LF+++Q   A  Q R + E LPP + +      Y
Sbjct: 136 EAISHYRELIAAQPDAPAVRMRLAAALFDNRQNEAAADQFDRLKAENLPPQLMEQVELYR 195

Query:  62 RQAEAVQAWHPSFNMNYEQTDNVNNASLSRDIVINGRKWIKSEDSLPKRANT--IRYELG 119
            +       AW +    +  + N+N A     +   KW      + PK+   + + Y LG
Sbjct: 196 KALRERDAWKVNGGFSVTREHNINQAPKRQQR----GLW-----TFPKQVDGTAVNYRLG 246

Query: 120 VDRMFNMAGNHFARLGISSGSGVHYWNARDFSEQAFHAEVGYRYRNSRLEWGFRPFVKQNR 179
            ++ +++   +    G   SG   Y    + F++       G  + + R + G    F ++
Sbjct: 247 AEKKWSLKNGWYTTAGGDVSGRVYPGNKKFNDMTAGVSGGIGFADRRKDAGLAVFHERRT 306

Query: 180 LGNNRYTANTGIVLDYSRRLNEKWRSTQSFQYGRKQYHDEYLAKRYNSKTISVSGTFSYY 239
              GN+ Y+   G L  ++R    KW++  S  ++GR +        R ++  +S +  +Y
Sbjct: 307 YGNDAYSYTNGARLYFNRWQTPKWQTLSSAEWGRLK---NTRRARSDNTHLQISNSLVFY 363

Query: 240 AMSAWQLYGGISGMFD-NTVEKEQASRRYGVSLGTVKILDG-GLGLKLGAGYTKRIFKAP 297
            +     GG+    + N ++        RYG+    +   G GL    G KR ++ P
Sbjct: 364 RNARQYWMGGLDFYRERNPADRGDNFNRYGLRFAWGQEWGGSGLSSLLRLGAAKRHYEKP 423
```

Based on this analysis, it was predicted that this protein from *N. gonorrhoeae*, and its epitopes, could be useful antigens for vaccines or diagnostics.

EXAMPLE 81

A DNA sequence was identified in *N. gonorrhoeae* <SEQ ID 161> which encodes amino acid sequence <SEQ ID 162; NGS81>. Analysis of this protein sequence reveals the following:

```
   GvH: Examining signal sequence (von Heijne)
       Signal Score (-7.5): -6.25
       Possible cleavage site: 15
   >>> Seems to have no N-terminal signal seq.
   Amino Acid Composition of Predicted Mature Form:
       calculated from 1
   ALOM: Finding transmembrane regions (Klein et al.)
       count: 0    value:  7.05 threshold:  0.0
       PERIPHERAL Likelihood =   7.05
       modified ALOM score: -1.91
   Rule: cytoplasmic protein
*** Reasoning Step: 2
----- Final Results -----
        bacterial cytoplasm --- Certainty= 0.232(Affirmative)
         < succ>
```

The protein has homology with the following sequences in the databases:

```
gi|10803654|ref|NP_046052.1|putative ISH4 transposase [Halobacterium sp.
NRC-1]
gi|7484109|pir||T08324 probable transposase H1306-Halobacterium sp.
(strain NRC-1) insertion sequence ISH4 plasmid pNRC100
gi|2822385|gb|AAC82891.1|(AF016485) putative ISH4 transposase
[Halobacterium sp. NRC-1]
gi|10580476|gb|AAG19350.1|(AE005029) Vng0918h [Halobacterium sp. NRC-1]
Length = 294
Score = 52.1 bits (124), Expect = 4e-06
Identities = 36/139 (25%), Positives = 63/139 (44%), Gaps = 7/139 (5%)

Query:   31 CPHCQSTHFVKNGKDCGNQRFLCRDCKKSFVEQTGTILYNTQKDIEVWEKYIHCMIE-KY   89
             CP C++    ++ G      QR+LC+DC ++F +QTGT+ ++    +  W   ++ I
Sbjct:   28 CPSCRAESVIRYGSYRVFQRYLCKDCDRTFNDQTGTVFEHSAVALRKWFLAVYTYIRLNT   87

Query:   90 PLRKCAEICKINLATAFTWRHKILDALQNMMNEVELDGIVQADETYSTISYKGHHKNFNL  149
             +R+      ++ T +   + L  AL       L+G V+ DE Y      KG  ++
Sbjct:   88 SIRQLDAEIDVSYKTVYRRVQRFLRALD--APRPHLEGPVEIDEFYVKAGLKGRERD---  142

Query:  150 PRPAHKRGTRATKRGISKE                                          168
             +P+  RG    RG   E
Sbjct:  143 -QPSRSRGLSTRGRGTYAE                                          160
```

Based on this analysis, it was predicted that this protein from *N. gonorrhoeae*, and its epitopes, could be useful antigens for vaccines or diagnostics.

EXAMPLE 82

A DNA sequence was identified in *N. gonorrhoeae* <SEQ ID 163> which encodes amino acid sequence <SEQ ID 164; NGS82>. Analysis of this protein sequence reveals the following:

GvH: Examining signal sequence (von Heijne)
   Signal Score (-7.5): -4.66
   Possible cleavage site: 57

>>> Seems to have no N-terminal signal seq.
Amino Acid Composition of Predicted Mature Form:
   calculated from 1
ALOM: Finding transmembrane regions (Klein et al.)
   count: 1   value: -0.85   threshold: 0.0
   INTEGRAL   Likelihood = -0.85 Transmembrane 76-92 (76-92)
   PERIPHERAL   Likelihood = 1.75
   modified ALOM score: 0.67
Rule: cytoplasmic membrane protein
\*\*\* Reasoning Step: 2
----- Final Results -----
   bacterial inner membrane --- Certainty= 0.134(Affirmative) < succ>

The protein has homology with the following sequences in the databases:

```
>gi|586070|sp|Q07605|T4BA_BACCO RESTRICTION ENZYME BGCI ALPHA SUBUNIT
[INCLUDES: ADENINE-SPECIFIC METHYLTRANSFERASE ACTIVITY]
gi|1075788|pir||A53125 restriction enzyme BcgI alpha chain-Bacillus
coagulans
gi|304140|gb|AAA16626.1|(L17341) restriction endonuclease alpha subunit
[Bacillus coagulans]
Length = 637
Score = 91.4 bits (226), Expect = 1e-17
Identities = 78/256 (30%), Positives = 123/256 (47%), Gaps = 42/256 (16%)

Query:    1 MFALAASNMILRGDGKANLHQSSCFMTDFQDLIKNPKPETGLKRPNVGFLNPPYAQSKSD   60
             +F  +A +NMILRGDGK+NL + +C    F + I N    G+    N  +NPPY+Q+K+D
Sbjct:  394 LFTIATTNMILRGDGKSNLIRDNCLT--FDNTIMN---GYGI---NKILMNPPYSQAKND  445

Query:   61 AELH--ELYFVKEMLKMLAEGGTGIAIIPVSCVIAPSK----AKSEIVKYHRLKAVMSMP  114
                  H   EL F+++ L+ML  GG    AI+P S ++    ++     K +I+K H L+ V+++
Sbjct:  446 QTQHLSELSFIQQALEMLVVGGKLCAIVPQSTMVGKNRHDKARKKQILKQHTLETVITLN  505

Query:  115 SELFYPVGTVTCIVVFEAHKPHFQTVVIDPDTQEEISTKKACENTWFGYWRDDGFEKTKH  174
             +  F+  VG  CIV+F+A H +                    ++ F    + DDG     KH
Sbjct:  506 KDTFHGVGVNPCIVIFKAGIKHPEN----------------KRVSFVNFEDDGHVVRKH  548

Query:  175 LGRIDLYDRWQGIKARWLEHYL-----NNEVHTGESVTAFVTDNDEWVAEAYLETDYSKI  229
             +G +              G +        EH L  + +     T    V   + DEW+       Y      D
Sbjct:  549 VGLVG-----DGTEKGKREHLLAVLAGDEDDGTDLIVKTAIKDTDEWLHSFYYFND-GIP  602

Query:  230 TRADFEQVVREFALFQ                                             245
              +   DF + V +    FQ
Sbjct:  603 SEDDFYKTVANYLTFQ                                             618
```

Based on this analysis, it was predicted that this protein from *N. gonorrhoeae*, and its epitopes, could be useful antigens for vaccines or diagnostics.

EXAMPLE 83

A DNA sequence was identified in *N. gonorrhoeae* <SEQ ID 165> which encodes amino acid sequence <SEQ ID 166; NGS83>. Analysis of this protein sequence reveals the following:

GvH: Examining signal sequence (von Heijne)
    Signal Score (−7.5): −8.04
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 1   value: −1.44   threshold: 0.0
    INTEGRAL   Likelihood = −1.44 Transmembrane 55–71 (55–71)
    PERIPHERAL   Likelihood = 4.03
    modified ALOM score: 0.79
Rule: cytoplasmic membrane protein
*** Reasoning Step: 2
----- Final Results -----
    bacterial inner membrane --- Certainty= 0.157
    (Affirmative) < succ>

Signal Score (−7.5): 3.15
    Possible cleavage site: 33
>>> Seems to have no N-terminal signal seq.
Amino Acid Composition of Predicted Mature Form:
    calculated from 1
ALOM: Finding transmembrane regions (Klein et al.)
    count: 0   value:   1.22 threshold:   0.0
    PERIPHERAL Likelihood =   1.22
    modified ALOM score: −0.74
Rule: cytoplasmic protein
*** Reasoning Step: 2
----- Final Results -----
    bacterial cytoplasm --- Certainty= 0.072(Affirmative) < succ>

The protein has homology with the following sequences in the databases:

The protein has homology with the following sequences in the databases:

```
>gi|586071|sp|Q07606|T4BB_BACCO RESTRICTION ENZYME BGCI BETA SUBUNIT
gi|1075789|pir||B53125 restriction enzyme BcgI beta chain-Bacillus
coagulans
gi|304141|gb|AAA16627.1|(L17341) restriction endonuclease beta subunit
[Bacillus coagulans]
Length = 341
Score = 44.0 bits (103), Expect = 0.002
Identities = 46/195 (23%), Positives = 79/195 (39%), Gaps = 23/195 (11%)

Query:    4 LQEIFDVSYGSKLDLNKMSSFNPTINFVGRSGKNNGVTASVDLLKNTKPYPAGLLTVALG   63
            + ++FDV  G  +D NK       ++R    NG    +D  K  KY    L   + +G
Sbjct:   12 ISDLFDVVIGKTIDGNKAQRNENGTPYITRKATRNGFEFMIDGEKE-KLYSGKLPVITIG   70

Query:   64 GSVLSTFLQNKPFYTAQNVAVLNPKTEMTEQQKLFYCAAIFANAYRFSACGREANRT-LR  122
              F+Q    F+T   V + PK ++      L Y   + NA +  +    N T L+
Sbjct:   71 NETSKPFVQEFHFFTGTKVNICIPKLDLNRNH-LLYITTMIENATKMFSYSYTINSTRLK  129

Query:  123 QL--FVPSLDEIPSW--------------VESVNLNPSAGVTEPKLKESLDLPVVRQSKR  166
            L   +P    E P W              ++ ++   + GV++  +    + L         +
Sbjct:  130 SLKILLPIKGEEPDWDYMNTYISKILSNMEKNFDVQQNDGVSDLRSLKDLSW----SQFK  185

Query:  167 LPEIFTIQNGIAATK                                               181
             +DEIF+I  +G+   TK
Sbjct:  186 MDEIFSINSGVRLTK                                               200
```

Based on this analysis, it was predicted that this protein from *N. gonorrhoeae*, and its epitopes, could be useful antigens for vaccines or diagnostics.

EXAMPLE 84

A DNA sequence was identified in *N. gonorrhoeae* <SEQ ID 167> which encodes amino acid sequence <SEQ ID 168; NGS84>. Analysis of this protein sequence reveals the following:

```
>gi|2495432|sp|P55409|Y4DJ_RHISN HYPOTHETICAL TRANSCRIPTIONAL REGULATOR
Y4DJ
gi|7465604|pir||T02773 y4dJ protein-Rhizobium sp. plasmid pNGR234a
gi|2182353|gb|AAB91639.1|(AE000069) Y4dJ [Rhizobium sp. NGR234]
Length = 77
```

```
                                -continued
Score = 44.4 bits (104), Expect = 7e-04
Identities = 25/61 (40%), Positives = 36/61 (58%)

Query:  92 KAGGETFVSLRKGFTQSELATAAGLPQPYLSRIENSKQSLQDKTVQKLANALGVSPLE    151
           K   G   F  LR +KG TQ E+    +G  Q YLS +E  +++     T+ +LA ALGVS +E
Sbjct:   5 KLVGSNFARLREEKGLTQEEEARSGFSQQYLSSLERGRRNPTVITLYELAQALGVSHVE    64

Query: 152 V                                                            152
           +
Sbjct:  65 L                                                             65
```

Based on this analysis, it was predicted that this protein from *N. gonorrhoeae*, and its epitopes, could be useful antigens for vaccines or diagnostics.

EXAMPLE 85

A DNA sequence was identified in *N. gonorrhoeae* <SEQ ID 169> which encodes amino acid sequence <SEQ ID 170; NGS85>. Analysis of this protein sequence reveals the following:

Signal Score (−7.5): −6.09
    Possible cleavage site: 15
>>> Seems to have no N-terminal signal seq.
Amino Acid Composition of Predicted Mature Form:
    calculated from 1
ALOM: Finding transmembrane regions (Klein et al.)
    count: 0   value:   2.92 threshold:   0.0
    PERIPHERAL Likelihood =  2.92
    modified ALOM score: −1.08
Rule: cytoplasmic protein

*** Reasoning Step: 2
----- Final Results -----
    bacterial cytoplasm --- Certainty= 0.480(Affirmative) < succ>

The protein has no homology with sequences in the databases.

Based on this analysis, it was predicted that this protein from *N. gonorrhoeae*, and its epitopes, could be useful antigens for vaccines or diagnostics.

EXAMPLE 86

A DNA sequence was identified in *N. gonorrhoeae* <SEQ ID 171> which encodes amino acid sequence <SEQ ID 172; NGS86>. Analysis of this protein sequence reveals the following:

Signal Score (−7.5): −2.92
    Possible cleavage site: 21
>>> Seems to have no N-terminal signal seq.
Amino Acid Composition of Predicted Mature Form:
    calculated from 1
ALOM: Finding transmembrane regions (Klein et al.)
    count: 1   value:   −2.76 threshold:   0.0
    INTEGRAL     Likelihood = −2.76 Transmembrane 179–195 (179–195)
    PERIPHERAL   Likelihood = 2.17
    modified ALOM score: 1.05
Rule: cytoplasmic membrane protein
*** Reasoning Step: 2
----- Final Results -----
    bacterial inner membrane --- Certainty= 0.210 (Affirmative) < succ>

The protein has homology with the following sequences in the databases:

```
>sp|Q05205|PPB_LYSEN ALKALINE PHOSPHATASE PRECURSOR (APASE)
pir||A42467 alkaline phosphatase (EC 3.1.3.1) phoA precursor-Lysobacter
enzymogenes
emb|CAA39978.1|(X56656) alkaline phosphatase [Lysobacter enzymogenes]
Length = 539
Score = 37.5 bits (86), Expect = 0.40
Identities = 28/82 (34%), Positives = 43/82 (52%), Gaps = 8/82 (9%)

Query: 189 VALGLQAYWDVAGANNGATGQSPNIKTAQVPAKITRRNADGTTDTFGGGSARKSAAASVS    248
              V  GL A W+V+ A              +   AQV +++ R+  GT D +  G+A    A AS  S
Sbjct: 458 VLRGLMA-WNVSSA------AGKTLTGAQVKLQVSDRST-GTYDLYRAGAAWTEANASYS    509

Query: 249 GIEAGKKVTAVIPAVRGAVAYA                                        270
           G+   G K+ +V+P+   GA + A
Sbjct: 510 GVSLGSKIGSVVPSATGAQSIA                                        531
```

Based on this analysis, it was predicted that this protein from *N. gonorrhoeae*, and its epitopes, could be useful antigens for vaccines or diagnostics.

EXAMPLE 87

A DNA sequence was identified in *N. gonorrhoeae* <SEQ ID 173> which encodes amino acid sequence <SEQ ID 174; NGS97>. Analysis of this protein sequence reveals the following:

Signal Score (−7.5): 0.18
    Possible cleavage site: 35
>>> Seems to have no N-terminal signal seq.
Amino Acid Composition of Predicted Mature Form:
    calculated from 1

-continued

```
ALOM: Finding transmembrane regions (Klein et al.)
    count: 0    value:    1.70 threshold:    0.0
    PERIPHERAL Likelihood =    1.70
    modified ALOM score: -0.84
Rule: cytoplasmic protein
*** Reasoning Step: 2
----- Final Results -----
        bacterial cytoplasm --- Certainty= 0.138(Affirmative) < succ>
```

The protein has homology with the following sequences in the databases:

```
>gi|12514207|gb|AAG55499.1|AE005289_17 (AE005289) unknown protein
encoded by cryptic prophage CP-933M [Escherichia coli O157:H7]
gi|12514720|gb|AAG55907.1|AE005324_10 (AE005324) unknown protein
encoded by prophage CP-933N [Escherichia coli O157:H7]
Length = 108
Score = 30.9 bits (69), Expect = 9.1
Identities = 21/55 (38%), Positives = 28/55 (50%), Gaps = 3/55 (5%)

Query:   1 MAAPVSLEEFKQRIGVEHDRRDDFFLSVIDGVSAAAEAYIGRSLLAADYVGRYDG       55
           M A ++LEE K  + V+HD  DD  +    +A   AYI S    D V R DG
Sbjct:   1 MTALLTLEEIKAHLRVDHDADDDMLMDKVRQATAVLLAYIQGS---RDKVIREDG    52
```

Based on this analysis, it was predicted that this protein from *N. gonorrhoeae*, and its epitopes, could be useful antigens for vaccines or diagnostics.

EXAMPLE 88

A DNA sequence was identified in *N. gonorrhoeae* <SEQ ID 175> which encodes amino acid sequence <SEQ ID 176; NGS88>. Analysis of this protein sequence reveals the following:

```
Signal Score (-7.5): -3.69
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 0    value:    6.05 threshold:    0.0
    PERIPHERAL Likelihood =    6.05
    modified ALOM score: -1.71
Rule: cytoplasmic protein
*** Reasoning Step: 2
----- Final Results -----
        bacterial cytoplasm --- Certainty= 0.227(Affirmative) < succ>
```

The protein has no homology with sequences in the databases.

Based on this analysis, it was predicted that this protein from *N. gonorrhoeae*, and its epitopes, could be useful antigens for vaccines or diagnostics.

EXAMPLE 89

A DNA sequence was identified in *N. gonorrhoeae* <SEQ ID 177> which encodes amino acid sequence <SEQ ID 178; NGS89>. Analysis of this protein sequence reveals the following:

```
Signal Score (-7.5): -4.77
    Possible cleavage site: 26
>>> Seems to have no N-terminal signal seq.
Amino Acid Composition of Predicted Mature Form:
    calculated from 1
ALOM: Finding transmembrane regions (Klein et al.)
    count: 0    value:    1.38 threshold:    0.0
    PERIPHERAL Likelihood =    1.38
    modified ALOM score: -0.78
Rule: cytoplasmic protein
*** Reasoning Step: 2
----- Final Results -----
        bacterial cytoplasm --- Certainty= 0.284(Affirmative) < succ>
```

The protein has homology with the following sequences in the databases:

```
>gi|9634142|ref|NP_037684.1|gp24 [Enterobacteria phage HK022]
gi|6863134|gb|AAF30375.1|AF069308_23 (AF069308) gp24 [Enterobacteria
phage HK022]
Length = 1183
Score = 44.9 bits (102), Expect = 0.006
Identities = 38/127 (29%), Positives = 64/127 (49%), Gaps = 11/127 (8%)

Query:  851 NKALRDKINLIDGNGAGSVNERVEAVRSTADGNAAAVQTHARSI---NG-LEAQYTVK--    904
            NKA  + +N    +    +   ++  + +T +GN +A+ T+A++I    NG L A Y +K
Sbjct:  989 NKASINSLNQTFSDYQQATATQINGITATVNGNTSAITTNAQAIANVNGDLSAMYNIKVG   1048

Query:  905 VDANGK--VAGFGLATTPKNGTPESKFIVNADRFGI-GAAGKADVFPFVVDTQKNRVGIN    961
            V +NG+      AG G+            +S+ I  ADRF +  AAG  +  PFV+ Q + I
Sbjct: 1049 VSSNGQYYAAGMGIGVENTPSGMQSQVIFLADRFAVTTAAGNSVALPFVI--QNGQTFIR   1106

Query:  962 GELVVNG    968
             + +G
Sbjct: 1107 ASFIQDG   1113
```

Based on this analysis, it was predicted that this protein from *N. gonorrhoeae*, and its epitopes, could be useful antigens for vaccines or diagnostics.

EXAMPLE 90

A DNA sequence was identified in *N. gonorrhoeae* <SEQ ID 179> which encodes amino acid sequence <SEQ ID 180; NGS90>. Analysis of this protein sequence reveals the following:

```
Signal Score (−7.5): −2.82
    Possible cleavage site: 24
>>> Seems to have no N-terminal signal seq.
Amino Acid Composition of Predicted Mature Form:
    calculated from 1
ALOM: Finding transmembrane regions (Klein et al.)
    count: 4   value:   −9.66 threshold:   0.0
    INTEGRAL    Likelihood = −9.66 Transmembrane 321–337
    (317–349)
    INTEGRAL    Likelihood = −6.48 Transmembrane 351–367
    (340–371)
    INTEGRAL    Likelihood = −5.73 Transmembrane 907–923
    (903–926)
    INTEGRAL    Likelihood = −0.00 Transmembrane 430–446
    (430–446)
    PERIPHERAL  Likelihood = 2.17
    modified ALOM score: 2.43
Rule: cytoplasmic membrane protein
*** Reasoning Step: 2
----- Final Results -----
        bacterial inner membrane --- Certainty= 0.486
        (Affirmative) < succ>
```

Based on this analysis, it was predicted that this protein from *N. gonorrhoeae*, and its epitopes, could be useful antigens for vaccines or diagnostics.

EXAMPLE 91

A DNA sequence was identified in *N. gonorrhoeae* <SEQ ID 181> which encodes amino acid sequence <SEQ ID 182; NGS91>. Analysis of this protein sequence reveals the following:

```
Signal Score (−7.5): −0.63
    Possible cleavage site: 36
>>> Seems to have no N-terminal signal seq.
Amino Acid Composition of Predicted Mature Form:
    calculated from 1
ALOM: Finding transmembrane regions (Klein et al.)
    count: 0   value:   0.16 threshold:   0.0
    PERIPHERAL Likelihood =  0.16
    modified ALOM score: −0.53
Rule: cytoplasmic protein
*** Reasoning Step: 2
----- Final Results -----
        bacterial cytoplasm --- Certainty= 0.250(Affirmative) < succ>
```

The protein has homology with the following sequences in the databases:

```
>gi|12514839|gb|AAG56002.1|AE005332_9 (AE005332) putative tail component
of prophage CP-933X [Escherichia coli O157:H7]
Length = 1026
Score = 111 bits (279), Expect = 3e-23
Identities = 78/274 (28%), Positives = 146/274 (52%), Gaps = 10/274 (3%)

Query:   69 AAGNQAQQASEKVRAEVGKIGSGLSGLTKLLAGLATADFAKSVLDTADAMQSINSQVRQV   128
            AA  + ++A  ++ +++ +I +    G+T   AG   A     ++ AD    S+N++++Q
Sbjct:   45 AAAREQRRALAELHSQLTEIRASAVGMTGAFAG---AFATGHLISLADEWSSVNARLKQA   101

Query:  129 TSSETEYLAVQQQLLDTANRTRASLESTANLYVSTSRALKDYGYTQQEILKFTEAANNAM   188
            + S   E+ + Q+ L+D + RT +     A L+  ++ ++++YGY+  ++LK TEA +  +
Sbjct:  102 SQSSDEFASSQKVLMDISQRTGTAFSDNAALFARSAASMREYGYSADDVLKVTEAISTGL   161

Query:  189 TIGGVGAQQQAAALMQLSQALGSGVLQGDEFKSISEAAPILLDTIAEYMGKSRDEIKKLG   248
             I G   +  + + + Q SQAL  GVL+G+EF S++E+   ++  +A  MG +R  ++K +
Sbjct:  162 KISGASTAEAGSVITQFSQALAQGVLRGEEFNSVNESGDRIVRALAAGMGVARKDLKAMA   221

Query:  249 SEGKLTADVIFKAISGASEKFGEQAAKMPVTMGQALTVFSNNWQSMVSKLLNDSGTMSGI   308
            +GKLTAD + A+            ++ A MP T+  ++T   N + + V         G  +
Sbjct:  222 DDGKLTADKVVPALISQLGILRDEYAAMPETVSSSITKVENAFMAWV-------GGANEA   274

Query:  309 AAVIKLIADNLNLVVPIVAGFAVAVAAAVAPTLA                             342
            + V K ++   LN V      +    A AV  A VA   +A
Sbjct:  275 SGVTKTLSGMLNGVAGQIDNVATAVGALVAVGVA                             308
```

```
(AF237934) putative integrase/recombinase [Pasteurella multocida]
Length = 329
Score = 449 (206.9 bits), Expect = 4.4e-91, Sum P(2) = 4.4e-91
Identities = 93/196 (47%), Positives = 129/196 (65%)
```

```
                                     -continued
Query:  56 IFADLIRRYLSEVTPSKRGAREESYRIGRALKTPLAKVRLADLRPQDFADWRDQRLQEVS  115
           IF D+I RY +EV+ +K+GAR E R+ R L+  ++  + + DLR +DF +W   RL EVS
Sbjct:  55 IFRDVIERYQNEVSITKKGARNEIIRLNRFLRYDISNLYIRDLRKEDFEEWIRIRLTEVS  114

Query: 116 PTSVGRELTTLSAVCEHAMKEWGLLRENPVRKISKPKKSRARTRRPTEQEIADICAALLY  175
               SV REL T+S+V   A+ +WG + +P+  I KPK S  R  R +EQ+I  I      Y
Sbjct: 115 DASVRRELVTISSVLTTAINKWGYISRHPMTGIEKPKNSAERKERYSEQDIKTILETARY  174

Query: 176 RPNEKPKMAVQRVAVAVLFAIETAMRAGEICGLKWADVNMRRRIAHLPITKNGDSRDVPL  235
           ++ P      QRVA+A+LFAIETAMRAGEI    +KW +V +  +RI HLP TKNG SRDVPL
Sbjct: 175 CEDKLPITLKQRVAIAMLFAIETAMRAGEIASIKWDNVFLEKRIVHLPTTKNGHSRDVPL  234

Query: 236 SLRAAELIEQLRGIDD                                             251
           S RA  LI +++ +++
Sbjct: 235 SQRAVALILKMKEVEN                                             250

Score = 248 (114.3 bits), Expect = 4.4e-91, Sum P(2) = 4.4e-91
Identities = 48/76 (63%), Positives = 57/76 (75%)

Query: 254 VFSLDAKSLDVLFRRARDNCGIQGLHFHDTRREALTRLSKKVPVEVLAKISGHRDLRILL  313
           VF   +SL   FR  +  CG++ LHFHDTRREALTRLSKKV V  LAKISGHRDLRIL
Sbjct: 254 VFQTTPESLSTTFRVLKKECGLEHLHFHDTRREALTRLSKKVDVMTLAKISGHRDLRILQ  313

Query: 314 NVYYRPDMADIAKMLD                                             329
           N YY P+M+++A +LD
Sbjct: 314 NTYYAPNMSEVANLLD                                             329
```

Based on this analysis, it was predicted that this protein from *N. gonorrhoeae*, and its epitopes, could be useful antigens for vaccines or diagnostics.

EXAMPLE 92

A DNA sequence was identified in *N. gonorrhoeae* <SEQ ID 183> which encodes amino acid sequence <SEQ ID 184; NGS92>. Analysis of this protein sequence reveals the following:

Signal Score (−7.5): −7.85
   Possible cleavage site: 25
>>> Seems to have an uncleavable N-term signal seq
Amino Acid Composition of Predicted Mature Form:
   calculated from 1
ALOM: Finding transmembrane regions (Klein et al.)
   count: 1  value: −8.33 threshold: 0.0
   INTEGRAL   Likelihood = −8.33 Transmembrane 6–22 (1–25)
   PERIPHERAL  Likelihood = 5.99
   modified ALOM score: 2.17
Rule: cytoplasmic membrane protein
*** Reasoning Step: 2
----- Final Results -----
bacterial inner membrane --- Certainty= 0.433
   (Affirmative) < succ>

The protein has homology with the following sequences in the databases:

```
>gi|963205|ref|NP_048840.1|A484L [Paramecium bursaria Chlorella virus 1]
gi|7461623|pir|T17986 hypothetical protein A484L-Chlorella virus PBCV-1
gi|1620155|gb|AAC96851.1|(U42580) A484L [Paramecium bursaria Chlorella
virus 1]
Length = 155
Score = 31.6 bits (70), Expect = 3.5
Identities = 20/72 (27%), Positives = 36/72 (49%)
Frame = +1

Query:  52 LQINLKMLEKRIDFLVENIDKYYQQYGSYPNNFDFISTKTDFTTESYCDFWDKNIAGYGN  231
            + +NLKM     I F     +DKY +QY +Y N  F  T+  +   ++ + +I      N
Sbjct:  23 IAVNLKMNGVSIPF----VDKYSKQYPTYTKNALFHVTRFNNAYQKTFEYKNISIDTINN   78

Query: 232 CYFVKNDKDYTI                                                267
            +  +++D   Y I
Sbjct:  79 LFSIRDDVLYNI                                                 90
```

Based on this analysis, it was predicted that this protein from *N. gonorrhoeae*, and its epitopes, could be useful antigens for vaccines or diagnostics.

EXAMPLE 93

A DNA sequence was identified in *N. gonorrhoeae* <SEQ ID 185> which encodes amino acid sequence <SEQ ID 186; NGS93>. Analysis of this protein sequence reveals the following:

GvH: Examining signal sequence (von Heijne)
   Signal Score (−7.5): −5.08
   Possible cleavage site: 14

-continued

>>> Seems to have no N-terminal signal seq.
Amino Acid Composition of Predicted Mature Form:
  calculated from 1
ALOM: Finding transmembrane regions (Klein et al.)
  count: 0   value: 0.79 threshold: 0.0
  PERIPHERAL Likelihood = 0.79
  modified ALOM score: −0.66

-continued

Rule: cytoplasmic protein
*** Reasoning Step: 2
----- Final Results -----
  bacterial cytoplasm --- Certainty= 0.320(Affirmative) < succ>

The protein has homology with the following sequences in the databases:

```
>gb|AAG22017.1|AF288038_2 (AF288038) putative HsdR ]Streptococcus
thermophilus]
Length = 740
Score = 674 bits (1738), Expect = 0.0
Identities = 364/746 (48%), Positives = 489/746 (64%), Gaps = 40/746 (5%)

Query:  14 NENSRVKIPAVLHLMRLGYDYLSLKNANW---DRQTNIFPEIFVDSLCRINPDLPPDDAR   70
              +E +RV+IPA  HLMRLGY YL       D +TNI  IF +   + N        D
Sbjct:   8 SELTRVQIPAAFHLMRLGYTYLPHNGKEIMGRDPETNILISIFREQFLKFNNYATDLVE   67

Query:  71 RLLADIRLELDNEDLGQKFYERLTNQSGGKKLIDFQNFDNNSFHVVTELPCINGDEAFRP  130
              R L +I++ELD DLG+ FY R+ + SG     +D++N +NN+FH+  E+ C NG + FRP
Sbjct:  68 RELNNIKIELDQNDLGRAFYNRIVSDSG-PTYVDWENPENNTFHLALEVTCQNGGDEFRP  126

Query: 131 DIALLVNGMPLVFIEVKKPN----NKGGIGEERERMGKRAKNPKFRRFINITQFMIFSNN  186
              DI + +NG+PL +IEVK+PN     K  I  E+ R   R +N +FRRF NITQ + FS+N
Sbjct: 127 DIVIFINGLPLSYIEVKQPNAIRDGKTAIQSEQSRTAVRFENRRFRRFNNITQLISFSDN  186

Query: 187 MEYDDGATEPAQGAFYASSACGKPVFNYFREEHKXXXXXXXXXXXXXXXXXXVLQDNNLPV  246
              + Y  G +   QG+FY S+A  K  FN F+EE +                    VL+D N
Sbjct: 187 LPYISGQGQQKQGSFYCSNAFSKTKFNAFKEEREEELIYSIRSLGEEEIDAVLKDVNRFA  246

Query: 247 IKHSPEFISNKSPDTPTNRILTSLLCRERLSFLLQHGLTYVK--ASQGLVQ--KHIMRYP  302
              +K  PEF +N+ P TP N  ++L  ++RL FLL++GL YV+  +   G +Q    KH+MRYP
Sbjct: 247 LKSQPEFKTNQDPSTPCNTFISSLYQKKRLLFLLRYGLAYVEEHSKDGTIQLQKHVMRYP  306

Query: 303 QLFATLAIEKHLANGGKKGVIWHTQGSGKTALAYYNTRYLTHYYAKQGIVPKFYFIVDRL  362
              Q FAT AIE  +   G +KGVIWHTQGSGKTAL+Y+N  RYLT+Y++KQGIVP+FYF+VDRL
Sbjct: 307 QFFATKAIEDAIGKGVRKGVIWHTQGSGKTALSYFNIRYLTNYFSKQGIVPQFYFVVDRL  366

Query: 363 DLLKQAQREFTARDLVVHTIDSREAFAADIKSAQTLHNHAGKAEITVVNIQKFQDDPDVV  422
              DL QA REFT R L V  I+S         Q L+      ++ VVNIQKF+D+ D+
Sbjct: 367 DLADQATREFTKRGLKVKRINS----------PQELNEKHDAYQVAVVNIQKFKDNSDLT  416

Query: 423 ARNDYDLAIQRVYFLDEVHRSYNPKGSFLANLNQSDVNAVKIGLTGTPLI-----GVTA-  476
              + YDL  Q +YF+DE HRSYN KGS+L NL +D NA+KI LTGTPLI     G T
Sbjct: 417 DHSGYDLNRQNIYFIDEAHRSYNEKGSYLPNLYNADKNAIKIALTGTPLITYKKDGKTKE  476

Query: 477 GNVNTRELFGDYIHKYYYNASIADGYTLRLIREEIGSRYKAQLQEALAQLEIEKGSFDRK  536
              +    TR++FGDYIHKYYYN SI DG+TLRL+RE+I + YK  LQ       EI +G   +
Sbjct: 477 SHATTRDIFGDYIHKYYYNQSIDDGFTLRLMREDIETSYKETLQTI--NEEILRGDLSKD  534

Query: 537 EIYAHPHFVHPMLDYILDDFAKFRKTN-QDESLGAMVVCDSAEQARQL---FEHFQTASD  592
              +I+AHP +V PMLG+IL+DF + R    D+S+G M+VCDS++QAR++      E ++  +
Sbjct: 535 DIFAHPRYVSPMLDFILEDFNRARDVVFDDDSIGGMIVCDSSKQAREIEKQLEERRSGE   594

Query: 593 HNFTAALILHDVGTKEERDQWVKDFKAGKIDILFVYNMLLTGFDAPRLKKLYLGRLIKAH  652
              +N T+ALILHD G KE +      V+ ++ GKID++ VY+MLLTGFDAPRLK+LYLGR IKAH
Sbjct: 595 TNITSALILHDEGDKEYKKDRVESYREGKIDLVIVYSMLLTGFDAPRLKRLYLGRKIKAH  654

Query: 653 NLLQTLTRVNRTYKSYRYGYVVDFADIEREFDKTNRAYWDELSEN-----LGDEIGS-YS  706
              NLLQTLTRVNR YK Y++GYV+DFADI +EFDKTNRAY +EL+ E        G+++ + +
Sbjct: 655 NLLQTLTRVNRPYKDYQFGYVIDFADISKEFDKTNRAYLEELNQEYDPKNTGEDVENVFG  714

Query: 707 QLFKTAEEIEQEIADIKNALFDFDTE                                  732
              LF +A+EI +++    + L ++ TE
Sbjct: 715 SLFVSADEISKQLEKSETILMNPTE                                   740
```

Based on this analysis, it was predicted that this protein from *N. gonorrhoeae*, and its epitopes, could be useful antigens for vaccines or diagnostics.

EXAMPLE 94

A DNA sequence was identified in *N. gonorrhoeae* <SEQ ID 187> which encodes amino acid sequence <SEQ ID 188; NGS94>. Analysis of this protein sequence reveals the following:

```
Signal Score (-7.5): -3.19
    Possible cleavage site: 35
>>> Seems to have no N-terminal signal seq.
Amino Acid Composition of Predicted Mature Form:
    calculated from 1
ALOM: Finding transmembrane regions (Klein et al.)
    count: 0    value:    5.73 threshold:    0.0
    PERIPHERAL Likelihood =    5.73
    modified ALOM score: -1.65
Rule: cytoplasmic protein
*** Reasoning Step: 2
----- Final Results -----
        bacterial cytoplasm --- Certainty= 0.302(Affirmative) < succ>
```

The protein has homology with the following sequences in the databases:

```
GvH: Examining signal sequence (von Heijne)
    Signal Score (-7.5): -6.12
    Possible cleavage site: 19
>>> Seems to have an uncleavable N-term signal seq
Amino Acid Composition of Predicted Mature Form:
    calculated from 1
ALOM: Finding transmembrane regions (Klein et al.)
    count: 3    value:   -10.51 threshold:    0.0
    INTEGRAL    Likelihood = -10.51 Transmembrane 112-128
    (109-132)
    INTEGRAL    Likelihood =  -4.46 Transmembrane 50-66 (46-70)
    INTEGRAL    Likelihood =  -2.23 Transmembrane 7-23 (7-23)
    PERIPHERAL  Likelihood =   4.19
    modified ALOM score: 2.60
Rule: cytoplasmic membrane protein
*** Reasoning Step: 2
----- Final Results -----
        bacterial inner membrane --- Certainty= 0.520
        (Affirmative) < succ>
```

The protein has homology with the following sequences in the databases:

```
>gi|10717100|gb|AAG22014.1|AF288037_3 (AF288037) putative HsdS
[Streptococcus thermophilus]
Length = 402
Score = 154 bits (389), Expect = 2e-36
Identities = 123/348 (35%), Positives = 168/348 (47%), Gaps = 48/348 (13%)

Query:  73 GKTAFVDILDDGEVAFGSTEFIVLRAKNET--NPEFLYYFAISPDFRKRAIECMEGTSGR  130
           GKT     ++ DGE ++      IV    +E+    +FLYYF  + F         G++  +
Sbjct:  74 GKT----VIFDGEDSYFQDSNIVWIENDESKVTNQFLYYFLQTNPFIT-----TNGSTIK  124

Query: 131 QRVNENALKTLELPIPEPQIQQSIAAVLSALDKKIALNKQINARLEEMAKTLYDYWFVQF  190
             + N+N    T   +P  Q Q   I   +L  LDKKI +N QIN  LE  MAKTLYDYWFVQF
Sbjct: 125 RLYNDNLRDTKIPNVPSIQQQNQITDILGTLDKKIQINNQINQELEAMAKTLYDYWFVQF  184

Query: 191 DFPDANGKPYKSSGGDMVFDETLKREIPKGWGSIELQSCL---AKIPNTTKILNKDIKDF  247
           DFPD NGKPYKSSGG MV++   LKREIP+GWG+ +L S L     + N  K  N++ K +
Sbjct: 185 DFPDQNGKPYKSSGGKMVYNPELKREIPEGWGAEKLSSLLKIGKETTNPKKFPNEEFKYY  244

Query: 248 --------GKYPVVD----QSQDFICGFTNKEKSILNPQDAHIIFGDHTRIVKLVNFQYA  295
                   G Y +      +S  F   +  S LNP    +I+       +      F
Sbjct: 245 SIPEFDTTGTYSLERGESIKSNKFK-                                   301
           FKVEKNDLLVSKLNPWFNRVIYNLEENAIASTEF---

Query: 296 RGADGTQVILSNNERMPNYLFYQIINQIDLSSY------GYARHFK-----FLKEFKIIL  344
                ++     R     YQ+   +  Y       G +   K       + F+I
Sbjct: 302 -------IVWKTFNRFEKNFLYQVATGKEFIEYCTRFATGTSNSHKRVSPDIMVGFQIPF  354

Query: 345 PSKDISQKYNEIANTFFVKVRNNLKQNHHLTQLRDFLLPMLMNGQVSV              392
           I QK+ EI ++   +V  N +QN  LTQLRD++LPMLMNGQV V
Sbjct: 355 EKTHI-QKFGEIIDSIRTQVLQNNEQNQELTQLRDWILPMLMNGQVKV              401
```

Based on this analysis, it was predicted that this protein from *N. gonorrhoeae*, and its epitopes, could be useful antigens for vaccines or diagnostics.

EXAMPLE 95

A DNA sequence was identified in *N. gonorrhoeae* <SEQ ID 189> which encodes amino acid sequence <SEQ ID 190; NGS95>. Analysis of this protein sequence reveals the following:

```
>pir||G69096 hypothetical protein MTH1717-Methanobacterium
thermoautotrophicum (strain Delta H)
gb|AAB86189.1|(AE000928) unknown [Methanothermobacter thermautotrophicus]
Length = 557
Score = 35.4 bits (80), Expect = 0.50
Identities = 25/80 (31%), Positives = 47/80 (58%), Gaps = 5/80 (6%)

Query:   52 LLFYFLIPFIATATVLWLSKYLGKDEFKQGEVKELEYVNDNFLPSYLGYFFVALSIPDNN  111
             L+F+F+ P +  TATVL + K +  ++ F++ EV  L   + +PS++     ++ IP++
Sbjct:   92 LVFFFISPLLGTATVLVIYK-VARETFEREEVALLSAFLFSMVPSFVAR--TSVFIPESM 148

Query:  112 LFLLFVMYGIIFLLVSCSKS                                         131
             LL    GI+++LV     K+
Sbjct:  149 GLLL--TSGILYMLVKYLKT                                         166
```

Based on this analysis, it was predicted that this protein from *N. gonorrhoeae*, and its epitopes, could be useful antigens for vaccines or diagnostics.

EXAMPLE 96

A DNA sequence was identified in *N. gonorrhoeae* <SEQ ID 191> which encodes amino acid sequence <SEQ ID 192; NGS96>. Analysis of this protein sequence reveals the following:

```
GyH: Examining signal sequence (von Heijne)
    Signal Score (-7.5): -7.76
    Possible cleavage site: 28
>>> Seems to have no N-terminal signal seq.
Amino Acid Composition of Predicted Mature Form:
    calculated from 1
ALOM: Finding transmembrane regions (Klein et al.)
    count: 0   value:  6.15 threshold:  0.0
    PERIPHERAL Likelihood = 6.15
    modified ALOM score: -1.73
Rule: cytoplasmic protein
*** Reasoning Step: 2
----- Final Results -----
        bacterial cytoplasm --- Certainty= 0.362(Affirmative) < succ>
```

The protein has no homology with sequences in the databases.

Based on this analysis, it was predicted that this protein from *N. gonorrhoeae*, and its epitopes, could be useful antigens for vaccines or diagnostics.

EXAMPLE 97

A DNA sequence was identified in *N. gonorrhoeae* <SEQ ID 193> which encodes amino acid sequence <SEQ ID 194; NGS97>. Analysis of this protein sequence reveals the following:

```
GvH: Examining signal sequence (von Heijne)
    Signal Score (-7.5): -0.48
    Possible cleavage site: 13
>>> Seems to have no N-terminal signal seq.
Amino Acid Composition of Predicted Mature Form:
    calculated from 1
ALOM: Finding transmembrane regions (Klein et al.)
    count: 0   value:  8.86 threshold:  0.0
    PERIPHERAL Likelihood = 8.86
    modified ALOM score: -2.27
Rule: cytoplasmic protein
*** Reasoning Step: 2
----- Final Results -----
        bacterial cytoplasm --- Certainty= 0.127(Affirmative) < succ>
```

The protein has homology with the following sequences in the databases:

```
>ref|NP_052265.1|P2 J homolog; baseplate or base of tail fibre
[Enterobacteria phage 186]
gb|AAC34162.1|(U32222) P2 J homolog; baseplate or base of tail fibre
[Enterobacteria phage 186]
Length = 302
Score = 112 bits (280), Expect = 3e-24
Identities = 65/151 (43%), Positives = 85/151 (56%), Gaps = 1/151 (0%)

Query:    1 MGNSRLSQLPAPAAIEETDFEGIFARKKAALTALCPESIRETVAQTLELESEPLTIDLQQ   60
            M    LS LP P  +EE DFE I A + A L +L PE  +E VA+TL LESEP+    LQ+
Sbjct:    1 MATVDLSLLPVPDVVEELDFETILAERIATLISLYPEDQQEAVARTLALESEPIVKLLQE  60

Query:   61 QAYQELLVRNRINEAVKANLLAYAQGSDLDHIAAQYGLSRKTIRXXXXXXXXXXXXXEYET  120
            AY+E++ R R+NEA +A +LAYA+ SDLD++ A + + R  +R               E E
Sbjct:   61 NAYREVIWRQRVNEAARAGMLAYARDSDLDNLGANFNVERLVVRPADDTTIPPTPAEMEL  120

Query:  121 DDAFRARV-QAHPEKYAAGPRTAYEAHAIDA                              150
            D  FR R+ QA      AG    AYE H   A
Sbjct:  121 DADFRLRIQQAFEGMSVAGSTGAYEFHGRSA                              151
```

Based on this analysis, it was predicted that this protein from *N. gonorrhoeae*, and its epitopes, could be useful antigens for vaccines or diagnostics.

EXAMPLE 98

A DNA sequence was identified in *N. gonorrhoeae* <SEQ ID 195> which encodes amino acid sequence <SEQ ID 196; NGS98>. Analysis of this protein sequence reveals the following:

```
>gi|10172952|dbj|BAB04058.1|(AP001508) BH0339-unknown conserved protein
in others [Bacillus halodurans]
Length = 283
Score = 83.7 bits (206), Expect = 1e-15
Identities = 59/156 (37%), Positives = 87/156 (54%), Gaps = 8/156 (5%)

Query:   10 VRGPVQLAFAQSIDPIVPPEVSITRMAVTNEKDLEKERTMGRKYIVPYVVYRVHGFISAN    69
              VRGPV + A SIDPI       IT+   +   D     TMG K+ V + VY    G I+
Sbjct:  129 VRGPVSIHTATSIDPIDIVSTQITKSVNSVTGDKRSSDTMGMKHRVDFGVYVFKGSINTQ   188

Query:   70 LAAKTGFSDDDLAKLWQALTLMFEHDRSAAR--GEMARKLVFKHDSALGSQPAHKLFD    127
              LA KTGF+++D  K+ +AL +FE+D S+AR  G M    K+  ++H S LG    + K+
Sbjct:  189 LAEKTGFTNEDAEKIKRALITLFENDSSSARPDGSMEVHKVYWWEHSSKLGQYSSAKVHR   248

Query:  128 AVKVERVNGESGTPASGFGDYKISVVSDGLNGVSVE                           163
              ++K+E    ++ TP S F DY + +    L+G+ VE
Sbjct:  249 SLKIE---SKTDTPKS-FDDYAVELYE--LDGLGVE                           278
```

Signal Score (−7.5): −3.68
    Possible cleavage site: 33
>>> Seems to have no N-terminal signal seq.
Amino Acid Composition of Predicted Mature Form:
    calculated from 1
ALOM: Finding transmembrane regions (Klein et al.)
    count: 0  value: 4.61  threshold: 0.0
    PERIPHERAL  Likelihood = 4.61
    modified ALOM score: −1.42
Rule: cytoplasmic protein
\*\*\* Reasoning Step: 2
----- Final Results -----
    bacterial cytoplasm --- Certainty= 0.182(Affirmative) < succ>

The protein has no homology with sequences in the databases.

Based on this analysis, it was predicted that this protein from *N. gonorrhoeae*, and its epitopes, could be useful antigens for vaccines or diagnostics.

EXAMPLE 99

A DNA sequence was identified in *N. gonorrhoeae* <SEQ ID 197> which encodes amino acid sequence <SEQ ID 198; NGS99>. Analysis of this protein sequence reveals the following:

Signal Score (−7.5): −4.87
    Possible cleavage site: 19
>>> Seems to have no N-terminal signal seq.
Amino Acid Composition of Predicted Mature Form:
    calculated from 1
ALOM: Finding transmembrane regions (Klein et al.)
    count: 0  value: 4.93  threshold: 0.0
    PERIPHERAL  Likelihood = 4.93
    modified ALOM score: −1.49
Rule: cytoplasmic protein
\*\*\* Reasoning Step: 2
----- Final Results -----
    bacterial cytoplasm --- Certainty= 0.189(Affirmative) < succ>

The protein has homology with the following sequences in the databases:

Based on this analysis, it was predicted that this protein from *N. gonorrhoeae*, and its epitopes, could be useful antigens for vaccines or diagnostics.

EXAMPLE 100

A DNA sequence was identified in *N. gonorrhoeae* <SEQ ID 199> which encodes amino acid sequence <SEQ ID 200; NGS100>. Analysis of this protein sequence reveals the following:

Signal Score (−7.5): −3.03
    Possible cleavage site: 18
>>> Seems to have no N-terminal signal seq.
Amino Acid Composition of Predicted Mature Form:
    calculated from 1
ALOM: Finding transmembrane regions (Klein et al.)
    count: 0  value: 6.63  threshold: 0.0
    PERIPHERAL  Likelihood = 6.63
    modified ALOM score: −1.83
Rule: cytoplasmic protein
\*\*\* Reasoning Step: 2
----- Final Results -----
    bacterial cytoplasm --- Certainty= 0.185(Affirmative) < succ>

The protein has homology with the following sequences in the databases:

```
>gi|1175791|sp|P44189|YE18_HAEIN HYPOTHETICAL PROTEIN HI1418
gi|1074769|pir||A64029 hypothetical protein HI1418-Haemophilus influenzae
(strain Rd KW20)
gi|1574254|gb|AAC23068.1|(U32821) H. influenzae predicted coding region
HI1418 [Haemophilus influenzae Rd]
Length = 201
Score = 144 bits (364), Expect = 1e-33
Identities = 71/109 (65%), Positives = 79/109 (72%)

Query:  8 NFQQNSVRTVADNKGELWFLANDVCEILGYTNPRRTVDLHCKSRGVTKRYTPTTSGEQEM   67
          NF+    VR + D KGE WF   DVC ILGYTN R+ +  HCK  GVTKRYTPT S +QEM
Sbjct: 24 NFKDLPVRVILDPKGEFWFCGTDVCHILGYTNSRKALQDHCKQGGVTKRYTPTKSADQEM   83

Query: 68 TYINEPNLYRLIIKSRKPAAEAFEEWVMETVLPAIRKTGGCQVGPKTTA             116
          T+INEPNLYRLIIKSRKP AE FE WV E VLP IRKTG  Q+ P+  A
Sbjct: 84 TFINEPNLYRLIIKSEKPEAEPFEAWVFEEVLPQIRKTGKYQLQPQQLA             132
```

Based on this analysis, it was predicted that this protein from *N. gonorrhoeae*, and its epitopes, could be useful antigens for vaccines or diagnostics.

EXAMPLE 101

A DNA sequence was identified in *N. gonorrhoeae* <SEQ ID 201> which encodes amino acid sequence <SEQ ID 202; NGS101>. Analysis of this protein sequence reveals the following:

Signal Score (−7.5): −1.23
    Possible cleavage site: 47
>>> Seems to have no N-terminal signal seq.

Amino Acid Composition of Predicted Mature Form:
    calculated from 1
ALOM: Finding transmembrane regions (Klein et al.)
    count: 0   value: 3.55  threshold: 0.0
    PERIPHERAL   Likelihood = 3.55
    modified ALOM score: −1.21
Rule: cytoplasmic protein
*** Reasoning Step: 2
----- Final Results -----
    bacterial cytoplasm --- Certainty= 0.126(Affirmative) < succ>

The protein has homology with the following sequences in the databases:

```
>gi|9632520|ref|NP_049514.1|hypothetical protein [Bacteriophage 933W]
gi|9633449|ref|NP_050552.1|hypothetical protein [Bacteriophage VT2-Sa]
gi|4585431|gb|AAD25459.1|AF125520_54 (AF125520) hypothetical protein
[Bacteriophage 933W]
gi|5881645|dbj|BAA84336.1|(AP000363) hypothetical protein [Bacteriophage
VT2-Sa]
gi|7649882|dbj|BAA94160.1|(AP000422) hypothetical protein [Escherichia
coli O157:H7]
Length = 404
Score = 177 bits (449), Expect = 3e-43
Identities = 130/425 (30%), Positives = 204/425 (47%), Gaps = 27/425 (6%)

Query:   7 TAYGDPQAMMKQAAGLFAMHMQRNSTLNRLAGKMPAGTA-GAEATLRKQTTQHMPVVRCQ    65
           T     QA    LF +   S +N L  + A  A   +   KQT+    PVVR
Sbjct:   2 TTVTSAQANKLYQVALFTAANRNRSMVNILTEQQEAPKAVSPDKKSTKQTSAGAPVVRIT    61

Query:  66 DLTRGMGDEIRFNLVNPVSALPIMGDNTAEGRGVGMSLSEAGLRVNQARFPVDGGGTMTN   125
           DL +  GDE+ F++++ +S  P MGD    EGRG +S ++  L++NQ R  VD GG M+
Sbjct:  62 DLNKQAGDEVTFSIMHKLSKRPTMGDERVEGRGEDLSHADFSLKINQGRHLVDAGGRMSQ   121

Query: 126 QRSPADYRALIRPAAQSLMDRYADQTLLVHMAGARGFHDNIEWGVPLAGDPKFNDYAVNP   185
           QR+  +   +  R   +  + +    DQ +VH+AGARG      +P A  P+F    +N
Sbjct: 122 QRTKFNLASSARTLLGTYFNDLQDQCAIVHLAGARGDFVADDTILPTAEHPEFKKIMIND   181

Query: 186 VKAPSKNRHFTASGDAVTGVGDNGGELKIASTDLFTMDTVDSMRTVLDQIPLPPPIVKFE   245
           V  P+ +RHF       GD    +I + D+F++   VD++   +D++    P   V+
Sbjct: 182 VLPPTHDRHFFG--------GDATSFEQIEAADIFSIGLVDNLSLFIDEMAHPLQPVRLS   233

Query: 246 GDKAAGDSPLRVWLLSPAQYNRF---AADPKFRQLQASAIARASQANQNPLFLGDAGLWN   302
           GD+  G+ P V  ++P Q+N +        + Q+   A+ RA    N +PLF G+  +W
Sbjct: 234 GDELHGEDPYYVLYVTPRQWNDYTSTSGKDWNQMMVRAVNRAKGFN-HPLFKGECAMWR   292

Query: 303 GFILVKMP-RPIRFYAGDEMKYCADKFSEAESGLKIPASFADKFAVDRSVILGGQAVLEA   361
           ++ K     PIRFY G ++  +        A   +DR++++LG QA+  A
Sbjct: 293 NILVRKYAGMPIRFYQGSKVLVSENNLTATTK------EVAAATNIDRAMLLGAQALANA   346

Query: 362 FANTGKHGGMPFFWSEKELDHGNRVETLVGTIRGVAKTRFAVDVGGGAKEITDYGVTVVD   421
           +    G+     G  F       EK+ D  NR E    +  I G+ K RF       G      ++ D+GV   VD
Sbjct: 347 Y---GQKAGGHFNMVEKKTDMDNRTEIAISWINGLKKIRFPEKSG----KMQDHGVIAVD   399

Query: 422 TVVPL                                                         426
           T V L
Sbjct: 400 TAVKL                                                         404
```

Based on this analysis, it was predicted that this protein from *N. gonorrhoeae*, and its epitopes, could be useful antigens for vaccines or diagnostics.

EXAMPLE 102

A DNA sequence was identified in *N. gonorrhoeae* <SEQ ID 203> which encodes amino acid sequence <SEQ ID 204; NGS 102>. Analysis of this protein sequence reveals the following:

```
Signal Score (-7.5): -6.09
    Possible cleavage site: 15
>>> Seems to have no N-terminal signal seq.
Amino Acid Composition of Predicted Mature Form:
    calculated from 1
ALOM: Finding transmembrane regions (Klein et al.)
    count: 0   value:  2.92  threshold: 0.0
    PERIPHERAL   Likelihood =  2.92
    modified ALOM score:  -1.08
Rule: cytoplasmic protein
*** Reasoning Step: 2
----- Final Results -----
    bacterial cytoplasm --- Certainty= 0.480(Affirmative) < succ
```

The protein has no homology with sequences in the databases.

Based on this analysis, it was predicted that this protein from *N. gonorrhoeae*, and its epitopes, could be useful antigens for vaccines or diagnostics.

EXAMPLE 103

A DNA sequence was identified in *N. gonorrhoeae* <SEQ ID 205> which encodes amino acid sequence <SEQ ID 206; NGS 103>. Analysis of this protein sequence reveals the following:

```
Signal Score (-7.5): -1.29
    Possible cleavage site: 34
>>> Seems to have no N-terminal signal seq.
Amino Acid Composition of Predicted Mature Form:
    calculated from 1
ALOM: Finding transmembrane regions (Klein et al.)
    count: 1   value:  -0.00  threshold: 0.0
    INTEGRAL    Likelihood = -0.00   Transmembrane
    22-38 (22-38)
    PERIPHERAL   Likelihood = 4.88
    modified ALOM score:  0.50
Rule: cytoplasmic membrane protein
*** Reasoning Step: 2
----- Final Results -----
    bacterial inner membrane --- Certainty=
    0.100(Affirmative) < succ>
```

The protein has homology with the following sequences in the databases:

```
>gi|11277848|pir||E81145 replicative DNA helicase NMB0885 [imported]-Neisseria
meningitidis (group B strain MD58)
gi|7226124|gb|AAF41296.1|(AE002441) replicative DNA helicase [Neisseria
meningitidis MC58]
Length = 468
Score = 233 bits (594), Expect = 5e-60
Identities = 158/456 (34%), Positives = 245/456 (53%), Gaps = 34/456 (7%)

Query:   15 SVGAEQNILGGILIEPTAIARCA-ILTPEKFYQAQHRIIFRALLDMAAANEPIDIITLND   73
            S+ AEQ++LGG+++E A  R A +++ E FY+ +HR+IFR++  +   + P D+IT+ +
Sbjct:   23 SMEAEQSVLGGLMLENPAWDRIADVVSGEDFYRHEHRLIFRSIAKLINESRPADVITVQE   82

Query:   74 KLEARGEAENAGGLAYLIDLNQNTPSAKNISRYVGIVNDRFVERGLLKASAAIEKIAVSK  133
            L+   E E AGG  YLI L QNTPSA NI RY  IV +R + R L +    I + A +
Sbjct:   83 DLQRNEELEAAGGFEYLITLAWNTPSAANIRRYAEIVRERSIMRQLAEVGTEIARSAYNP  142

Query:  134 DGGTVAEKLSKAADELAAVGKDAVKRETKTFGQTVEDLIGGLDKRLDGVR--------FG  185
            G   + L +A +++  + + K  +K   + DL+ +  +R+D +        G
Sbjct:  143 QGRDAGQLLDEAENKVFQIAESTAK--SKQGFLEMPDLLKEVVQRIDMLYSRDNPDEVTG  200

Query:  186 LPTGLMKLDGMTGGLPDGNLIVIAARPSMGKTVLAENIARFALKQGK-AVHFQSYEMSAV  244
            +PTG + LD  T GL  G+LI++A RPSMGKT + NIA    +G+  V    S EM
Sbjct:  201 VPTGFIDLDKKTSGLQPGDLIIVAGRPSMGKTAFSINIAEHVAVEGRLPVAVFSMEMGGA  260

Query:  245 ELARRGMAAECNIPMQNLKTGNLTQSDYANM---------PIYVSQAKEWKFDVNCDLL  294
            +L  R + +    +    LKTG L  +         P+Y+ +
Sbjct:  261 QLVMRMLGSVGRLDQSVLKTGRLEDEHWGRLNEAVVKLSDAPVYIDETPGLTALELRARA  320

Query:  295 NVDELCFLAKEKKLTTGLDLLVVDHLHIMPRAGRDE--VAELGNISRRLKNLAAELNTPV  352
                 F  K       L L+V+D+L +M  +GR +    +ELG ISR LK LA EL P+
Sbjct:  321 RRLARQFNNK------LGLIVIDYLQLMAGSGRSDNRASELGEISRSLKALAKELQVPI  373

Query:  353 VLVAQLNRGNTKQADKRPNMADIRGSGAIEQDANIIMPHRESYYDGNENP--SIAELII  410
            + ++QL+R   +  DKRP M+D+R SGAIEQDA++I+  +R+ YY+  ++P   +AE II
Sbjct:  374 IALSQLSRTVESRTDKRPMMSDLRESGAIEQDADLIMFLMYRDEYYN-QDSPMKGLAECII  432

Query:  411 AKNRDGEMGTVVCGWKGQFMKFEEEPDLAWQAPKHD                          446
            K+R+G +G +   W GQF KF+   + +A  D
Sbjct:  433 GKHRNGPVGKIFLTWTGQFTKFDNAAYIPEEAKIED                          468

>gi|11277846|pir||E81876 probable replicative DNA helicase (EC 3.6.1.-)
NMA1105
[imported]- Neisseria meningitidis (group A strain Z2491)
gi|7379799|emb|CAB84367.1|(AL162755) putative replicative DNA helicase
```

```
[Neisseria meningitidis Z2491]
Length = 468
Score = 230 bits (588), Expect = 2e-59
Identities = 158/456 (34%), Positives = 244/456 (52%), Gaps = 34/456 (7%)

Query:  15 SVGAEQNILGGILIEPTAIARCA-ILTPEKFYQAQHRIIFRALLDMAAANEPIDIITLND   73
            S+ AEQ++LGG+++E  A  R A +++ E FY+ +HR+IFR++  +   + P D+IT+ +
Sbjct:  23 SMEAEQSVLGGLMLENPAWDRIADVVSGEDFYRHEHRLIFRSIAKLINESRPADVITVQE   82

Query:  74 KLEARGEAENAGGLAYLIDLNQNTPSAKNISRYVGIVNDRFVERGLLKASAAIEKIAVSK  133
            L+   E E AGG  YLI L QNTPSA NI RY IV +R + R L +    I + A +
Sbjct:  83 DLQRNEELEAAGGFEYLITLAQNTPSAANIRRYAEIVRERSIMQLAEVGTEIARSAYNP  142

Query: 134 DGGTVAEKLSKAADELAAVGKDAVKRETKTFGQTVEDLIGGLDKRLDGVR--------FG  185
             G    + L +A +++  + +   K   +K    + DL+  + +R+D +           G
Sbjct: 143 QGRDAGQLLDEAENKVFQIAESTAK--SKQGFLEMPDLLKEVVQRIDMLYSRDNPDEVTG  200

Query: 186 LPTGLMKLDGMTGGLPDGNLIVIAARPSMGKTVLAENIARFALKQGK-AVHFQSYEMSAV  244
             + TG + LD   T GL  G+LI++A RPSMGKT  + NIA       +GK V  S EM
Sbjct: 201 VSTGFIDLDKKTSGLQPGDLIIVAGRPSMGKTAFSINIAEHVAVEGKLPVAVFSMEMGGA  260

Query: 245 ELARRGMAAECNIPMQNLKTGNLTQSDYANM----------PIYVSQAKEWKFDVNCDLL  294
            +L  R ++   +     LKTG L  +    +            P+Y+ +
Sbjct: 261 QLVMRMLGSVGRLDQSVLKTGRLEDEHWGRLNEAVVKLSDAPVYIDETPGLTALELRARA  320

Query: 295 NVDELCFLAKEKKLTTGLDLLVVDHLHIMPRAGRDE--VAELGNISRRLKNLAAELNTPV  352
                F  K        L L+V+D+L +M  +GR +    +ELG  ISR LK LA EL  P+
Sbjct: 321 RRLARQFNNK-------LGLIVIDYLQLMAGSGRSDNRASELGEISRSLKALAKELQVPI  373

Query: 353 VLVAQLNRGNTKQADKRPNMADIRGSGAIEQDANIIIMPHRESYYDGNENP--SIAELII  410
             +  ++QL+R    + DKRP M+D+R SGAIEQDA++I+   +R+ YY+ ++P    +AE II
Sbjct: 374 IALSQLSRTVESRTDKRPMMSDLRESGAIEQDADLIMFMYRDEYYN-QDSPMKGLAECII  432

Query: 411 AKNRDGEMGTVVCGWKGQFMKFEEEPDLAWQAPKHD                         446
            K+R+G +G +    W GQF  KF+      + +A   D
Sbjct: 433 GKHRNGPVGKIFLTWTGQFTKFDNAAYIPEEAKIED                         468
```

Based on this analysis, it was predicted that this protein from *N. gonorrhoeae*, and its epitopes, could be useful antigens for vaccines or diagnostics.

EXAMPLE 104

A DNA sequence was identified in *N. gonorrhoeae* <SEQ ID 207> which encodes amino acid sequence <SEQ ID 208; NGS104>. Analysis of this protein sequence reveals the following:

Signal Score (–7.5): –2.11
    Possible cleavage site: 15

>>> Seems to have no N-terminal signal seq.
Amino Acid Composition of Predicted Mature Form:
    calculated from 1
ALOM: Finding transmembrane regions (Klein et al.)
    count: 0   value:    5.04 threshold:  0.0
    PERIPHERAL   Likelihood =  5.04
    modified ALOM score:   –1.51
Rule: cytoplasmic protein
*** Reasoning Step: 2
----- Final Results -----
    bacterial cytoplasm --- Certainty= 0.220(Affirmative) < succ The protein has homology with the following sequences in the databases:

```
>gi|7515458|pir||T13296 hypothetical protein 8-Streptococcus phage phi-
01205
gi|2444088|gb|AAC79524.1|(U88974) ORF8 [Streptococcus thermophilus
temperate bacteriophage 01205]
Length = 157
Score = 62.1 bits (150), Expect = 3e-09
Identities = 53/161 (32%), Positives = 86/161 (52%), Gaps = 8/161 (4%)

Query:   5 TLYRCAADVQAGLDYYFDSETEREDTLEAV--IGQFEVKAQSVIAYIKNQEITEKMLEGH   62
           TLY      +   D ET + DTLEA+     +E K + +  IK+ E    +
Sbjct:   3 TLYELTDQLLEIYNMDVDDET-KLDTLEAIDWTTDYENKVEGYVKVIKSLEADIEARKNE   61

Query:  63 IRQMTGKLKAAKARNQSLKDYLARNMQAAGITEIKADDGTFKASFRKSEAVVILDEAQIP  122
           +++  G  K+ +++    LK  LA +M    G T +   D  FK   FRKSEAVV+ +E ++P
Sbjct:  62 KKRLDGLNKSDQSKIDKLKTALAVSMAETGQTRV--DTTLFKVGFRKSEAVVV-NEEEKLP  118

Query: 123 AEFMREAVKTEPDKTAIRKAIESGRQVAGAKIEGRKNLQIR                    163
            E+      K   PDK +++ ++SG+ + GA +E R+NL IR
Sbjct: 119 KEYQIATYK--PDKKTLKBLLKSGKHIEGATLEERRNLNIR                    157
```

Based on this analysis, it was predicted that this protein from *N. gonorrhoeae*, and its epitopes, could be useful antigens for vaccines or diagnostics.

EXAMPLE 105

A DNA sequence was identified in *N. gonorrhoeae* <SEQ ID 209> which encodes amino acid sequence <SEQ ID 210; NGS 105>. Analysis of this protein sequence reveals the following:

```
Signal Score (-7.5): -5.52
     Possible cleavage site: 31
>>> Seems to have no N-terminal signal seq.
Amino Acid Composition of Predicted Mature Form:
     calculated from 1
ALOM: Finding transmembrane regions (Klein et al.)
     count: 0   value:  2.60 threshold:  0.0
     PERIPHERAL   Likelihood =  2.60
     modified ALOM score:   -1.02
Rule: cytoplasmic protein
*** Reasoning Step: 2
----- Final Results -----
     bacterial cytoplasm --- Certainty= 0.135(Affirmative) < succ>
```

The protein has no homology with sequences in the databases.

Based on this analysis, it was predicted that this protein from *N. gonorrhoeae*, and its epitopes, could be useful antigens for vaccines or diagnostics.

EXAMPLE 106

A DNA sequence was identified in *N. gonorrhoeae* <SEQ ID 211> which encodes amino acid sequence <SEQ ID 212; NGS 106>. Analysis of this protein sequence reveals the following:

```
Signal Score (-7.5): 4.8
     Possible cleavage site: 26
>>> Seems to have a cleavable N-term signal seq.
Amino Acid Composition of Predicted Mature Form:
     calculated from 27
ALOM: Finding transmembrane regions (Klein et al.)
     count: 0   value:  7.80 threshold:  0.0
     PERIPHERAL   Likelihood =  7.80
     modified ALOM score:   -2.06
Score for OM-PP discrimination: 4.38
Rule: outer membrane or periplasmic protein
Score for OM-PP discrimination: 4.38
Rule: outer membrane or periplasmic protein
*** Reasoning Step: 2
Outer membrane?   Score: 0.437687
Outer membrane?   Score: 0.437687
----- Final Results -----
     bacterial outer membrane --- Certainty=
     0.768(Affirmative) < succ>
```

The protein has no homology with sequences in the databases, although it is similar to HMW1 from *Haemophilus influenzae*.

The protein was expressed in *E. coli* as an insoluble 43.56 kDa His-fusion product and then purified.

Based on this analysis, it was predicted that this protein from *N. gonorrhoeae*, and its epitopes, could be useful antigens for vaccines or diagnostics.

EXAMPLE 107

A DNA sequence was identified in *N. gonorrhoeae* <SEQ ID 213> which encodes amino acid sequence <SEQ ID 214; NGS 107>. Analysis of this protein sequence reveals the following:

```
Signal Score (-7.5): -3.83
     Possible cleavage site: 51
>>> Seems to have no N-terminal signal seq.
Amino Acid Composition of Predicted Mature Form:
     calculated from 1
ALOM: Finding transmembrane regions (Klein et al.)
     count: 0   value:  4.61 threshold:  0.0
     PERIPHERAL   Likelihood =  4.61
     modified ALOM score:   -1.42
Rule: cytoplasmic protein
*** Reasoning Step: 2
----- Final Results -----
     bacterial cytoplasm --- Certainty= 0.146(Affirmative) < succ>
```

The protein has no homology with sequences in the databases.

Based on this analysis, it was predicted that this protein from *N. gonorrhoeae*, and its epitopes, could be useful antigens for vaccines or diagnostics.

EXAMPLE 108

A DNA sequence was identified in *N. gonorrhoeae* <SEQ ID 215> which encodes amino acid sequence <SEQ ID 216; NGS108>. Analysis of this protein sequence reveals the following:

```
GvH: Examining signal sequence (von Heijne)
Signal Score (-7.5): -6.14
     Possible cleavage site: 19
>>> Seems to have no N-terminal signal seq.
Amino Acid Composition of Predicted Mature Form:
     calculated from 1
ALOM: Finding transmembrane regions (Klein et al.)
     count: 0   value:  8.43 threshold:  0.0
     PERIPHERAL   Likelihood =  8.43
     modified ALOM score:   -2.19
Rule: cytoplasmic protein
*** Reasoning Step: 2
----- Final Results -----
     bacterial cytoplasm --- Certainty=
        0.574(Affirmative) < succ>
     bacterial periplasmic space --- Certainty=
        0.000(Not Clear) < succ>
     bacterial outer membrane --- Certainty=
        0.000(Not Clear) < succ>
     bacterial inner membrane --- Certainty=
        0.000(Not Clear) < succ>
```

The protein has homology with the following sequences in the databases:

```
>pir||G81977 probable lipoprotein NMA0586 [imported]-Neisseria meningitidis
(group A strain Z2491)
emb|CAB83877.1|(AL162753) putative lipoprotein [Neisseria meningitidis
Z2491]
Length = 280
Score = 52.9 bits (126), Expect = 5e-06
Identities = 43/134 (32%), Positives = 63/134 (46%), Gaps = 23/134 (17%)

Query: 174 LGDIRGVATDEDKLPKAGSFQYEGRAFGGNGVLSKESLDNHNGVFRYTIDFDRRKGSGSI  233
              +GDI G  T  DKLP+ G    Y G AFG             D+ +G   YTIDF  ++G G I
Sbjct: 156 IGDIAGEHTSFDKLPEGGRATYRGTAFGS---------DDASGKLTYTIDFAAKQGHGKI  206

Query: 234 EGMEQYGKIKLEEAAIERIPYRESGSSLGLKDRVSYFGVNEGVAMLEKDNEIKKYHLGIF  293
              E ++    ++ ++ AA  +  P ++ + +              ++L    E    Y LGIF
Sbjct: 207 EHLKS-PELNVDLAASDIKPDKKRHAVI-------------SGSVLYNQAEKGSYSLGIF  252

Query: 294 GEAANEVAGAVSQE                                                307
              G  A  EVAG+    E
Sbjct: 253 GGQAQEVAGSAEVE                                                266

>pir||D81032 hypothetical protein NMB1870 [imported]-Neisseria meningitidis
(group B strain MD58)
gb|AAF42204.1|(AE002537) hypothetical protein [Neisseria meningitidis
MC58]
Length = 320
Score = 50.6 bits (120), Expect = 3e-05
Identities = 50/168 (29%), Positives 76/168 (44%), Gaps = 28/168 (16%)

Query: 136 VYEQPYSVVRGYFGYSRKDGNPIEGDGQNPEEIPFDLYLGDIRGVATDEDKLPKAGSFQY  195
              VY+Q +S +  +       +D    E  G+    +   F   +GDI G  T  DKLP+ G    Y
Sbjct: 163 VYKQSHSALTAFQTEQIQDS---EHSGKMVAKRQFR--IGDIAGEHTSFDKLPEGGRATY  217

Query: 196 EGRAFGGNGVLSKESLDNHNGVFRYTIDFDRRKGSGSIEGMEQYGKIKLEEAAIERIPYR  255
              G  AFG             D+  G   YTIDF  ++G+G IE ++    ++ ++ AA  +  P
Sbjct: 218 RGTAFGS---------DDAGGKLTYTIDFAAKQGNGKIEHLKS-PELNVDLAAADIKPDK  267

Query: 256 ESGSSLGLKDRVSYFGVNEGVAMLEKDNEIKKYHLGIFGEAANEVAGA              303
              +   + +                ++L    E    Y LGIFG  A  EVAG+
Sbjct: 268 KRHAVI-------------SGSVLYNQAEKGSYSLGIFGGKAQEVAGS              302
```

Based on this analysis, it was predicted that this protein from *N. gonorrhoeae*, and its epitopes, could be useful antigens for vaccines or diagnostics.

EXAMPLE 109

A DNA sequence was identified in *N. gonorrhoeae* <SEQ ID 217> which encodes amino acid sequence <SEQ ID 218; NGS109>. Analysis of this protein sequence reveals the following:

GvH: Examining signal sequence (von Heijne)
Signal Score (-7.5): -5.39
Possible cleavage site: 25
>>> Seems to have no N-terminal signal seq.
Amino Acid Composition of Predicted Mature Form:
calculated from 1

ALOM: Finding transmembrane regions (Klein et al.)
count: 0  value: 7.00 threshold: 0.0
PERIPHERAL  Likelihood = 7.00
modified ALOM score: −1.90
Rule: cytoplasmic protein
*** Reasoning Step: 2
----- Final Results -----
bacterial cytoplasm --- Certainty= 0.353(Affirmative) < succ>
bacterial periplasmic space --- Certainty= 0.000(Not Clear) < succ>
bacterial outer membrane --- Certainty= 0.000(Not Clear) < succ>
bacterial inner membrane --- Certainty= 0.000(Not Clear) < succ>

The protein has homology with the following sequences in the databases:

```
>pir||A82012 hypothetical protein NMA0179 [imported]-Neisseria
meningitidis (group A strain Z2491)
emb|CAB83494.1|(AL162752) hypothetical protein NMA0179 [Neisseria
meningitidis Z2491]
Length = 97
Score = 183 bits (464), Expect = 1e-45
Identities = 92/97 (94%), Positives = 95/97 (97%)

Query:  44 MKANDKLNRQIDVLQKQSAAIHNEAYIEMNTLLYRHREVVSIHNRKADYAEKGKERIALF  103
              MK NDKLNRQIDVLQKQSAAIHNEAYIEMNTLLYRHREVVS+HNRKADYAEKGKE+IALF
Sbjct:   1 MKTNDKLNRQIDVLQKQSAAIHNEAYIEMNTLLYRHREVVSVHNRKADYAEKGKEQIALF   60
```

```
-continued
Query:  104 PRGLNGITKLPAAVLLPERPYHFDMKEVLYIFSRIPR            140
            PRGLNGITKLPAAVLLPERPYHFDMKEVL+IFS IPR
Sbjct:   61 PRGLNGITKLPAAVLLPERPYHFDMKEVLHIFSWIPR             97
```

As a homolog was found in serogroup A *N. meningitidis* but not in serogroup B, NGS109 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 110

A DNA sequence was identified in *N. gonorrhoeae* <SEQ ID 219> which encodes amino acid sequence <SEQ ID 220; NGS110>. Analysis of this protein sequence reveals the following:

---

GvH: Examining signal sequence (von Heijne)
    Signal Score (−7.5): −2.76
    Possible cleavage site: 41
>>> Seems to have no N-terminal signal seq.
Amino Acid Composition of Predicted Mature Form:
    calculated from 1
ALOM: Finding transmembrane regions (Klein et al.)
    count: 1  value: −0.00  threshold: 0.0
    INTEGRAL    Likelihood = −0.00    Transmembrane 88-104 (88-104)
    PERIPHERAL  Likelihood = 7.69
    modified ALOM score: 0.50
Rule: cytoplasmic membrane protein
*** Reasoning Step: 2
----- Final Results -----
    bacterial inner membrane --- Certainty= 0.100(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

---

The protein has no homology with sequences in the databases.

Based on this analysis, it was predicted that this protein from *N. gonorrhoeae*, and its epitopes, could be useful antigens for vaccines or diagnostics.

EXAMPLE 111

A DNA sequence was identified in *N. gonorrhoeae* <SEQ ID 221> which encodes amino acid sequence <SEQ ID 222; NGS111>. Analysis of this protein sequence reveals the following:

---

GvH: Examining signal sequence (von Heijne)
    Signal Score (−7.5): −5.89
    Possible cleavage site: 21
>>> Seems to have no N-terminal signal seq.
Amino Acid Composition of Predicted Mature Form:
    calculated from 1
ALOM: Finding transmembrane regions (Klein et al.)
    count: 0  value: 2.44  threshold: 0.0
    PERIPHERAL  Likelihood = 2.44
    modified ALOM score: −0.99
Rule: cytoplasmic protein
*** Reasoning Step: 2
----- Final Results -----
    bacterial cytoplasm --- Certainty= 0.293(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

---

The protein has homology with the following sequences in the databases:

```
>gb|AAC45840.1|(AF001598) restriction endonuclease [Neisseria
gonorrhoeae]
Length = 374
Score = 539 bits (1390), Expect = e-152
Identities = 285/285 (100%), Positives = 285/285 (100%)

Query:    1 MGFIEPFLSSYTPLSRDYVQARTNRKRQTLLSKIVYTHSGFQRSVTENSNIRQINFLIKT     60
            MGFIEPFLSSYTPLSRDYVQARTNRKRQTLLSKIVYTHSGFQRSVTENSNIRQINFLIKT
Sbjct:   90 MGFIEPFLSSYTPLSRDYVQARTNRKRQTLLSKIVYTHSGFQRSVTENSNIRQINFLIKT    149

Query:   61 LVEHPQGKLNKKEIAAMMLVDLKTFQQDYLTETELNDYFQQGIESGFIERKYNQISYLWN    120
            LVEHPQGKLNKKEIAAMMLVDLKTFQQDYLTETELNDYFQQGIESGFIERKYNQISYLWN
Sbjct:  150 LVEHPQGKLNKKEIAAMMLVDLKTFQQDYLTETELNDYFQQGIESGFIERKYNQISYLWN    209

Query:  121 LLDKLDDLKRVGDDLYFAEDAQRIFGNLDEITVRKRDPYLHRLYKNQLQEESEEHYGNVK    180
            LLDKLDDLKRVGDDLYFAEDAQRIFGNLDEITVRKRDPYLHRLYKNQLQEESEEHYGNVK
Sbjct:  210 LLDKLDDLKRVGDDLYFAEDAQRIFGNLDEITVRKRDPYLHRLYKNQLQEESEEHYGNVK    269

Query:  181 CMLEKLAYPVLIASHIKPFILSDDTEAYDPNNGLLLSRTLDSLFDLKYISFDDEGNMVKS    240
            CMLEKLAYPVLIASHIKPFILSDDTEAYDPNNGLLLSRTLDSLFDLKYISFDDEGNMVKS
Sbjct:  270 CMLEKLAYPVLIASHIKPFILSDDTEAYDPNNGLLLSRTLDSLFDLKYISFDDEGNMVKS    329

Query:  241 KRLSDDVWRRWCDVKLDNNLLNDKRKSYLAYHRELMLQEDQEFHI                 285
            KRLSDDVWRRWCDVKLDNNLLNDKRKSYLAYHRELMLQEDQEFHI
Sbjct:  330 KRLSDDVWRRWCDVKLDNNLLNDKRKSYLAYHRELMLQEDQEFHI                 374
```

Based on this analysis, it was predicted that this protein from *N. gonorrhoeae*, and its epitopes, could be useful antigens for vaccines or diagnostics.

EXAMPLE 112

A DNA sequence was identified in *N. gonorrhoeae* <SEQ ID 223> which encodes amino acid sequence <SEQ ID 224; NGS112>. Analysis of this protein sequence reveals the following:

```
GvH Examining signal sequence (von Heijne)
    Signal Score (-7.5): -9.08
    Possible cleavage site: 54
>>> Seems to have no N-terminal signal seq.
Amino Acid Composition of Predicted Mature Form:
    calculated from 1
ALOM: Finding transmembrane regions (Klein et al.)
    count: 1   value:   -1.22 threshold:  0.0
    INTEGRAL        Likelihood =  -1.22    Transmembrane
    160-176 (160-177)
    PERIPHERAL      Likelihood =   0.58
    modified ALOM score:   0.74
Rule: cytoplasmic membrane protein
*** Reasoning Step: 2
----- Final Results -----
    bacterial inner membrane --- Certainty=
    0.149(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>
```

The protein has homology to the following sequences in the databases:

Based on this analysis, it was predicted that this protein from *N. gonorrhoeae*, and its epitopes, could be useful antigens for vaccines or diagnostics.

EXAMPLE 113

A DNA sequence was identified in *N. gonorrhoeae* <SEQ ID 225> which encodes amino acid sequence <SEQ ID 226; NGS113>. Analysis of this protein sequence reveals the following:

```
GvH Examining signal sequence (von Heijne)
    Signal Score (-7.5): -1.7
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 4   value:   -9.77 threshold:  0.0
    INTEGRAL        Likelihood =  -9.77    Transmembrane
    187-203 (183-208)
    INTEGRAL        Likelihood =  -7.22    Transmembrane
    25-41 (19-46)
    INTEGRAL        Likelihood =  -4.14    Transmembrane
    139-155 (138-155)
    INTEGRAL        Likelihood =  -2.87    Transmembrane
    86-102 (85-102)
    PERIPHERAL      Likelihood =   1.27
    modified ALOM score:   2.45
Rule: cytoplasmic membrane protein
*** Reasoning Step: 2
----- Final Results -----
    bacterial inner membrane --- Certainty=
    0.491(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>
```

The protein has homology to the following sequences in the databases:

```
^ **gbp_12644572 gi|12644572|sp|Q50973|T2B1_NEIGO TYPE II RESTRICTION
ENZYME NGOBI (ENDONUCLEASE NGOBI) (R.NGOBI) (R.NGOI)
gb|AAB03207.2|(U42459) NgoI restriction endonuclease R.NgoI
[N. gonorrhoeae]
Length = 350
Score = 694 bits (1791), Expect = 0.0
Identities = 349/350 (99%), Positives = 349/350 (99%)

Query:    1 MTLEEQQAKEALDGIIKKSRVHLYKPIQIAEILYHDRCIKQLDFLNLDTYRNQSKRWRDE    60
            MTLEEQQAKEALDGIIKKSRVHLYKPIQIAEILYHDRCIKQLDFLNLDTYRNQSKRWRDE
Sbjct:    1 MTLEEQQAKEALDGIIKKSRVHLYKPIQIAEILYHDRCIKQLDFLNLDTYRNQSKRWRDE    60

Query:   61 ICRRFLGISTSSAKFQDNLFEKNAIPPEKLAVLGTLNRQSDGGVESTITKQFFNRFSQM   120
            ICRRFLGISTSSAKFQDNLFEKNAIPPEKLAVLGTLNRQSDGGVESTITKQFFNRFSQM
Sbjct:   61 ICRRFLGISTSSAKFQDNLFEKNAIPPEKLAVLGTLNRQSDGGVESTITKQFFNRFSQM   120

Query:  121 SEALAYVGNTDRYSFQLSEFLNLFWLEPGLKRSIDKIYEIVVYALFDALVSELGITVSID   180
            SEALAYVGNTDRYSFQLSEFLNLFWLEPGLKRSIDKIYEIVVYALFDALVSELGITVSID
Sbjct:  121 SEALAYVGNTDRYSFQLSEFLNLFWLEPGLKRSIDKIYEIVVYALFDALVSELGITVSID   180

Query:  181 FPKENLFLWEEYQDFAEKIITMPKNEHLKLPAKIHRVGVTNAADRGLDMWSNFGLAIQVK   240
            FPKENLFLWEEYQDFAEKIITMPKNEHLKLPAKIHRVGVTNAADRGLDMWSNFGLAIQVK
Sbjct:  181 FPKENLFLWEEYQDFAEKIITMPKNEHLKLPAKIHRVGVTNAADRGLDMWSNFGLAIQVK   240

Query:  241 HLSLDEELAEDIVSSISADRIVIVCKKAEQSVIVSLLTQIGWKSRIQNIVTEDDLISWYE   300
            HLSLDEELAEDIVSSISADRIVIVCKKAEQSVIVSLLTQIGWKSRIQNIVTEDDLISWYE
Sbjct:  241 HLSLDEELAEDIVSSISADRIVIVCKKAEQSVIVSLLTQIGWKSRIQNIVTEDDLISWYE   300

Query:  301 KALRQQYPIAEALLENIKTEIMREFPAVNEANEFLDFAQNRGYDITVTHF            350
            KALRQQYPIAEALLENIKTEIMREFPAVNEANEFLDFAQNRGYDITVTHF
Sbjct:  301 KALRQQYPIAEALLENIKTEIMREFPAVNEANEFLDFAQNRGYDITVTHF            350
```

```
^ **gbp_15902668 gi|15902668|ref|NP_358218.1|\(NC_003098) ABC transporter
membrane-spanning permease-glutamine transport [Streptococcus pneumoniae
R6]
gb|AAK99428.1|(AE008440) ABC transporter membrane-spanning permease-
glutamine transport [Streptococcus pneumoniae R6]
Length = 226
Score = 218 bits (556), Expect = 7e-56
Identities = 113/218 (51%), Positives = 155/218 (70%)

Query:    1 MNWPYLIDAVPKFADAAKLTLELSVYGVVLSLLFLPVAVVTAYRIRPFYALARAYIELS   60
            M+W    +P +  A  LTL ++V+G++ S L GL V+++  YRI    +A AYIEILS
Sbjct:    1 MNWPYLIDAVPKFADAAKLTLELSVYGVVLSLLFGLPVAVVTAYRIRPFYALARAYIELS   60
            RNTPLLIQLFFLY+GLP++GI      C   + LVFLG SYMAE+ R+G+ A+ + Q    G Query:   61 RNTPLLIQLFFLYYGLPKMGIKWDGFTCGVIALVFLGASYMAEAVRAGILAVPKGQVGAG 120
            RNTPLLIQLFFLY+GLP++GI       C  +LVFLG SYMAE+ R+G+ A+ + G    G
Sbjct:   61 RNTPLLIQLFFLYFGLPRIGIVLSSEVCATLGLVFLGGSYMAESFRSGLEAISQTQQEIG 120

Query:  121 KAIGLSRFQVFRYVELPQVWAVAVPAIGANILFLMKETSVVSTVGIAELLFVTKDVIGMD 180
                AIGL+   QVFRYV LPQ   AVA+P+   AN++FL+KETSV S V +A+L++V KD+IG+
Sbjct:  121 LAIGLTPLQVFRYVVLPQATAVALPSFSANVIFLIKETSVFSAVALADLMYVAKDLIGLY 180

Query:  181 YKTNEALFLLFAAYLIILLPVSLLARRIENRVRSAKYG                      218
            Y+T+  AL +L   AYLI+LLP+SL+    IE R+R A +G
Sbjct:  181 YETDIALAMLVVAYLIMLLPISLVFSWIERRIRHAGFG                      218
```

Based on this analysis, it was predicted that this protein from *N. gonorrhoeae*, and its epitopes, could be useful antigens for vaccines or diagnostics.

EXAMPLE 114

A DNA sequence was identified in *N. gonorrhoeae* <SEQ ID 227> which encodes amino acid sequence <SEQ ID 228; NGS 114>. Analysis of this protein sequence reveals the following:

---

GvH Examining signal sequence (von Heijne)
  Signal Score (−7.5): −0.46
  Possible cleavage site: 17
>>> Seems to have a cleavable N-term signal seq.
Amino Acid Composition of Predicted Mature Form:
  calculated from 18
ALOM: Finding transmembrane regions (Klein et al.)
  count: 3   value: −5.36 threshold: 0.0
    INTEGRAL         Likelihood = −5.36   Transmembrane
    50-66 (47-67)

-continued

INTEGRAL         Likelihood = −4.83   Transmembrane
    183-199 (176-200)
    INTEGRAL         Likelihood = −1.81   Transmembrane
    72-88 (72-88)
    PERIPHERAL       Likelihood =  0.26
    modified ALOM score: 1.57
Rule: cytoplasmic membrane protein
*** Reasoning Step: 2
----- Final Results -----
    bacterial inner membrane --- Certainty=
    0.314(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>

---

The protein has homology to the following sequences in the databases:

```
^ **gbp_15902667 gi|15902667|ref|NP_358217.1|\(NC_003098) ABC transporter
membrane-spanning permease-glutamine transport [Streptococcus pneumoniae
R6]
gb|AAK99427.1|(AE008440) ABC transporter membrane-spanning permease-
glutamine transport [Streptococcus pneumoniae R6]
Length = 225
Score = 218 bits (555), Expect = 9e-56
Identities = 111/206 (53%), Positives = 151/206 (72%)

Query:    3 EGLLLTAQISLISVAASCVLGTLFGLVLRSRNRLVRFVGRFYLETIRIVPILVWLFGLYF   62
            +GL +T   IS++SV  S + GT+ G+++ S +R++RF+  R YLE  IRI+P LV LF +YF
Sbjct:   20 QGLGVTIGISILSVLLSMMFGTVMGIIMTSHSRIIRFLTRLYLEFIRIMPQLVLLFIVYF   79

Query:   63 GLSVWTGIHIGGFWVCVWVFSLWGVAEMGKLVRGALESIEKHQVESGLAPGLSRGQVFRC 122
            GL+     I+I G  + VF+LWG AEMGDLVRGA+ S+ KHQ ESG A GL+   Q++
Sbjct:   80 GLARNFNINISGETSAIIVFTLWGTAEMGDLVRGAITSLPKHQFESGQALGLTNVQLYYH 139

Query:  123 IELPQSIRRVLPGAVNLFTRMIKTSSLAWLIGVIEVVKVGQQIIENSLLTQPNASFWVYG 182
            I +PQ +RR+LP A+NL TRMIKT+SL  LIGV+EV KVGQQII+++  LT P ASFW+YG
Sbjct:  140 IIIPQVLRRLLPQAINLVTRMIKTTSLVVLIGVVEVTKVGQQIIDSNRLTIPTASFWIYG 199

Query:  183 LIFMLYFFCCWPLSLLAAKLEQKWEH                                   208
              I +LYF  C+P+S L+   LE+ W +
Sbjct:  200 TILVLYFAVCYPISKLSTHLEKHWRN                                   225
```

EXAMPLE 115

A DNA sequence was identified in *N. gonorrhoeae* <SEQ ID 229> which encodes amino acid sequence <SEQ ID 230; NGS 115>. Analysis of this protein sequence reveals the following:

```
GvH Examining signal sequence (von Heijne)
    Signal Score (-7.5): -0.639999
    Possible cleavage site: 38
>>> May be a lipoprotein
Amino Acid Composition of Predicted Mature Form:
    calculated from 23
ALOM: Finding transmembrane regions (Klein et al.)
    count: 0   value:   5.25 threshold:   0.0
    PERIPHERAL   Likelihood =   5.25
    modified ALOM score:   -1.55
Rule: inner or outer membrane protein
Rule: inner or outer membrane protein
*** Reasoning Step: 2
Lipoprotein?
Inner membrane?
----- Final Results -----
    bacterial outer membrane --- Certainty=
      0.790(Affirmative) < succ>
    bacterial inner membrane --- Certainty=
      0.700(Affirmative) < succ>
    bacterial periplasmic space --- Certainty=
      0.000(Not Clear) < succ>
        bacterial cytoplasm --- Certainty= 0.000(Not Clear) < succ>
```

The protein has homology to the following sequences in the databases:

```
^ **gbp_4588485 gi|4588485|gb|AAD26123.1|\(AF109148) antigenic protein
[Actinobacillus pleuropneumoniae]
Length = 278
Score = 407 bits (1045), Expect = e-112
Identities = 212/282 (75%), Positives = 242/282 (85%), Gaps = 7/282 (2%)

Query:     1 MKLNAKLKALLASAAIAVGLTACGGGSGDAQSSQSSGAA-TVAAIKEKGVIRIGVFGDKP    59
             MKL+  LK LLA+A  A  LTAC     +A ++QSS A  +VA IKEKGVIRIGVFGDKP
Sbjct:     1 MKLSTTLKTLLATAITAFALTACD----NANNAQSSTAKDSVAQIKEKGVIRIGVFGDKP    56

Query:    60 PFGYVDANGKNQGFDVEIAKDLAKDLLGSPDKVEFVLTEAANRVEYVRSGKVDLILANFT   119
             PFGYVDANGK+QGFDVEIAK++A DLLGS DKVEFVLTEAANRVEY++S KVDLILANFT
Sbjct:    57 PFGYVDANGKSQGFDVEIAKEIANDLLGSSDKVEFVLTEAANRVEYLKSNKVDLILANFT   116

Query:   120 QTPERAEAVDFADPYMKVALGVVSPKNKPITDMAQLKDQTLLVNKGTTADAFFTKSHPEV   179
             +TPERAE VDFA PYM VALGVVSPK + I+D+ QL+ +TLLVNKGTTADA+FTK+HPE+
Sbjct:   117 KTPERAEVVDFAAPYMNVALGVVSPKVRLISDLKQLEGKTLLVNKGTTADAYFTKNHPEI   176

Query:   180 KLLKFDQNTETFDALKDGRGVALAHDNALLWAWAKENPNFEVAIGNLGPAEFIAPAVQKG   239
             LLKFDQNTETFDALKDGRGVALAHDNAL+WAWAKENP F+VAIG++GPAE IAPVQKG
Sbjct:   177 NLLKFDQNTETFDALKDGRGVALAHDNALVWAWAKENTFDVAIGSVGPAEQIAPAVQKG   236

Query:   240 NADLLNWVNGEIAAMKKDGRLKAAYEKTLLPVYGEKVKPEAL                   281
             N  LL+ +N EIA  K +G+LKAAYEKTL+PVYG+  KPE L
Sbjct:   237 NQALLDVINKEIAEFKTNGKLKAAYERKTLVPVYGD--KPELL                  276
```

The protein was expressed in *E. coli* as a soluble 28.16 kDa His-fusion product, lacking its leader peptide and its polyglycine sequence (GGGSG), and then purified.

Based on this analysis, it was predicted that this protein from *N. gonorrhoeae*, and its epitopes, could be useful antigens for vaccines or diagnostics.

EXAMPLE 116

A DNA sequence was identified in *N. gonorrhoeae* <SEQ ID 231> which encodes amino acid sequence <SEQ ID 232; NGS116>. Analysis of this protein sequence reveals the following:

```
GvH Examining signal sequence (von Heijne)
    Signal Score (-7.5): -7.13
    Possible cleavage site: 61
>>> Seems to have no N-terminal signal seq.
Amino Acid Composition of Predicted Mature Form:
    calculated from 1
ALOM: Finding transmembrane regions (Klein et al.)
    count: 1   value:   -1.86 threshold:   0.0
    INTEGRAL     Likelihood =   -1.86      Transmembrane
      51-67 (51-67)
    PERIPHERAL   Likelihood =   1.54
    modified ALOM score:   0.87
Rule: cytoplasmic membrane protein
*** Reasoning Step: 2
----- Final Results -----
    bacterial inner membrane --- Certainty=
      0.174(Affirmative) < succ>
    bacterial periplasmic space --- Certainty=
      0.000(Not Clear) < succ>
    bacterial outer membrane --- Certainty=
      0.000(Not Clear) < succ>
      bacterial cytoplasm --- Certainty=
      0.000(Not Clear) < succ>
```

The protein has no homology to sequences in the databases.

Based on this analysis, it was predicted that this protein from *N. gonorrhoeae*, and its epitopes, could be useful antigens for vaccines or diagnostics.

EXAMPLE 117

A DNA sequence was identified in *N. gonorrhoeae* <SEQ ID 233> which encodes amino acid sequence <SEQ ID 234; NGS117>. Analysis of this protein sequence reveals the following:

GvH Examining signal sequence (von Heijne)
    Signal Score (−7.5): 0.25
    Possible cleavage site: 40
>>> Seems to have a cleavable N-term signal seq.
Amino Acid Composition of Predicted Mature Form:
    calculated from 41
ALOM: Finding transmembrane regions (Klein et al.)
    count: 2  value: −4.57  threshold: 0.0
    INTEGRAL    Likelihood = −4.57  Transmembrane
    100-116 (99-118)
    INTEGRAL    Likelihood = −1.59  Transmembrane
    54-70 (54-70)
    PERIPHERAL    Likelihood = 0.53
    modified ALOM score: 1.41
Rule: cytoplasmic membrane protein
*** Reasoning Step: 2
----- Final Results -----
    bacterial inner membrane --- Certainty= 0.283(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

The protein has homology to the following sequences in the databases:

```
^ **gbp_15793413 gi|15793413|ref|NP_283235.1|\(NC_003116) putative
integral membrane protein [Neisseria meningitidis Z2491]
pir||C81957 probable integral membrane protein NMA0408 [imported]-
Neisseria meningitidis (group A strain Z2491)
emb|CAB83707.1|(AL162753) putative integral membrane protein [Neisseria
meningitidis Z2491]
Length = 550
Score = 1115 bits (2885), Expect = 0.0
Identities = 539/550 (98%), Positives = 545/550 (99%)

Query:    1 MVAYAFLFLFVTAAVLLIVRSHYRWTYFFASALFVFLAGGMLMLTAQWQRALNFASVWFV   60
            MVAY FLFLFVTAA++LI+RSHYRWTYFFASALFVFLAGGMLMLTAQWQRALNFASVWFV
Sbjct:    1 MVAYVFLFLFVTAALVLIIRSHYRWTYFFASALFVFLAGGMLMLTAQWQRALNFASVWFV   60

Query:   61 VLILFHRLKIHYYKQPLLISDFLLIADWRNWETLFHYKEAVIGMAGLLALAGYAVFGWSG  120
            VLILFHRLKIHYYKQPLLISDFLLIADWRNWETLFHYKEAVIGMAGLLALA YAVFGWSG
Sbjct:   61 VLILFHRLKIHYYKQPLLISDFLLIADWRNWETLFHYKEAVIGMAGLLALAAYAVFGWSG  120

Query:  121 ADSLGMPWRWAGAVLFAAAFVSVRHFSKHPGAVKTWLDSLPDDGRDVFLNLPMSCRAVFF  180
            ADSL +PWRWAGAVLFAAAFVS+RHFSKHPGAVKTWLDSLPDDGRDVFLNLPMSCRAVFF
Sbjct:  121 ADSLDVPWRWAGAVLFAAAFVSMRHFSKHPGAVKTWLDSLPDDGRDVFLNLPMSCRAVFF  180

Query:  181 QVPVFEGDGEAFARQMPSETRPYGMSDEKPDIVVTLMESTLDPHCFDFAAAKIPDLKMFG  240
            QVPVFEGDGEAFARQMPSETRP GMSDEKPDIVVTLMESTLDPHCFDFAAAKIPDLKMFG
Sbjct:  181 QVPVFEGDGEAFARQMPSETRPCGMSDEKPDIVVTLMESTLDPHCFDFAAAKIPDLKMFG  240

Query:  241 RQEDTVFSSPLRVHTFGGATWKSEFAFLAGVPSTDFGALASGVFYSVVPHLQTGFVRNLR  300
            RQEDTVFSSPLRVHTFGGATWKSEFAFLAGVPSTDFGALASGVFYSVVPHLQTGFVRNLR
Sbjct:  241 RQEDTVFSSPLRVHTFGGATWKSEFAFLAGVPSTDFGALASGVFYSVVPHLQTGFVRNLR  300

Query:  301 EHGYFCVALSPFTKGNYNAKAAYDHFGFNLMFQPQDLGYPAPMGKNLWHISSEEMMQYAR  360
            EHGYFCVALSPFTKGNYNAKAAYDHFGFNLMFQPQDLGYPAPMGKNLWHISSEEMMQYAR
Sbjct:  301 EHGYFCVALSPFTKGNYNAKAAYDHFGFNLMFQPQDLGYPAPMGKNLWHISSEEMMQYAR  360

Query:  361 MILEKRHPDLENVRQPMFVYVLTMKEHGPYRTDTDNVFDLDAPDLNAKTVSALNDYIGRI  420
            MILEKRHPDLENVRQPMFVYVLTMKEHGPYRTDTDNVFDLDAPDLNAKTVSALNDYIGRI
Sbjct:  361 MILEKRHPDLENVRQPMFVYVLTMKEHGPYRTDTDNVFDLDAPDLNAKTVSALNDYIGRI  420

Query:  421 ADLDKAVESFDRYLHERGKPFVFGYFGDHQVPFEGVSVRKKWDYAQPDYVTQFAVRSNIA  480
            ADLDKAVESFDRYLHERGKPFVFGYFGDHQVPFEGVSVRKKWDYAQPDYVTQFAVRSNIA
Sbjct:  421 ADLDKAVESFDRYLHERGKPFVFGYFGDHQVPFEGVSVRKKWDYAQPDYVTQFAVRSNIA  480

Query:  481 GGFVQRQDFLDLAFAGGVLMEAAGLEAKDGFMRANMAMRGLCGGGLEDCPNRELVGNYRN  540
            GGFVQRQ+FLDLAFAGGVLMEAAGLEAKDGFMRANMAMRGLCGGGLEDCPN ELVGNYRN
Sbjct:  481 GGFVQRQNFLDLAFAGGVLMEAAGLEAKDGFMRANMAMRGLCGGGLEDCPNWELVGNYRN  540

Query:  541 YLYDVLKIAR                                                   550
            YLYDVLKIAR
Sbjct:  541 YLYDVLKIAR                                                   550
```

A homolog was found in serogroup A *N. meningitidis* but not in serogroup B, so NGS117 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 118

A DNA sequence was identified in *N. gonorrhoeae* <SEQ ID 235> which encodes amino acid sequence <SEQ ID 236; NGS118>. Analysis of this protein sequence reveals the following:

```
GvH Examining signal sequence (von Heijne)
    Signal Score (-7.5): 0.59
    Possible cleavage site: 19
    >>> May be a lipoprotein
Amino Acid Composition of Predicted Mature Form:
    calculated from 22
ALOM: Finding transmembrane regions (Klein et al.)
    count: 0   value:   8.33 threshold:   0.0
    PERIPHERAL   Likelihood =   8.33
    modified ALOM score:   -2.17
Rule: inner or outer membrane protein
Rule: inner or outer membrane protein
*** Reasoning Step: 2
Lipoprotein?
Inner membrane?
----- Final Results -----
        bacterial outer membrane --- Certainty=
        0.790(Affirmative) < succ>
        bacterial inner membrane --- Certainty=
        0.700(Affirmative) < succ>
        bacterial periplasmic space --- Certainty=
        0.000(Not Clear) < succ>
            bacterial cytoplasm --- Certainty=
            0.000(Not Clear) < succ>
```

The protein has no homology to sequences in the databases.

The protein was expressed in *E. coli* as a soluble 12.98 kDa His-fusion product and then purified.

Based on this analysis, it was predicted that this protein from *N. gonorrhoeae*, and its epitopes, could be useful antigens for vaccines or diagnostics.

EXAMPLE 119

A DNA sequence was identified in *N. gonorrhoeae* <SEQ ID 237> which encodes amino acid sequence <SEQ ID 238; NGS119>. Analysis of this protein sequence reveals the following:

```
GvH Examining signal sequence (von Heijne)
    Signal Score (-7.5): -4.75
    Possible cleavage site: 47
    >>> Seems to have no N-terminal signal seq.
Amino Acid Composition of Predicted Mature Form:
    calculated from 1
ALOM: Finding transmembrane regions (Klein et al.)
    count: 0   value:   7.69 threshold:   0.0
    PERIPHERAL   Likelihood =   7.69
    modified ALOM score:   -2.04
Rule: cytoplasmic protein
*** Reasoning Step: 2
----- Final Results -----
        bacterial cytoplasm --- Certainty=
        0.213(Affirmative) < succ>
        bacterial periplasmic space --- Certainty=
        0.000(Not Clear) < succ>
        bacterial outer membrane --- Certainty=
        0.000(Not Clear) < succ>
        bacterial inner membrane --- Certainty=
        0.000(Not Clear) < succ>
```

The protein has homology to the following sequences in the databases:

```
^ **gbp_2625122 gi|2625122|gb|AAB86635.1|\(AF031495) putative hemoglobin
receptor component precursor HpuA [Neisseria gonorrhoeae]
Length = 360
Score = 668 bits (1724), Expect = 0.0
Identities = 331/331 (100%), Positives = 331/331 (100%)

Query:    1 VSIPTATPLPAGEVTLSSDNGNIENINTAGAGSASDAPSRSRRSLDAAPQNTSGISIRQR   60
            VSIPTATPLPAGEVTLSSDNGNIENINTAGAGSASDAPSRSRRSLDAAPQNTSGISIRQR
Sbjct:   30 VSIPTATPLPAGEVTLSSDNGNIENINTAGAGSASDAPSRSRRSLDAAPQNTSGISIRQR   89

Query:   61 EVEKDYFGYKSKETSFIFKTPGGAQYALSSYADPITVSYSSPKFKIPDRHAGQRLADGSR  120
            EVEKDYFGYKSKETSFIFKTPGGAQYALSSYADPITVSYSSPKFKIPDRHAGQRLADGSR
Sbjct:   90 EVEKDYFGYKSKETSFIFKTPGGAQYALSSYADPITVSYSSPKFKIPDRHAGQRLADGSR  149

Query:  121 IFICCSDSGATSYAEITKQDYMKFGAWIGPNGEIDLFAGGFPVGKTPPPAFSYGSSTPET  180
            IFICCSDSGATSYAEITKQDYMKFGAWIGPNGEIDLFAGGFPVGKTPPPAFSYGSSTPET
Sbjct:  150 IFICCSDSGATSYAEITKQDYMKFGAWIGPNGEIDLFAGGFPVGKTPPPAFSYGSSTPET  209

Query:  181 ALSKGKITYQVWGIRVRNGQFVTSSYTPPKSGSYYGTLANTPVSFITANFNSNTLAGKI   240
            ALSKGKITYQVWGIRVRNGQFVTSSYTPPKSGSYYGTLANTPVSFITANFNSNTLAGKI
Sbjct:  210 ALSKGKITYQVWGIRVRNGQFVTSSYTPPKSGSYYGTLANTPVSFITANFNSNTLAGKI   269

Query:  241 LGNSDYGPDVDIQNATITGPTFSGDATSGGKSGKLEGKFFGKFASTRSSEVSIGGKITFD  300
            LGNSDYGPDVDIQNATITGPTFSGDATSGGKSGKLEGKFFGKFASTRSSEVSIGGKITFD
Sbjct:  270 LGNSDYGPDVDIQNATITGPTFSGDATSGGKSGKLEGKFFGKFASTRSSEVSIGGKITFD  329

Query:  301 GDRSLDTVFGGVSYEKKLDDTSQDTNHLTKQ                              331
            GDRSLDTVFGGVSYEKKLDDTSQDTNHLTKQ
Sbjct:  330 GDRSLDTVFGGVSYEKKLDDTSQDTNHLTKQ                              360
```

Based on this analysis, it was predicted that this protein from *N. gonorrhoeae*, and its epitopes, could be useful antigens for vaccines or diagnostics.

EXAMPLE 120

A DNA sequence was identified in *N. gonorrhoeae* <SEQ ID 239> which encodes amino acid sequence <SEQ ID 240; NGS120>. Analysis of this protein sequence reveals the following:

GvH Examining signal sequence (von Heijne)
    Signal Score (−7.5): −7.24
    Possible cleavage site: 38
>>> Seems to have no N-terminal signal seq.
Amino Acid Composition of Predicted Mature Form:
    calculated from 1
ALOM: Finding transmembrane regions (Klein et al.)
    count: 0  value:  6.42  threshold:  0.0
    PERIPHERAL  Likelihood =  6.42
    modified ALOM score:  −1.78
Rule: cytoplasmic protein
*** Reasoning Step: 2
----- Final Results -----
    bacterial cytoplasm --- Certainty=
    0.280(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>

The protein has homology to the following sequences in the databases:

Based on this analysis, it was predicted that this protein from *N. gonorrhoeae*, and its epitopes, could be useful antigens for vaccines or diagnostics.

EXAMPLE 121

A DNA sequence was identified in *N. gonorrhoeae* <SEQ ID 241> which encodes amino acid sequence <SEQ ID 242; NGS121>. Analysis of this protein sequence reveals the following:

GvH Examining signal sequence (von Heijne)
    Signal Score (−7.5): −6.22
    Possible cleavage site: 37
>>> Seems to have no N-terminal signal seq.
Amino Acid Composition of Predicted Mature Form:
    calculated from 1
ALOM: Finding transmembrane regions (Klein et al.)
    count: 0  value:  3.23  threshold:  0.0
    PERIPHERAL  Likelihood =  3.23
    modified ALOM score:  −1.15
Rule: cytoplasmic protein
*** Reasoning Step: 2
----- Final Results -----
    bacterial cytoplasm --- Certainty=
    0.402(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>

The protein has homology to the following sequences in the databases:

```
^ **gsa_AAR91313 N. gonorrhoeae glycosyltransferase LgtC
|WO9610086-A1|09-JUL-1996
Length = 306
Score = 535 bits (1379), Expect = e-151
Identities = 252/253 (99%), Positives = 252/253 (99%)

Query:    8 GGGNIRFIDVNPEDFAGFPLNIRHISITTYARLKLGEYIADCDKVLYLDTDVLVRDGLKP   67
            GGGNIRFIDVNPEDFAGFPLNIRHISITTYARLKLGEYIADCDKVLYLDTDVLVRDGLKP
Sbjct:   54 GGGNIRFIDVNPEDFAGFPLNIRHISITTYARLKLGEYIADCDKVLYLDTDVLVRDGLKP  113

Query:   68 LWDTDLGGNWVGACIDLFVERQEGYKQKIGMADGEYYFNAGVLLINLKKWRRHDIFKMSC  127
            LWDTDLGGNWVGACIDLFVERQEGYKQKIGMADGEYYFNAGVLLINLKKWRRHDIFKMSC
Sbjct:  114 LWDTDLGGNWVGACIDLFVERQEGYKQKIGMADGEYYFNAGVLLINLKKWRRHDIFKMSC  173

Query:  128 EWVEQYKDVMQYQDQDILNGLFKGGVCYANSRFNFMPTNYAFMANGFASRHTDPLYLDRT  187
            EWVEQYKDVMQYQDQDILNGLFKGGVCYANSRFNFMPTNYAFMANGFASRHTDPLYLDRT
Sbjct:  174 EWVEQYKDVMQYQDQDILNGLFKGGVCYANSRFNFMPTNYAFMANGFASRHTDPLYLDRT  233

Query:  188 NTAMPVAVSHYCGSAKPWHRDCTVWGAERFTELAGSLTTVPEEWRGKLAVPPTKRMLQRW  247
            NTAMPVAVSHYCGSAKPWHRDCTVWGAERFTELAGSLTTVPEEWRGKLAVPPTKRMLQRW
Sbjct:  234 NTAMPVAVSHYCGSAKPWHRDCTVWGAERFTELAGSLTTVPEEWRGKLAVPPTKRMLQRW  293

Query:  248 RKKLSARFLRKIY                                                260
            RKKLSARFLRKIY
Sbjct:  294 RKKLSARFLRKIY                                                306
```

```
^ **gbp_15281345 gi|15281345|dbj|BAB63435.1|\(AB058945) DNA adenine
methylase M.Ssu4109IB [Streptococcus suis]
 Length = 271

Score = 269 bits (687), Expect = 4e-71
 Identities = 127/211 (60%), Positives = 158/211 (74%), Gaps = 1/211 (0%)

Query:    1 MIFADPPYFLSNDGFSCQNGQMVSVNKGNWDKSKGMAADLEFYEEWLRLCYALLKPNGTI    60
            MIFADPPYFLSN G S   GQ+VSV+KG+WDK   +    EF  +W+RL   +LKPNGTI
Sbjct:   44 MIFADPPYFLSNGGISNSGGQVVSVDKGDWDKVNSLEEKHEFNRKWIRLAKNVLKPNGTI   103

Query:   61 WVCGTFHNIYLIGYLMQTVGYHILNNITWEKPNPPPNLSCRFFTHSTETILWAKK-NKKA   119
            W+ G+FHNIY +G  ++   G+ ILNNITW+K NP PNLSCR+FTHSTETILWA+K +KKA
Sbjct:  104 WISGSFHNIYSVGMALEQEGFKILNNITWQKTNPAPNLSCRYFTHSTETILWARKDDKKA   163

Query:  120 KHTFHYEMMKAQNNGKQMKCVWTFAPPNKTEKTFGKHPTQKPLPLLERCILSASNIGDLI   179
            +H ++YE+MK  N+GKQMK VW         K+EK  GKHPTQKP  LLER IL+++  GD I
Sbjct:  164 RHYYNYELMKELNDGKQMKDVWVGGLTKKSEKWAGKHPTQKPEYLLERIILASTREGDYI   223

Query:  180 FDPFMGSGTTGVAALKHGRRFCGCELEEDFL                              210
            DPF+GSGTTGV A + GR+F G + E D+L
Sbjct:  224 LDPFVGSGTTGVVAKRLGRKFIGIDAERDYL                              254
```

Based on this analysis, it was predicted that this protein from N. gonorrhoeae, and its epitopes, could be useful antigens for vaccines or diagnostics.

EXAMPLE 122

A DNA sequence was identified in N. gonorrhoeae <SEQ ID 243> which encodes amino acid sequence <SEQ ID 244; NGS122>. Analysis of this protein sequence reveals the following:

GvH Examining signal sequence (von Heijne)
    Signal Score (−7.5): −2.55
    Possible cleavage site: 23
>>> May be a lipoprotein
Amino Acid Composition of Predicted Mature Form:
    calculated from 15
ALOM: Finding transmembrane regions (Klein et al.)
    count: 0   value: 11.46   threshold: 0.0
    PERIPHERAL Likelihood = 11.46
    modified ALOM score: −2.79
Rule: inner or outer membrane protein
Rule: inner or outer membrane protein
*** Reasoning Step: 2
Lipoprotein?
Inner membrane?
----- Final Results -----
    bacterial outer membrane --- Certainty= 0.790(Affirmative)
      < succ>
    bacterial inner membrane --- Certainty= 0.700(Affirmative)
      < succ>
    bacterial periplasmic space --- Certainty= 0.000(Not Clear) < succ>
      bacterial cytoplasm --- Certainty= 0.000(Not Clear) < succ>

The protein has no homology to sequences in the databases:

The protein was expressed in E. coli as an insoluble 14.85 kDa His-fusion product and then purified.

Based on this analysis, it was predicted that this protein from N. gonorrhoeae, and its epitopes, could be useful antigens for vaccines or diagnostics.

EXAMPLE 123

A DNA sequence was identified in N. gonorrhoeae <SEQ ID 245> which encodes amino acid sequence <SEQ ID 246; NGS123>. Analysis of this protein sequence reveals the following:

GvH Examining signal sequence (von Heijne)
    Signal Score (−7.5): −5.65
    Possible cleavage site: 20
>>> Seems to have no N-terminal signal seq.
Amino Acid Composition of Predicted Mature Form:
    calculated from 1
ALOM: Finding transmembrane regions (Klein et al.)
    count: 0   value: 4.24   threshold: 0.0
    PERIPHERAL Likelihood = 4.24
    modified ALOM score: −1.35
Rule: cytoplasmic protein
*** Reasoning Step: 2
----- Final Results -----
    bacterial cytoplasm --- Certainty= 0.404(Affirmative) < succ>
    bacterial periplasmic space --- Certainty= 0.000(Not Clear) < succ>
    bacterial outer membrane --- Certainty= 0.000(Not Clear)
      < succ>
    bacterial inner membrane --- Certainty= 0.000(Not Clear)
      < succ>

The protein has no homology to the sequences in the databases.

Based on this analysis, it was predicted that this protein from N. gonorrhoeae, and its epitopes, could be useful antigens for vaccines or diagnostics.

EXAMPLE 124

A DNA sequence was identified in N. gonorrhoeae <SEQ ID 247> which encodes amino acid sequence <SEQ ID 248; NGS124>. Analysis of this protein sequence reveals the following:

GvH Examining signal sequence (von Heijne)
    Signal Score (−7.5): −5
    Possible cleavage site: 18
>>> Seems to have no N-terminal signal seq.
Amino Acid Composition of Predicted Mature Form:
    calculated from 1
ALOM: Finding transmembrane regions (Klein et al.)
    count: 1   value: −1.59   threshold: 0.0
    INTEGRAL   Likelihood = −1.59   Transmembrane 289-305 (289-305)
    PERIPHERAL   Likelihood = 3.76
    modified ALOM score: 0.82
Rule: cytoplasmic membrane protein
*** Reasoning Step: 2
----- Final Results -----
    bacterial inner membrane --- Certainty= 0.164(Affirmative)
      < succ>
    bacterial periplasmic space --- Certainty= 0.000(Not Clear) < succ>
    bacterial outer membrane --- Certainty= 0.000(Not Clear)
      < succ>
        bacterial cytoplasm --- Certainty= 0.000(Not Clear)
          < succ>

The protein has homology to the following sequences in the databases:

```
^ **gbp_1617515 gi|1617515|gb|AAC82509.1|\(U365994) pilin gene inverting
protein homolog PivNG [Neisseria gonorrhoeae]
Length = 320
Score = 614 bits (1584), Expect = e-175
Identities = 311/320 (97%), Positivies = 316/320 (98%)

Query:    1 MRNTVGLDISKLTFDATAMVGKTEHSAKFDNDSKGLDQFSDRLKSLGYQNLHICMEATGS   60
            MRN VGLDISKLTF+A+AMVGKTEHSAKFDNDSKGLDQFSDRLKSLG QNLHICMEATG+
Sbjct:    1 MRNAVGLDISKLTFNASAMVGKTEHSAKFDNDSKGLDQFSDRLKSLGCQNLHICMEATGS   60

Query:   61 YYEEVADYFAQYYSVYVVNPLKISKYAESRFKRTKTDKQDAKLIAQYCRSAQESELVKRQ  120
            YYEEVADYFAQYYSVYVVNPLKISKYAESRFKRTKTDKQDAKLIAQYCR A+ESELVKRQ
Sbjct:   61 YYEEVADYFAQYYSVYVVNPLKISKYAESRFKRTKTDKQDAKLIAQYCRLAKESELVKRQ  120

Query:  121 KPTDEQYRLSRMTAAYAKIKSECAAMKNRHHAAKDEEAAKAYAEIIKAMNEQLEVLKEKI  180
            KPTDEQYRL RMTAAYAKIKSECAAMKNRHHAAKDEEAAKAYA+IIKAMNEQLEVLKEKI
Sbjct:  121 KPTDEQYRLLRMTAAYAKIKSECAAMKNRHHAAKDEEAAKAYAQIIKAMNEQLEVLKEKI  180

Query:  181 KEQTEKPNCKEGVKRLETIPAIGRMTAAVLFHHLTSSKFETSNKFAAFAGLSPQQKESGT  240
            KEQTEKPNCKEGVKRLETIPAIGRMTAAVLFHHLTSSKFETSNKFAAFAGLSPQQKESGT
Sbjct:  181 KEQTEKPNCKEGVKRLETIPAIGRMTAAVLFHHLTSSKFETSNKFAAFAGLSPQQKESGT  240

Query:  241 SVRGKGKLTKFGNRKLRAVLFMPAMVAVYRIRAFPDFIKRLEEKKKPKKVIIAALMRKLAV 300
            SVRGKGKLTKFGNRKLRAVLFMPAMVAVYRIRAFPDFIKRLEEKKKPKKVIIAALMRKLAV
Sbjct:  241 SVRGKGKLTKFGNRKLRAVLFMPAMVAVYRIRAFPDFIKRLEEKKKPKKVIIAALMRKLAV 300

Query:  301 IAYHVHKKGGDYDPSRYKSA                                         320
            IAYHVHKKGGDYDPSRYKSA
Sbjct:  301 IAYHVHKKGGDYDPSRYKSA                                         320
```

Based on this analysis, it was predicted that this protein from *N. gonorrhoeae*, and its epitopes, could be useful antigens for vaccines or diagnostics.

EXAMPLE 125

A DNA sequence was identified in *N. gonorrhoeae* <SEQ ID 249> which encodes amino acid sequence <SEQ ID 250; NGS127>. Analysis of this protein sequence reveals the following:

GvH Examining signal sequence (von Heijne)
    Signal Score (-7.5): -5.8
    Possible cleavage site: 52
>>> Seems to have no N-terminal signal seq.

-continued

Amino Acid Composition of Predicted Mature Form:
    calculated from 1
ALOM: Finding transmembrane regions (Klein et al.)
    count: 0    value: 1.70    threshold:    0.0
    PERIPHERAL Likelihood = 1.70
    modified ALOM score:    −0.84
Rule: cytoplasmic protein
*** Reasoning Step: 2
----- Final Results -----
    bacterial cytoplasm --- Certainty= 0.383(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

The protein has homology to the following sequences in the databases:

```
^ **gbp_1076012 gi|1076012|pir||B55225 stress-sensitive restriction
system protein 2-Corynebacterium glutamicum (ATCC 13032)
gb|AAC00044.1|(U13922) This orf may encode a typeI or typeIII restriction
endonuclease which is stress-sensitive and ATP-dependent. It contains a
typical ATP binding region (Walker motif) [Corynebacterium glutamicum]
Length = 632
Score = 298 bits (764), Expect = 2e-79
Identities = 199/633 (31%), Positives = 321/633 (50%), Gaps = 32/633 (5%)

Query:    2 LRTYLNQLTP-PELADSVKNTVDGFMEKLSQTEPKIA-QNVLLLGNVQSGKTAQVLGVLS   59
            L Y +    +L + V  TVD F   +      I+ Q VLL G+VQSGKT+ +LG++++
Sbjct:    7 LNNYITSLSDNADLREKVTATVDAFRHTVMDDFDYISDQQVLLYGDVQSGKTSHMLGIIA   66

Query:   60 ALADDGDHKVFLYLTTDSVDLQDQTVKRAKANLKNFIVLSEADDRSFMEVMKAENP--IL  117
              D   H +  LT+ +   L  QT  R          + V        F   K+ P   +
Sbjct:   67 DCLDSTFHTIVI-LTSPNTRLVQQTYDRVAQAFPDTLVCDRDGYNDFRANQKSLTPRKSI  125

Query:  118 VVIKKNARVLKRWRNLFASQSSLKGYPLVIVDDEADAASLNTNSDKPKDASTINKLLND  177
            VV+ K   VL W +F   +L G+P++I+DDEADA SLNT ++   D STIN  L
Sbjct:  126 VVVGKIPAVLGNWLRVFNDSGALSGHPVLIIDDEADATSLNTKVNQ--SDVSTINHQLTS 183
```

```
                                                -continued
Query:  178 IKNSCCQSLPIQLTATPQSLLLQHEESDWQPEFIHFFEAGEKYIGGNFVFSDPPS-YIVR  236
            I++       +++Q+T TPQ++LLQ ++S+W  E +  F   GE YIGG  FS+  + Y+
Sbjct:  184 IRDLATGCIYLQVTGTPQAVLLQSDDSNWAAEHVLHFAPGESYIGGQLFFSELNNPYLRL  243

Query:  237 FIDSELDDMKDESGEIAEGAKQALLSFLITCAEFALCDKANCNFALHPSYKIQDHQAFSK  296
            F +++ D+    S        A+ ++L+T A F L  ++ C    +HPS+     H+ F++
Sbjct:  244 FANTQFDEDSRFS--------DAIYTYLLTAALFLRGESLCTMLIHPSHTASSHRDFAQ  295

Query:  297 KIQAFLNDLVQAVNNGEDLAGSFKESYLDLQKTKPDIHHFDEIYEKLTALLENKQISTLV  356
            + +  L   +          +  +F+ +Y  L +T  ++     +I    L  + ++ I     +
Sbjct:  296 EARLQLTFAFERFYEPM-IQHNFQRAYEQLAQTDSNLPPLRKILNILGGMEDDFSIH--I  352

Query:  357 VNSQTET-DFDLEKGFNIIIGGNVIGRGLTIPKLQTVYYSRTAKKPNADTFWQHRIFGY   415
            VNS   T + D   G+NII+GGN +GRGLT    LQTV+Y R +K+P ADT WQH+R+FGY
Sbjct:  353 VNSDNPTVEEDWADGYNIIVGGNSLGRGLTFNNLQTVFYVRESKRPQADTLWQHARMFGY  412

Query:  416 DRDKSLLRLYIPFDVYYFFVQLNQANNLIIGQAKNSG--GNIQVIYPKNINPTRKNVLKF  473
            R K  +R+++P  +   F ++       N  I  Q +      +I+VI    + PTR NVL
Sbjct:  413 KRHKDTMRVFMPATIAQTFQEVYLGNEAIKNQLDHGTHINDIRVILGDGVAPTRANVLDK  472

Query:  474 DSINQIVGGVNYFPLHPNEDNLSEINKILPSILKDEIQSDLYQIDIEDLFLVLDKLGRYV  533
             +  +  GGVNYF   P   N+ ++K L + L    +       I + +   +L+
Sbjct:  473 RKVGNLSGGVNYFAADPRIIKNVEALDKKLLAYLDKHGEDS--TIGMRAIITILNAF-TVD  529

Query:  534 PDDWNKEKFIAGVEALKAQRPSFKTYVLIKTGRKLSRATGTMLSEDDRKLGEKYPNDLFL  593
            P+D +      F A +   +P       ++++T RK+++ TG +LS   D+ L             L
Sbjct:  530 PNLDLDLATFKAALLDFERNQPHLTARMVLRTNRKVNQGTGALLSPTDQALSRAEVAHPLL  589

Query:  594 TLYQVVGNKDKG-------WQGKDFWLPNIKLP                            619
            LY++  G   D        W    W+PNIKLP
Sbjct:  590 ILYRIEGVNDAAAQRGEPTWSSDPIWVPNIKLP                            622
```

Based on this analysis, it was predicted that this protein from *N. gonorrhoeae*, and its epitopes, could be useful antigens for vaccines or diagnostics.

EXAMPLE 126

A DNA sequence was identified in *N. gonorrhoeae* <SEQ ID 251> which encodes amino acid sequence <SEQ ID 252; NGS128>. Analysis of this protein sequence reveals the following:

GvH Examining signal sequence (von Heijne)
    Signal Score (−7.5): −4.98
    Possible cleavage site: 20
>>> Seems to have no N-terminal signal seq.

-continued

Amino Acid Composition of Predicted Mature Form:
    calculated from 1
ALOM: Finding transmembrane regions (Klein et al.)
    count: 0  value:  7.37  threshold:    0.0
    PERIPHERAL Likelihood = 7.37
    modified ALOM score: −1.97
Rule: cytoplasmic protein
*** Reasoning Step: 2
----- Final Results -----
    bacterial cytoplasm --- Certainty= 0.225(Affirmative) < succ>
    bacterial periplasmic space --- Certainty= 0.000(Not Clear) < succ>
    bacterial outer membrane --- Certainty= 0.000(Not Clear) < succ>
    bacterial inner membrane --- Certainty= 0.000(Not Clear) < succ>

The protein has homology to the following sequences in the databases:

```
^ **gbp_11357195 gi|11387195|sp|Q50976|T2F7_NEIGO TYPE II RESTRICTION
ENZYME NGOFVII (ENDONUCLEASE NGOFVII) (R.NGOFVII) (R.NGOVII)
pir||T10166 restriction endonuclease (EC 3.1.21.-) NgoVII-N. gonorrhoeae
gb|AAA86271.1|(U43736) R.NgoVII [Neisseria gonorrhoeae]
Length = 326
Score = 651 bits (1679), Expect = 0.0
Identities = 317/326 (97%), Positives = 320/326 (97%)

Query:    1 MNTVFSNIANAKITEKSLNAVWMDLFKSADEVLMATGYVSNDAVVELHKILELNDHIQKI   60
            MNTVFSNIANAKITEKSLNAVWMDLFKSADEVLMATGYVSNDAVVELHKILELNDHIQKI
Sbjct:    1 MNTVFSNIANAKITEKSLNAVWMDLFKSADEVLMATGYVSNDAVVELHKILELNDHIQKI   60

Query:   61 DLLVGMHYLEGFSHLQYDSLCKLNDFLRHEKRGAVYVSPFVKFHGKMYSFKNYQKINGLI  120
            DLLVGMHYLEGFSHLQYDSLCKLNDFLRHEKRGAVYVSPFVKFHGKMYSFKNYQKINGLI
Sbjct:   61 DLLVGMHYLEGFSHLQYDSLCKLNDFLRHEKRGAVYVSPFVKFHGKMYSFKNYQKINGLI  120

Query:  121 GSANLTCFWDSTERTYETMLHLNGKPAQILQADIQSTIHKLGKNIQEVERPSKFIEHNSH  180
            GSANLTCFWDSTERTYETMLHLNGKPAQILQADIQSTIHKLGKNIQEVERPSKFIEHNSH
Sbjct:  121 GSANLTCFWDSTERTYETMLHLNGKPAQILQADIQSTIHKLGKNIQEVERPSKFIEHNSH  180

Query:  181 LENCLGVQKIAPEQIRQLFAQTSEYHFSIPAKTEEKSNLNVFFGEGRRDKRGFVKPRPWY  240
            LENCLGVQKIAPEQIRQLFAQTSEYHFSIPAKTEEKSNLNVFFGEGRRDKRGFVKPRPWY
Sbjct:  181 LENCLGVQKIAPEQIRQLFAQTSEYHFSIPAKTEEKSNLNVFFGEGRRDKRGFVKPRPWY  240
```

-continued

```
Query: 241 EVELIVSKDITSQEGYPVLKSFTVITDDGWQFQCKTSGDYSKNFRSENDLKTLGKWIKGR 300
           EVELIVSKDITSQEGYPVLKSFTVITDDGWQFQCKTSGDYSK  + +LKTLGKWIKGR
Sbjct: 241 EVELIVSKDITSQEGYPVLKSFTVITDDGWQFQCKTSGDYSKTSTQKMNLKTLGKWIKGR 300

Query: 301 LESHGCLQNNEKITHETLREYGNDHF                                   326
           LESHGCLQNNEKITHETLREYGN+ F
Sbjct: 301 LESHGCLQNNEKITHETLREYGNESF                                   326
```

Based on this analysis, it was predicted that this protein from *N. gonorrhoeae*, and its epitopes, could be useful antigens for vaccines or diagnostics.

EXAMPLE 127

A DNA sequence was identified in *N. gonorrhoeae* <SEQ ID 253> which encodes amino acid sequence <SEQ ID 254; NGS 129>. Analysis of this protein sequence reveals the following:

---

GvH Examining signal sequence (von Heijne)
   Signal Score (−7.5): −5.5
   Possible cleavage site: 48
   >>> Seems to have no N-terminal signal seq.
Amino Acid Composition of Predicted Mature Form:
   calculated from 1
ALOM: Finding transmembrane regions (Klein et al.)
   count: 0   value: 10.03   threshold: 0.0
   PERIPHERAL Likelihood = 10.03
   modified ALOM score: −2.51
Rule: cytoplasmic protein
*** Reasoning Step: 2
----- Final Results -----
   bacterial cytoplasm --- Certainty= 0.545(Affirmative) < succ>

-continued bacterial periplasmic space --- Certainty= 0.000(Not Clear) < succ>
   bacterial outer membrane --- Certainty= 0.000(Not Clear) < succ>
   bacterial inner membrane --- Certainty= 0.000(Not Clear) < succ>

---

The protein has homology to the following sequences in the databases:

```
^ **gbp_15804186 gi|15804186|ref|NP_290225.1|\(NC_002655) DNA-damage-
inducible protein [Escherichia coli O157:H7 EDL933]
ref|NP_312547.1|(NC_002695) DNA-damage-inducible protein [Escherichia coli
O157:H7]
gb|AAG58789.1|AE005591_13 (AE005591) DNA-damage-inducible protein
[Escherichia coli O157:H7 EDL933]
dbj|BAB37943.1|(AP002566) DNA-damage-inducible protein [Escherichia coli
O157:H7]
Length = 278
Score = 340 bits (872), Expect = 2e-92
Identities = 161/266 (60%), Positives = 197/266 (73%)

Query:   1 MTTENNAFENAKHIDETGNEYWSARTLQQILEYSEWRNFQRAIDKAITACETSGNDKNHH  60
           M   + FE +H   G E+WSAR L  +L+Y +WRNFQ+  +A  ACE  S   + H
Sbjct:   5 MNEHQPFEEIRHYGTEGQEFWSARELAPLLDYRDWRNFQKVLAPATQACEASNQAASDH  64

Query:  61 FVETNKMIALGKGGQREVADYRLSRYACYLIVQNGDPSKSVIAAGQTYFAVQARRQELQD 120
           FVET KM+LG G QRE+ D  LSRYACYL+VQNGDP+K VIAAGQTYFA+Q RRQEL D
Sbjct:  65 FVETTKMVVLGSGAQRELEDVHLSRYACYLVVQNGDPAKPVIAAGQTYFAIQTRRQELAD 124

Query: 121 EAAFRSLGEDKQRLLLRRQLREHNTDLAAAAKDAGVEKPVEYAVFQNHGYRGLYGGLDKQ 180
           + AF+ L ED++RL LR +L+EHN   L  AA+ A V      ++A+FQNHGY+GLYGGLD++
Sbjct: 125 DEAFKQLREDEKRLFLRNELKEHNKQLVEAAQQAAVATATDFAIFQNHGYQGLYGGLDQK 184

Query: 181 GIHSPRGLKKSQRILDHMNASEPAANLFRATQTEEKLRRKNIQGKTQANRVHFEVGQKVR 240
              IH   KGLKKSQ+ILDHM ++E AANLFRATQTEEKL+R   + K QAN  HF+VG KVR
Sbjct: 185 AIEQLKGLKKSQKILDHMGSTELAANLFRATQTEEKLKRDGVNSKQQANTTHFDVGSKVR 244

Query: 241 QTIEELGGIMPENQPVPEKSIKQLEN                                  266
           QTI+ELGG MPE  P P+ SIKQLEN
Sbjct: 245 QTIQELGGTMPEELPTPQVSIKQLEN                                  270
```

Based on this analysis, it was predicted that this protein from *N. gonorrhoeae*, and its epitopes, could be useful antigens for vaccines or diagnostics.

EXAMPLE 128

A DNA sequence was identified in *N. gonorrhoeae* <SEQ ID 255> which encodes amino acid sequence <SEQ ID 256; NGS130>. Analysis of this protein sequence reveals the following:

---

GvH Examining signal sequence (von Heijne)
   Signal Score (−7.5): −3.68
   Possible cleavage site: 14

-continued

>>> Seems to have an uncleavable N-term signal seq
Amino Acid Composition of Predicted Mature Form:
    calculated from 1
ALOM: Finding transmembrane regions (Klein et al.)
    count: 3   value:  −3.45  threshold:    0.0
    INTEGRAL     Likelihood = −3.45 Transmembrane 68-84 (68-92)
    INTEGRAL     Likelihood = −1.59 Transmembrane 10-26 (10-26)
    INTEGRAL     Likelihood = −1.44 Transmembrane 46-62 (45-62)
    PERIPHERAL   Likelihood =  1.48
    modified ALOM score:  1.19
Rule: cytoplasmic membrane protein
*** Reasoning Step: 2
----- Final Results -----
        bacterial inner membrane --- Certainty= 0.238(Affirmative)
        < succ>
        bacterial periplasmic space --- Certainty= 0.000(Not Clear) < succ>
        bacterial outer membrane --- Certainty= 0.000(Not Clear)
        < succ>
            bacterial cytoplasm --- Certainty= 0.000(Not Clear) < succ>

GvH Examining signal sequence (von Heijne)
    Signal Score (−7.5): −1.65
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 0   value:  7.05  threshold:    0.0
    PERIPHERAL Likelihood = 7.05
    modified ALOM score:  −1.91
Rule: cytoplasmic protein
*** Reasoning Step: 2
----- Final Results -----
        bacterial cytoplasm --- Certainty= 0.152(Affirmative)
        < succ>
        bacterial periplasmic space --- Certainty= 0.000(Not Clear) < succ>
            bacterial outer membrane --- Certainty= 0.000(Not Clear)
            < succ>
            bacterial inner membrane --- Certainty= 0.000(Not Clear)
            < succ>

The protein has homology to the following sequences in the databases:

The protein has homology to the following sequences in the databases:

```
^ **gbp_17988861 gi|17998861|ref|NP_541494.1|\(NC_003318) hypothetical
protein [Brucella melitensis]
gb|AAL53758.1|(AE009687) hypothetical protein [Brucella melitensis]
Length = 99
Score = 108 bits (270), Expect = 3e-23
Identities = 59/91 (64%), Positives = 69/91 (74%)

Query:  11 LLFSCMLAVTCPTRLIGFFALRNRTLSRRAQTVMEAAPGCVLISVIAPYFVSDKPHELIA    70
           L    M +VT  TR+ G+  LRNRTLS RA  VMEAAPGCVLISVIAP FVSDKP  LIA
Sbjct:   8 LTILAMASVTYLTRIGGYVLLRNRTLSNRAMAVMEAAPGCVLISVIAPDFVSDKPANLIA    67

Query:  71 IALTAFAACRFSMLFTVLIGVGSSGISGWLM                              101
           +A+T FAA RFSML TVLIG+G++ I  +L+
Sbjct:   6 LAVTVFAATRFSMLPTVLIGMGAASICRYLI                               98
```

Based on this analysis, it was predicted that this protein from *N. gonorrhoeae*, and its epitopes, could be useful antigens for vaccines or diagnostics.

EXAMPLE 129

A DNA sequence was identified in *N. gonorrhoeae* <SEQ ID 257> which encodes amino acid sequence <SEQ ID 258; NGS131>. Analysis of this protein sequence reveals the following:

```
^ **gbp_16760390 gi|16760390|ref NP_456007.1|\(NC_003198) hypothetical
protein [Salmonella enterica subsp. enterica serovar Typhi]
emb|CAD01841.1|(AL621270) hypothetical protein [Salmonella enterica subsp.
enterica serovar Typhi]
Length = 227
Score = 104 bits (259), Expect = 2e-21
Identities = 68/221 (30%), Positivies = 115/221 (51%), Gaps = 11/221 (4%)

Query:    2 DKEKVLDKIKKCLALGRSVNEHEAAQALRQAQALMEKYKVNAEDIALSKVSEQKAD--RK    59
            D++K ++K+KK LAL   S N HEAA ALR+A+ LM+ + +   DIA+S + E   +
Sbjct:    3 DQDKHIEKLKKLLALAASGNPHEAALALRRARKLMDVHGITHSDIAMSDIDETISHYWPT    62

Query:   60 MAFKLAGWQWGVANMIADIFGCKSYQRGKT---MMFYGIGNRAETSAYAFDVVYRQISAD   116
             +  +    + G+ N+I + FG  S       T  + FYG  RA  +AY ++V+ RQ+
Sbjct:   63 GSLRPPRYMLGLMNIIREAFGVNSIIHPGTYPGVGFYGNRERAALAAYTWEVLARQLKKA   122

Query:  117 RRKFLKT-CRAGKPSHRTYLADPFCGGWIASAWETVKKFEMSDEEKAIMDGYKKKEYPDM   175
            R++++    +  K + RT  D+F  GW+ +     ++ F ++D+E+ +M  +  + +YP
Sbjct:  123 RQQYISAQNKRIKTATRTSRGDQFAEGWVLAVISEIQSFALTDDERELMQQWLEHKYPQT   182

Query:  176 AEARTRDAKSSILQGSKMEYEALTRGMESGKQVKLHYAVNG                     216
             R R    S     G   Y    G    G+  V+LH  V+G
Sbjct:  183 QTTRARKPGRS-RNGDASRY----AGFREGQNVRLHRPVSG                     218
```

Based on this analysis, it was predicted that this protein from *N. gonorrhoeae*, and its epitopes, could be useful antigens for vaccines or diagnostics.

EXAMPLE 130

A DNA sequence was identified in *N. gonorrhoeae* <SEQ ID 259> which encodes amino acid sequence <SEQ ID 260; NGS132>. Analysis of this protein sequence reveals the following:

```
GvH Examining signal sequence (von Heijne)
    Signal Score (-7.5): -4.06
    Possible cleavage site: 30
>>> Seems to have no N-terminal signal seq.
Amino Acid Composition of Predicted Mature Form:
    calculated from 1
ALOM: Finding transmembrane regions (Klein et al.)
    count: 0   value:   2.49 threshold:      0.0
    PERIPHERAL Likelihood = 2.49
    modified ALOM score:   -1.00
Rule: cytoplasmic protein
*** Reasoning Step: 2
----- Final Results -----
        bacterial cytoplasm --- Certainty= 0.075(Affirmative)
          < succ>
    bacterial periplasmic space --- Certainty= 0.000(Not Clear) < succ>
        bacterial outer membrane --- Certainty= 0.000(Not Clear)
          < succ>
        bacterial inner membrane --- Certainty= 0.000(Not Clear)
          < succ>
```

The protein has no homology to sequences in the databases.

Based on this analysis, it was predicted that this protein from *N. gonorrhoeae*, and its epitopes, could be useful antigens for vaccines or diagnostics.

EXAMPLE 131

A DNA sequence was identified in *N. gonorrhoeae* <SEQ ID 261> which encodes amino acid sequence <SEQ ID 262; NGS133>. Analysis of this protein sequence reveals the following:

```
GvH Examining signal sequence (von Heijne)
    Signal Score (-7.5): 1.64
    Possible cleavage site: 53
>>> Seems to have no N-terminal signal seq.
Amino Acid Composition of Predicted Mature Form:
    calculated from 1
ALOM: Finding transmembrane regions (Klein et al.)
    count: 0   value:   3.82 threshold:      0.0
    PERIPHERAL Likelihood = 3.82
    modified ALOM score:   -1.26
Rule: cytoplasmic protein
*** Reasoning Step: 2
----- Final Results -----
        bacterial cytoplasm --- Certainty= 0.068(Affirmative)
          < succ>
    bacterial periplasmic space --- Certainty= 0.000(Not Clear) < succ>
        bacterial outer membrane --- Certainty= 0.000(Not Clear)
          < succ>
        bacterial inner membrane --- Certainty= 0.000(Not Clear)
          < succ>
```

The protein has no homology to the following sequences in the databases:

Based on this analysis, it was predicted that this protein from *N. gonorrhoeae*, and its epitopes, could be useful antigens for vaccines or diagnostics.

EXAMPLE 132

A DNA sequence was identified in *N. gonorrhoeae* <SEQ ID 263> which encodes amino acid sequence <SEQ ID 264; NGS135>. Analysis of this protein sequence reveals the following:

```
GvH Examining signal sequence (von Heijne)
    Signal Score (-7.5): -4.67
    Possible cleavage site: 39
>>> Seems to have no N-terminal signal seq.
Amino Acid Composition of Predicted Mature Form:
    calculated from 1
ALOM: Finding transmembrane regions (Klein et al.)
    count: 0   value:   5.52 threshold:      0.0
    PERIPHERAL Likelihood = 5.52
    modified ALOM score:   -1.60
Rule: cytoplasmic protein
*** Reasoning Step: 2
----- Final Results -----
        bacterial cytoplasm --- Certainty= 0.457(Affirmative)
          < succ>
    bacterial periplasmic space --- Certainty= 0.000(Not Clear) < succ>
        bacterial outer membrane --- Certainty= 0.000(Not Clear)
          < succ>
        bacterial inner membrane --- Certainty= 0.000(Not Clear)
          < succ>
```

The protein has no homology to sequences in the databases:

Based on this analysis, it was predicted that this protein from *N. gonorrhoeae*, and its epitopes, could be useful antigens for vaccines or diagnostics.

EXAMPLE 133

A DNA sequence was identified in *N. gonorrhoeae* <SEQ ID 265> which encodes amino acid sequence <SEQ ID 266; NGS136>. Analysis of this protein sequence reveals the following:

```
GvH Examining signal sequence (von Heijne)
    Signal Score (-7.5): -3.97
    Possible cleavage site: 15
>>> Seems to have no N-terminal signal seq.
Amino Acid Composition of Predicted Mature Form:
    calculated from 1
ALOM: Finding transmembrane regions (Klein et al.)
    count: 0   value:  11.35 threshold:      0.0
    PERIPHERAL Likelihood = 11.35
    modified ALOM score:   -2.77
Rule: cytoplasmic protein
*** Reasoning Step: 2
----- Final Results -----
        bacterial cytoplasm --- Certainty= 0.523(Affirmative)
          < succ>
    bacterial periplasmic space --- Certainty= 0.000(Not Clear) < succ>
        bacterial outer membrane --- Certainty= 0.000(Not Clear)
          < succ>
        bacterial inner membrane --- Certainty= 0.000(Not Clear)
          < succ>
```

The protein has no homology to sequences in the databases:

Based on this analysis, it was predicted that this protein from *N. gonorrhoeae*, and its epitopes, could be useful antigens for vaccines or diagnostics.

EXAMPLE 134

A DNA sequence was identified in *N. gonorrhoeae* <SEQ ID 267> which encodes amino acid sequence <SEQ ID 268; NGS 137>. Analysis of this protein sequence reveals the following:

```
GvH Examining signal sequence (von Heijne)
    Signal Score (-7.5): -8.52
    Possible cleavage site: 51
>>> Seems to have no N-terminal signal seq.
Amino Acid Composition of Predicted Mature Form:
    calculated from 1
ALOM: Finding transmembrane regions (Klein et al.)
    count: 0   value:   2.81 threshold:     0.0
    PERIPHERAL Likelihood = 2.81
    modified ALOM score:   -1.06
Rule: cytoplasmic protein
*** Reasoning Step: 2
----- Final Results -----
            bacterial cytoplasm --- Certainty= 0.374(Affirmative)
            < succ>
    bacterial periplasmic space --- Certainty= 0.000(Not Clear) < succ>
        bacterial outer membrane --- Certainty= 0.000(Not Clear)
```

```
GvH Examining signal sequence (von Heijne)
    Signal Score (-7.5): -7
    Possible cleavage site: 36
>>> Seems to have no N-terminal signal seq.
Amino Acid Composition of Predicted Mature Form:
    calculated from 1
ALOM: Finding transmembrane regions (Klein et al.)
    count: 0   value:   10.66 threshold:     0.0
    PERIPHERAL Likelihood = 10.66
    modified ALOM score:   -2.63
Rule: cytoplasmic protein
*** Reasoning Step: 2
----- Final Results -----
            bacterial cytoplasm --- Certainty= 0.415(Affirmative)
            < succ>
    bacterial periplasmic space --- Certainty= 0.000(Not Clear) < succ>
        bacterial outer membrane --- Certainty= 0.000(Not Clear)
        < succ>
        bacterial inner membrane --- Certainty= 0.000(Not Clear)
        < succ>
```

The protein has homology to the following sequences in the databases:

```
^ **gbp_13559865 gi|13559865|ref|NP_112075.1|\(NC_002730) terminase small
subunit [Bacteriophage HK620]
gb|AAK28890.1|AF335538_42 (AF335538) terminase small subunit
[Bacteriophage HK620]
Length = 140
Score = 125 bits (313), Expect = 5e-28
Identities = 56/122 (45%), Positivies = 85/122 (68%)

Query:   4 TKRKLGRPTDYTKDMADKICEKIANGRSLRSICAEDGVPPMKTIYRWLEANEEFRHQYAR  63
           T+ K GRP+DY ++AD IC +++G SL +C   G+P   T++RWL  +E+FR +YA+
Sbjct:   3 TEPKAGRPSDYMPEVADDICSLLSSGESLLKVCKRPGMPDKSTVFRWLAKHEDFRDKYAK  62

Query:  64 AREKQADYFAEEIIEIADSAQAE-                                    125
           SAAVSKAKLQIDARKWAASKIAPKKYGDKSELDVKSGDG
           A E +AD     EEI EIAD+A  ++A V+KA+L++D RKWA +++ P+KYGDK  ++    DG
Sbjct:  63 ATEARADSIFEEIFEIADNAIPDAAE-                                 124
           VAKARLRVDTRKWALARMNPRKYGDKVTNELVGKDG
```

-continued

```
        < succ>
        bacterial inner membrane --- Certainty= 0.000(Not Clear)
        < succ>
```

The protein has no homology to sequences in the databases.

Based on this analysis, it was predicted that this protein from *N. gonorrhoeae*, and its epitopes, could be useful antigens for vaccines or diagnostics.

EXAMPLE 135

A DNA sequence was identified in *N. gonorrhoeae* <SEQ ID 269> which encodes amino acid sequence <SEQ ID 270; NGS138>. Analysis of this protein sequence reveals the following:

Based on this analysis, it was predicted that this protein from *N. gonorrhoeae*, and its epitopes, could be useful antigens for vaccines or diagnostics.

EXAMPLE 136

A DNA sequence was identified in *N. gonorrhoeae* <SEQ ID 271> which encodes amino acid sequence <SEQ ID 272; NGS139>. Analysis of this protein sequence reveals the following:

```
GvH Examining signal sequence (von Heijne)
    Signal Score (-7.5): -1.49
    Possible cleavage site: 32
>>> Seems to have no N-terminal signal seq.
Amino Acid Composition of Predicted Mature Form:
    calculated from 1
ALOM: Finding transmembrane regions (Klein et al.)
    count: 0   value:   8.65 threshold:     0.0
    PERIPHERAL Likelihood = 8.65
    modified ALOM score:   -2.23
```

-continued

```
Rule: cytoplasmic protein
*** Reasoning Step: 2
----- Final Results -----
       bacterial cytoplasm --- Certainty= 0.301(Affirmative)
         < succ>
       bacterial periplasmic space --- Certainty= 0.000(Not Clear) < succ>
         bacterial outer membrane --- Certainty= 0.000(Not Clear)
         < succ>
         bacterial inner membrane --- Certainty= 0.000(Not Clear)
         < succ>
```

The protein has homology to the following sequences in the databases:

```
^ **gbp_16127009 gi|16127009|ref|NP_421573.1|\(NC_002696) hypothetical
protein [Caulobacter crescentus]
gb|AAK24741.1|(AE005943) hypothetical protein [Caulobacter crescentus]
Length = 184
Score = 59.7 bits (143), Expect = 4e-08
Identities = 50/164 (30%), Positives = 74/164 (44%), Gaps = 20/164 (12%)

Query:  30 ASGREFRTAYYTYPQWRFSLSFEVLRTKASVNELEKLAGFFNARKGSFESFLYEDPAD--   87
           ASG E RT+ ++ + R+ ++       ++E+ +L  FF AR+G    F + DPAD
Sbjct:   5 ASGHERRTSPWSQSRRRYLIA----TAPRPLDEIAELVAFFEARRGRLHGFRFRDPADFK   60

Query:  88 -------NAVTDQPVGNTVQGAR-YQLVRSMGGFIEPVSAVKERP-----AVKVGGTAL  134
                  A   DQ +G T  GV + +QL ++ G   E V+    +P       V V G   L
Sbjct:  61 SCAPSVQPAAGDQAIG-TGDGVRKKAFQLRKTYGAGGEAVARTIAKPVAGTVTVAVAGVVL  119

Query: 135 AYGRDYTVTDKGVLVFNTPQPPGRPITWTGGFYFRVRFTSDTVD                178
           A G           G++  NT  P G  +T   F   VRF  D +D
Sbjct: 120 APGAFAVDVTTGLITLNTAPPAGAAVTAGFAFDTPVRFDLDRLD                163
```

Based on this analysis, it was predicted that this protein from *N. gonorrhoeae*, and its epitopes, could be useful antigens for vaccines or diagnostics.

EXAMPLE 137

A DNA sequence was identified in *N. gonorrhoeae* <SEQ ID 273> which encodes amino acid sequence <SEQ ID 274; NGS140>. Analysis of this protein sequence reveals the following:

```
GvH Examining signal sequence (von Heijne)
    Signal Score (-7.5): -3.86
    Possible cleavage site: 31
>>> Seems to have no N-terminal signal seq.
Amino Acid Composition of Predicted Mature Form:
    calculated from 1
ALOM: Finding transmembrane regions (Klein et al.)
    count: 1   value: -4.94 threshold:  0.0
    INTEGRAL    Likelihood = -4.94    Transmembrane
                                      34-50 (31-54)
    PERIPHERAL  Likelihood = 8.01
    modified ALOM score:  1.49
Rule: cytoplasmic membrane protein
```

-continued

```
*** Reasoning Step: 2
----- Final Results -----
       bacterial inner membrane --- Certainty= 0.297(Affirmative)
         < succ>
       bacterial periplasmic space --- Certainty= 0.000(Not Clear) < succ>
         bacterial outer membrane --- Certainty= 0.000(Not Clear)
         < succ>
           bacterial cytoplasm --- Certainty= 0.000(Not Clear) < succ>
```

The protein has homology to the following sequences in the databases:

```
^ **gbp_17987625 gi|17987625|ref|NP_540259.1|\(NC_003317) Hypothetical
Phage Protein [Brucella melitensis]
gb|AAL52523.1|(AE009572) Hypothetical Phage Protein [Brucella
melitensis]
Length = 144
Score = 72.4 bits (176), Expect = 5e-12
Identities = 43/119 (36%), Positives = 64/119 (53%), Gaps = 7/119 (5%)

Query:  10 RIVEEARSWLGTPYHHHAMVKGAGVDCAMLLVAVYGAV-GLLPEGFDPRPYPQDWHLHRD   68
           R++  EA  W+GTPY H A   G   DC  L+  ++A+ G+ PE  +P  Y   DW
Sbjct:   6 RVLAEAHRWIGTPYRHGASTLGVSCDCLGVRQIWRALYGVEPE--NPGVYAPDWAEVSQ    63

Query:  69 CERYLGFVTQFC--RETESPQAGDIAV--WRFGRSFSHGGILAGGGKVIHSYIGRGVVS  123
           +    L   ++    RE  +PQ GD+    W+ G +  H GI+A   G+ IH+Y  G GV++
Sbjct:  64 GDPMLEAAVRYMVRREEHAPQPGDLLVFRWKPGFAAKHMGIMAREGRFIHAYQGHGVLA   122
```

Based on this analysis, it was predicted that this protein from *N. gonorrhoeae*, and its epitopes, could be useful antigens for vaccines or diagnostics.

EXAMPLE 138

A DNA sequence was identified in *N. gonorrhoeae* <SEQ ID 275> which encodes amino acid sequence <SEQ ID 276; NGS141>. Analysis of this protein sequence reveals the following:

```
GvH Examining signal sequence (von Heijne)
    Signal Score (-7.5): 5.35
    Possible cleavage site: 28
>>> Seems to have a cleavable N-term signal seq.
Amino Acid Composition of Predicted Mature Form:
    calculated from 29
ALOM: Finding transmembrane regions (Klein et al.)
    count: 0   value: 8.86 threshold:   0.0
    PERIPHERAL Likelihood = 8.86
    modified ALOM score:  -2.27
Score for OM-PP discrimination: 1.53
Rule: outer membrane or periplasmic protein
Score for OM-PP discrimination: 1.53
Rule: outer membrane or periplasmic protein
*** Reasoning Step: 2
Outer membrane?   Score: 0.152929
Outer membrane?   Score: 0.152929
----- Final Results -----
    bacterial outer membrane --- Certainty= 0.512(Affirmative)
        < succ >
    bacterial periplasmic space --- Certainty= 0.320(Affirmative) < succ >
        bacterial inner membrane --- Certainty= 0.000(Not Clear)
        < succ >
            bacterial cytoplasm --- Certainty= 0.000(Not Clear)
                < succ >
```

The protein has homology to the following sequences in the databases:

Based on this analysis, it was predicted that this protein from *N. gonorrhoeae*, and its epitopes, could be useful antigens for vaccines or diagnostics.

EXAMPLE 139

A DNA sequence was identified in *N. gonorrhoeae* <SEQ ID 277> which encodes amino acid sequence <SEQ ID 278; NGS142>. Analysis of this protein sequence reveals the following:

```
GvH Examining signal sequence (von Heijne)
    Signal Score (-7.5): -0.49
    Possible cleavage site: 22
>>> Seems to have no N-terminal signal seq.
Amino Acid Composition of Predicted Mature Form:
    calculated from 1
ALOM: Finding transmembrane regions (Klein et al.)
    count: 0   value: 1.22 threshold:   0.0
    PERIPHERAL Likelihood = 1.22
    modified ALOM score:  -0.74
Rule: cytoplasmic protein
*** Reasoning Step: 2
----- Final Results -----
    bacterial cytoplasm --- Certainty= 0.145(Affirmative)
        < succ >
    bacterial periplasmic space --- Certainty= 0.000(Not Clear) < succ >
        bacterial outer membrane --- Certainty= 0.000(Not Clear)
        < succ >
        bacterial inner membrane --- Certainty= 0.000(Not Clear)
        < succ >
```

The protein has homology to the following sequences in the databases:

```
^ **gbp_5915870 gi|5915870|sp|Q50940|CAH_NEIGO Carbonic anhydrase
precursor (Carbonate dehydratase)
emb|CAA72038.1|(Y11152) carbonic anhydrase [Neisseria gonorrhoeae]
Length = 252
Score = 523 bits (1347), Expect = e-147
Identities = 252/252 (100%), Positives = 252/252 (100%)

Query:     1 MPRFPRTLPRLTAVLLLACTAFSAAAHGNHTHWGYTGHDSPESWGNLSEEFRLCSTGKNQ    60
             MPRFPRTLPRLTAVLLLACTAFSAAAHGNHTHWGYTGHDSPESWGNLSEEFRLCSTGKNQ
Sbjct:     1 MPRFPRTLPRLTAVLLLACTAFSAAAHGNHTHWGYTGHDSPESWGNLSEEFRLCSTGKNQ    60

Query:    61 SPVNITETVSGKLPAIKVNYKPSMVDVENNGHTIQVNYPEGGNTLTVNGTYTLKQFHFH   120
             SPVNITETVSGKLPAIKVNYKPSMVDVENNGHTIQVNYPEGGNTLTVNGTYTLKQFHFH
Sbjct:    61 SPVNITETVSGKLPAIKVNYKPSMVDVENNGHTIQVNYPEGGNTLTVNGTYTLKQFHFH   120

Query:   121 VPSENQIKGRTFPMEAHFVHLDENKQPLVLAVLYEAGKTNGRLSSIWNVMPMTAGKVKLN   180
             VPSENQIKGRTFPMEAHFVHLDENKQPLVLAVLYEAGKTNGRLSSIWNVMPMTAGKVKLN
Sbjct:   121 VPSENQIKGRTFPMEAHFVHLDENKQPLVLAVLYEAGKTNGRLSSIWNVMPMTAGKVKLN   180

Query:   181 QPFDASTLLPKRLKYYRFAGSLTTPPCTEGVSWLVLKTYDHIDQAQAEKFTRAVGSENNR   240
             QPFDASTLLPKRLKYYRFAGSLTTPPCTEGVSWLVLKTYDHIDQAQAEKFTRAVGSENNR
Sbjct:   181 QPFDASTLLPKRLKYYRFAGSLTTPPCTEGVSWLVLKTYDHIDQAQAEKFTRAVGSENNR   240

Query:   241 PVQPLNARVVIE                                                  252
             PVQPLNARVVIE
Sbjct:   241 PVQPLNARVVIE                                                  252
```

```
^ **gbp_15794480 gi|15794480|ref|NP_284302.1|\(NC_003116) hypothetical
protein [Neisseria meningitidis Z2491]
pir||F81851 hypothetical protein NMA1587 [imported]-Neisseria
meningitidis (group A strain Z2491)
emb|CAB84814.1|(AL162756) hypothetical protein [Neisseria meningitidis
Z2491]
Length = 181
Score = 358 bits (919), Expect = 6e-98
Identities = 173/181 (95%), Positives = 178/181 (97%)

Query:    1 LKTDTARMNNLIPEHLAAYAHSDNLQIEGGHRCFSLSCQGRDTFHIRYYGEPFDGLITDT    60
            +KTDTA+MNNLIPEHLAAYAHSD+LQIEG HRCFSLSCQGRDTFHIRYYGEPFDGL+TDT
Sbjct:    1 MKTDTAKMNNLIPEHLAAYAHSDSLQIEGVHRCFSLSCQGRDTFHIRYYGEPFDGLMTDT    60

Query:   61 DKAPVKIVAVEAVSGDEIVLFDGAEHGYNAMFCDKYSQNQKQNRTLTDLDEYTYRVPIHL   120
            DKAPVKIVAVEAVSGDEIVLFDGAEHGYNAMFCDKYS NQKQNRTLTDLDEYTYRV IHL
Sbjct:   61 DKAPVKIVAVEAVSGDEIVLFDGAEHGYNAMFCDKYSPNQKQNRTLTDLDEYTYRVLIHL   120

Query:  121 YYNIDYEDEYEDFVNSEGQVPLIDGRIISFDSLKRNGFDAISIDLIDEKHSVRELLNEELS 181
            YYNIDYEDEYEDFVNSEGQVPLIDGRIISFDSLKRNGFDAIS+DLIDEKHSVRELLNEELS
Sbjct:  121 YYNIDYEDEYEDFVNSEGQVPLIDGRIISFDSLKRNGFDAISVDLIDEKHSVRELLNEELS 181
```

A homolog was found in serogroup A *N. meningitidis* but not in serogroup B, so NGS142 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 140

A DNA sequence was identified in *N. gonorrhoeae* <SEQ ID 279> which encodes amino acid sequence <SEQ ID 280; NGS143>. Analysis of this protein sequence reveals the following:

GvH Examining signal sequence (von Heijne)
    Signal Score (-7.5): -2.51
    Possible cleavage site: 57
>>> Seems to have no N-terminal signal seq.
Amino Acid Composition of Predicted Mature Form:
    calculated from 1

-continued

ALOM: Finding transmembrane regions (Klein et al.)
    count: 4   value: -15.23 threshold:  0.0
    INTEGRAL   Likelihood = -15.23   Transmembrane 84-100 (79-107)
    INTEGRAL   Likelihood = -8.12   Transmembrane 259-275 (250-281)
    INTEGRAL   Likelihood = -4.14   Transmembrane 159-175 (153-176)
    INTEGRAL   Likelihood = -3.88   Transmembrane 216-232 (216-235)
    PERIPHERAL   Likelihood = 1.11
    modified ALOM score:  3.55
Rule: cytoplasmic membrane protein
*** Reasoning Step: 2
----- Final Results -----
    bacterial inner membrane --- Certainty= 0.709(Affirmative) < succ>
    bacterial periplasmic space --- Certainty= 0.000(Not Clear) < succ>
    bacterial outer membrane --- Certainty= 0.000(Not Clear) < succ>
    bacterial cytoplasm --- Certainty= 0.000(Not Clear) < succ>

The protein has homology to the following sequences in the databases:

```
^ **gbp_5764059 gi|5764059|emb|CAB53350.1|\(AJ010260) NosR protein
[Paracoccus denitrificans]
Length = 724
Score = 393 bits (1009), Expect = e-108
Identities = 191/379 (50%), Positives = 249/379 (65%), Gaps = 22/379 (5%)

Query:    1 LMVQRVLSVNDKAFVTADLDYELPQAYYVDDPKAPPVEISAPVEAVPAAASDTASDGIAE    60
            L+VQR +     +K F T DL Y+LPQ Y            AP      A PAA +D
Sbjct:  358 LLVQREVGPIEKVFHTFDLGYQLPQKYLRSIAPAPEA---------AA-              402
            PAAQAD--------

Query:   61 DASAENGVSNQLWKQIWAKQGQIVVVGIALTILLLVFLFQDWIVRYEKWYDRFRFAFLT   120
               E+   QLWK+IW   + +I +    L +L  VF FQ +  RYE+ +  FR A+LT
Sbjct:  403 ----ESQAQAQLWKRIWLDSKPKIAGLAAMLLVLTGVFFFQSFTTRYERAFYVFRMAYLT   458

Query:  121 FTLFYIGWYAQAQLSVVNTLTLFSAILTEFHWEFFLMDPIVFILWLFTAATMLLWNRGTF   180
             TL ++GWYA AQLSVVN + LF +++  F W+ FL+DP+ FILW   AA +L W RG +
Sbjct:  459 VTLVFLGWYANAQLSVVNLMALFGSLVNGFSWQAFLLDPLTFILWFAVAAALLFWGRGAY   518

Query:  181 CGWLCPFGSLQELTNRIAKKLGVKQITVPHMLHTRLNVIKYLILFGFLAISLYDLGTAEK   240
            CGWLCPFG+LQELTN++A+KL + Q T+P  LH RL  +KY+I   G   +SL  +  AE
Sbjct:  519 CGWLCPFGALQELTNQVARKLRIPQWTLPWGLHERLWPVKYMIFLGLFGVSLMSVEQAEH   578

Query:  241 FAEVEPFKTAIILKFMCDWWFVAPAVALLIAGLFIERFFCRYLCPLGAGIALPGRFRVFD   300
             AEVEPFKTAIILKF+   W  FVA+A  ALLIAGLF+ERF+CRYLCPLGA +A+P R R+FD
```

```
Sbjct:  579 LAEVEPFKTAIILKFIRAWPFVAYAAALLIAGLFVERFYCRYLCPLGAALAIPARMRMFD  638

Query:  301 WLRRYKMCGNPCQICTHBCPVQAIAPEGDIHPNECIQCLHCQVMYHHDTRCPQVVAENKK  360
            WL+RY  CGNPCQ C  +CPVQ+I P G+I+PNECI CLHCQV+Y  +T CP V+   KK
Sbjct:  639 WLKRYHECGNPCQTCARQCPVQSIHPTGEINPNECINCLHCQVLYQSETTCPVVI---KK  695

Query:  361 KQKQAAAKSGELENVSKQP                                          379
            +++ A  +G +  + + P
Sbjct:  696 LKRREAVAAGSMPKLGQPP                                          714
```

Based on this analysis, it was predicted that this protein from *N. gonorrhoeae*, and its epitopes, could be useful antigens for vaccines or diagnostics.

EXAMPLE 141

A DNA sequence was identified in *N. gonorrhoeae* <SEQ ID 281> which encodes amino acid sequence <SEQ ID 282; NGS144>. Analysis of this protein sequence reveals the following:

GvH Examining signal sequence (von Heijne)
    Signal Score (−7.5): 1.23
    Possible cleavage site: 21
>>> May be a lipoprotein
Amino Acid Composition of Predicted Mature Form:
    calculated from 20
ALOM: Finding transmembrane regions (Klein et al.)
    count: 1  value:  −0.37 threshold:    0.0
    INTEGRAL    Likelihood = −0.37    Transmembrane 90-106 (89-106)
    PERIPHERAL  Likelihood = 10.82
    modified ALOM score:  0.57
Rule: inner or outer membrane protein
Rule: inner or outer membrane protein
Rule: cytoplasmic membrane protein
*** Reasoning Step: 2
Lipoprotein?
Inner membrane?
----- Final Results -----
    bacterial outer membrane --- Certainty= 0.790(Affirmative) < succ>
    bacterial inner membrane --- Certainty= 0.734(Affirmative) < succ>
    bacterial periplasmic space --- Certainty= 0.000(Not Clear) < succ>
        bacterial cytoplasm --- Certainty= 0.000(Not Clear) < succ>

The protein has homology no to sequences in the databases.

Based on this analysis, it was predicted that this protein from *N. gonorrhoeae*, and its epitopes, could be useful antigens for vaccines or diagnostics.

EXAMPLE 142

A DNA sequence was identified in *N. gonorrhoeae* <SEQ ID 283> which encodes amino acid sequence <SEQ ID 284; NGS145>. Analysis of this protein sequence reveals the following:

GvH Examining signal sequence (von Heijne)
    Signal Score (−7.5): 1.5
    Possible cleavage site: 19
>>> Seems to have a cleavable N-term signal seq.
Amino Acid Composition of Predicted Mature Form:
    calculated from 20
ALOM: Finding transmembrane regions (Klein et al.)
    count: 0  value:  8.70 threshold:    0.0
    PERIPHERAL Likelihood = 8.70
    modified ALOM score:  −2.24
Score for OM-PP discrimination: −9.24
Rule: outer membrane or periplasmic protein
Score for OM-PP discrimination: −9.24
Rule: outer membrane or periplasmic protein
*** Reasoning Step: 2
Periplasmic space?  Score: 0.924443
Periplasmic space?  Score: 0.924443
----- Final Results -----
    bacterial periplasmic space --- Certainty= 0.931(Affirmative) < succ>
    bacterial outer membrane --- Certainty= 0.231(Affirmative) < succ>
    bacterial inner membrane --- Certainty= 0.000(Not Clear) < succ>
        bacterial cytoplasm --- Certainty= 0.000(Not Clear) < succ>

The protein has homology to the following sequences in the databases:

```
^ **gbp_5051426 gi|5051426|emb|CAB45007.1|\(AJ242839) OpcA protein
[Neisseria gonorrhoeae]
Length = 263
Score = 531 bits (1369), Expect = e-150
Identities = 262/263 (99%), Positives = 263/263 (99%)

Query:    1 MKKALLALTIAAISGTAMAQLPDFLGKGEYTVRTDISKQTLKNADLKEKHKVQKNIGFRA   60
            MKKALLALTIAAISGTAMAQLPDFLGKGEYTVRTDISKQTLKNADLKEKHKVQKNIGFRA
Sbjct:    1 MKKALLALTIAAISGTAMAQLPDFLGKGEYTVRTDISKQTLKNADLKEKHKVQKNIGFRA   60

Query:   61 DMPFDDIHHGMRFEVSHSRDKKDMYVVTESTTKPFGKDVEEKRTDVYAGYTYTQPISEAT  120
            DMPFDDIHHGMRFEVSHSRDKKDMYVVTESTTKPFGKDV+EKRTDVYAGYTYTQPISEAT
Sbjct:   61 DMPFDDIHHGMRFEVSHSRDKKDMYVVTESTTKPFGKDVKEKRTDVYAGYTYTQPISEAT  120

Query:  121 KLRAGLGLGYEKYKDAVANEKGTVSTEREAFYTKAHADLTSDLGGGWYLNPWAEVKVDLD  180
            KLRAGLGLGYEKYKDAVANEKGTVSTEREAFYTKAHADLTSDLGGGWYLNPWAEVKVDLD
Sbjct:  121 KLRAGLGLGYEKYKDAVANEKGTVSTEREAFYTKAHADLTSDLGGGWYLNPWAEVKVDLD  180
```

```
Query: 181 AKLKHNATVAGVSADINAKTRGWGVGVGANIGKQITDTVGIEAGPFYKHRHFKASGSFVL  240
            AKLKHNATVAGVSADINAKTRGWGVGVGANIGKQITDTVGIEAGPFYKHRHFKASGSFVL
Sbjct: 181 AKLKHNATVAGVSADINAKTRGWGVGVGANIGKQITDTVGIEAGPFYKHRHFKASGSFVL  240

Query: 241 DGGNIRVDPTKINEYGVRVGVKF  263
            DGGNIRVDPTKINEYGVRVGVKF
Sbjct: 241 DGGNIRVDPTKINEYGVRVGVKF  263
```

Based on this analysis, it was predicted that this protein from N. gonorrhoeae, and its epitopes, could be useful antigens for vaccines or diagnostics.

EXAMPLE 143

A DNA sequence was identified in N. gonorrhoeae <SEQ ID 285> which encodes amino acid sequence <SEQ ID 286; NGS146>. Analysis of this protein sequence reveals the following:

```
GvH Examining signal sequence (von Heijne)
    Signal Score (-7.5): 0.1
    Possible cleavage site: 51
>>> Seems to have a cleavable N-term signal seq.
Amino Acid Composition of Predicted Mature Form:
    calculated from 52
ALOM: Finding transmembrane regions (Klein et al.)
    count: 0   value:  3.50 threshold:    0.0
    PERIPHERAL Likelihood = 3.50
    modified ALOM score:  -1.20
Score for OM-PP discrimination: -15.70
Rule: outer membrane or periplasmic protein
Score for OM-PP discrimination: -15.70
Rule: outer membrane or periplasmic protein
*** Reasoning Step: 2
Periplasmic space?  Score: 1.56979
Periplasmic space?  Score: 1.56979
----- Final Results -----
    bacterial periplasmic space --- Certainty= 0.944(Affirmative) < succ>
        bacterial outer membrane --- Certainty= 0.375(Affirmative)
        < succ>
        bacterial inner membrane --- Certainty= 0.000(Not Clear)
        < succ>
            bacterial cytoplasm --- Certainty= 0.000(Not Clear)
            < succ>
```

The protein has homology to the following sequences in the databases:

Based on this analysis, it was predicted that this protein from N. gonorrhoeae, and its epitopes, could be useful antigens for vaccines or diagnostics.

EXAMPLE 144

A DNA sequence was identified in N. gonorrhoeae <SEQ ID 287> which encodes amino acid sequence <SEQ ID 288; NGS147>. Analysis of this protein sequence reveals the following:

```
GvH Examining signal sequence (von Heijne)
    Signal Score (-7.5): -4.09
    Possible cleavage site: 40
>>> Seems to have no N-terminal signal seq.
Amino Acid Composition of Predicted Mature Form:
    calculated from 1
ALOM: Finding transmembrane regions (Klein et al.)
    count: 1   value:  -2.28 threshold:    0.0
    INTEGRAL    Likelihood = -2.28   Transmembrane
                                     36-52 (36-52)
    PERIPHERAL  Likelihood = 5.20
    modified ALOM score:  0.96
Rule: cytoplasmic membrane protein
*** Reasoning Step: 2
----- Final Results -----
    bacterial inner membrane --- Certainty= 0.191(Affirmative)
    < succ>
    bacterial periplasmic space --- Certainty= 0.000(Not Clear) < succ>
        bacterial outer membrane --- Certainty= 0.000(Not Clear)
        < succ>
            bacterial cytoplasm --- Certainty= 0.000(Not Clear) < succ>
```

The protein has homology to the following sequences in the databases:

```
^ **gbp_5051429 gi|5051429|emb|CAB45013.1|\(AJ242839) hypothetical
protein [Neisseria gonorrhoeae]
Length = 109
Score = 216 bits (549), Expect = 2e-55
Identities = 109/109 (100%), Positives = 109/109 (100%)

Query:   1 MFKRPEEIIVLILAVLWIAGTYFLAALFGADAYVLKITALTLLWSAASFLLWQKKPQPA   60
           MFKRPEEIIVLILAVLWIAGTYFLAALFGADAYVLKITALTLLWSAASFLLWQKKPQPA
Sbjct:   1 MFKRPEEIIVLILAVLWIAGTYFLAALFGADAYVLKITALTLLWSAASFLLWQKKPQPA   60

Query:  61 YLAAAARLPDHLLVAVASESIGRTRFFTLACIMDVQHNLSPDSRNRRLSV          109
           YLAAAARLPDHLLVAVASESIGRTRFFTLACIMDVQHNLSPDSRNRRLSV
Sbjct:  61 YLAAAARLPDHLLVAVASESIGRTRFFTLACIMDVQHNLSPDSRNRRLSV          109
```

```
^ **gbp_6606516 gi|6606516|gb|AAF19189.1|AF200716_2 \(AF200716)
trafficking protein B [Neisseria gonorrhoeae]
Length = 139
Score = 274 bits (700), Expect = 7e-73
Identities = 139/139 (100%), Positivies = 139/139 (100%)

Query:    2 MILLDTNVISEPLRPQPNERVVAWLDSLILEDVYLSAITVAELRLGVALLLNGKKKNVLH    61
            MILLDTNVISEPLRPQPNERVVAWLDSLILEDVYLSAITVAELRLGVALLLNGKKKNVLH
Sbjct:    1 MILLDTNVISEPLRPQPNERVVAWLDSLILEDVYLSAITVAELRLGVALLLNGKKKNVLH    60

Query:   62 ERLEQSILPLFAGRILPFDEPVAAIYAQIRSYAKTHGKEIAAADGYIAATAKQHSLTVAT   121
            ERLEQSILPLFAGRILPFDEPVAAIYAQIRSYAKTHGKEIAAADGYIAATAKQHSLTVAT
Sbjct:   61 ERLEQSILPLFAGRILPFDEPVAAIYAQIRSYAKTHGKEIAAADGYIAATAKQHSLTVAT   120

Query:  122 RDTGSFFAADVAVFNPWHD                                           140
            RDTGSFFAADVAVFNPWHD
Sbjct:  121 RDTGSFFAADVAVFNPWHD                                           139
```

Based on this analysis, it was predicted that this protein from *N. gonorrhoeae*, and its epitopes, could be useful antigens for vaccines or diagnostics.

EXAMPLE 145

A DNA sequence was identified in *N. gonorrhoeae* <SEQ ID 289> which encodes amino acid sequence <SEQ ID 290; NGS148>. Analysis of this protein sequence reveals the following:

```
GvH Examining signal sequence (von Heijne)
    Signal Score (-7.5): 0.86
    Possible cleavage site: 47
>>> Seems to have a cleavable N-term signal seq.
Amino Acid Composition of Predicted Mature Form:
    calculated from 48
ALOM: Finding transmembrane regions (Klein et al.)
    count: 5   value: -15.44 threshold:    0.0
    INTEGRAL    Likelihood = -15.44   Transmembrane
                                      157-173 (142-181)
```

-continued

```
    INTEGRAL    Likelihood = -12.15   Transmembrane
                                      62-78 (56-83)
    INTEGRAL    Likelihood = -6.32    Transmembrane
                                      194-210 (191-212)
    INTEGRAL    Likelihood = -4.30    Transmembrane
                                      87-103 (85-104)
    INTEGRAL    Likelihood = -2.60    Transmembrane
                                      121-137 (121-142)
    PERIPHERAL  Likelihood = 2.92
    modified ALOM score:   3.59
Rule: cytoplasmic membrane protein
*** Reasoning Step: 2
----- Final Results -----
    bacterial inner membrane --- Certainty= 0.718(Affirmative)
        < succ>
    bacterial periplasmic space --- Certainty= 0.000(Not Clear) < succ>
    bacterial outer membrane --- Certainty= 0.000(Not Clear)
        < succ>
    bacterial cytoplasm --- Certainty= 0.000(Not Clear) < succ>
```

The protein has homology to the following sequences in the databases:

```
^ **gbp_15777859|gi|15777859|gb|AAL05955.1|\(AY048756) putative cadmium
binding protein [Staphylococcus aureus]
Length = 209
Score = 354 bits (908), Expect = 1e-96
Identities = 177/208 (85%), Positives = 194/208 (93%)

Query:   14 MRCFMFSTVITAAVLYIATAVDLLVILLIFFARANTRKEYRDIYIGQYLGSVILILVSLF    73
            MRC M  TV+TAAVLYIATAVDLLVILLIFFARA TRKEYRDIY+GQYLGS+ILILVSLF
Sbjct:    1 MRCIMIQTVVAAAVLYIATAVDLLVILLIFFARAKTRKEYRDIYVGQYLGSIILILVSLF    60

Query:   74 LAFVLNYVPEKWVLGLLGLIPIYLGIKVAIYDDCEGEKRAKKELDEKGLSKLVGIVALVT   133
            LAFVLNYVPEKW+LGLLGLIPIYLGIKVAIYDDCEGEKRAKKEL+EKGLSKLVG VA+VT
Sbjct:   61 LAFVLNYVPEKWILGLLGLIPIYLGIKVAIYDDCEGEKRAKKELNEKGLSKLVGTVAIVT   120

Query:  134 VASCGADNIGLFVPYFVTLDLVDLLVTLLVFLILIFVLVYTAQRLANISGVGEIVEKFSR   193
            +ASCGADNIGLFVPYFVTL + +LL+TL VFLILIF LV+TAQ+LANI G+GEIVEKFSR
Sbjct:  121 IASCGADNIGLFVPYFVTLSVTNLLLTLFVFLILIFFLVFTAQKLANIPGIGEIVEKFSR   180

Query:  194 WIMAVIYIGLGLFIIIENNTIRTIISII                                  221
            WIMA+IYI LGLFIIIEN+TI+TI+  I
Sbjct:  181 WIMAIIYIALGLFIIIENDTIQTILGFI                                  208
```

Based on this analysis, it was predicted that this protein from *N. gonorrhoeae*, and its epitopes, could be useful antigens for vaccines or diagnostics.

EXAMPLE 146

A DNA sequence was identified in *N. gonorrhoeae* <SEQ ID 291> which encodes amino acid sequence <SEQ ID 292; NGS149>. Analysis of this protein sequence reveals the following:

```
GvH Examining signal sequence (von Heijne)
    Signal Score (-7.5): -0.63
    Possible cleavage site: 43
>>> Seems to have no N-terminal signal seq.
Amino Acid Composition of Predicted Mature Form:
    calculated from 1
ALOM: Finding transmembrane regions (Klein et al.)
    count: 0   value:   2.12  threshold:  0.0
    PERIPHERAL    Likelihood =   2.12
    modified ALOM score:   -0.92
Rule: cytoplasmic protein
*** Reasoning Step: 2
----- Final Results -----
        bacterial cytoplasm --- Certainty=
        0.122(Affirmative) < succ>
        bacterial periplasmic space --- Certainty=
        0.000(Not Clear) < succ>
            bacterial outer membrane --- Certainty=
            0.000(Not Clear) < succ>
            bacterial inner membrane --- Certainty=
            0.000(Not Clear) < succ>
```

The protein has homology to the following sequences in the databases:

```
^ **gbp_15675455 gi|15675455|ref|NP_269629.1|\(NC_002737) conserved
hypothetical protein [Streptococcus pyogenes]
[Streptococcus pyogenes M1 GAS]
gb|AAK34350.1|(AE006588) conserved hypothetical protein
[Streptococcus pyogenes M1 GAS]
Length = 224
Score = 106 bits (264), Expect = 3e-22
Identities = 63/151 (41%), Positives = 85/151 (55%), Gaps = 12/151 (7%)

Query:   20 LSALQHYAFCPRQCALIHNEQAWAENYLTAQGKALHERVDSDE-PETCKGVRFEWTVHVL   78
            LS +QH+ FC RQ ALIH EQ W +N   TA G+ LH + D+      E  K +    + +
Sbjct:   11 LSGIQHFQFCKRQWALIHIEQQWLDNEATAHGQVLHTKADNPYIKEKRKELLVSRAMPIS   70

Query:   79 ADKLGISGILDLVE---------VDTKTGRLKP--VEYKRGKPKPDPGDEIQLCAQGLCL  127
            + +LG+SGI+D+VE          + K G+  P  VEYKRGKPK  D  D +QL AQ +CL
Sbjct:   71 SAELGLSGIMDVVEFYKDDQGVSLRGKRGKWLPKVVEYKRGKPKKDTRDIVQLVAQTMCL  130

Query:  128 EEMTGQTVSEGALWYMQTRHRVPVVFSDGLR                             158
            EE     ++EG L+Y      RV V  +  LR
Sbjct:  131 EETLDCDINEGCLYYHSVNQRVIVPMTSALR                             161
```

Based on this analysis, it was predicted that this protein from *N. gonorrhoeae*, and its epitopes, could be useful antigens for vaccines or diagnostics.

EXAMPLE 147

A DNA sequence was identified in *N. gonorrhoeae* <SEQ ID 293> which encodes amino acid sequence <SEQ ID 294; NGS150>. Analysis of this protein sequence reveals the following:

```
GvH Examining signal sequence (von Heijne)
    Signal Score (-7.5): -0.71
    Possible cleavage site: 19
>>> Seems to have no N-terminal signal seq.
Amino Acid Composition of Predicted Mature Form:
    calculated from 1
ALOM: Finding transmembrane regions (Klein et al.)
    count: 1   value:   -0.85  threshold:  0.0
    INTEGRAL      Likelihood =   -0.85    Transmembrane
    79-95 (79-96)
    PERIPHERAL    Likelihood =   6.52
    modified ALOM score:   0.67
Rule: cytoplasmic membrane protein
*** Reasoning Step: 2
----- Final Results -----
        bacterial inner membrane --- Certainty=
        0.134(Affirmative) < succ>
        bacterial periplasmic space --- Certainty=
        0.000(Not Clear) < succ>
        bacterial outer membrane --- Certainty=
        0.000(Not Clear) < succ>
            bacterial cytoplasm --- Certainty=
            0.000(Not Clear) < succ>
```

The protein has no homology to sequences in the databases.

Based on this analysis, it was predicted that this protein from *N. gonorrhoeae*, and its epitopes, could be useful antigens for vaccines or diagnostics.

EXAMPLE 148

A DNA sequence was identified in *N. gonorrhoeae* <SEQ ID 295> which encodes amino acid sequence <SEQ ID 296; NGS151>. Analysis of this protein sequence reveals the following:

GvH Examining signal sequence (von Heijne)
    Signal Score (-7.5): 3.47
    Possible cleavage site: 23
>>> Seems to have a cleavable N-term signal seq.
Amino Acid Composition of Predicted Mature Form:
    calculated from 24
ALOM: Finding transmembrane regions (Klein et al.)
    count: 0   value: 14.32 threshold: 0.0
    PERIPHERAL   Likelihood = 14.32
    modified ALOM score: -3.36
Score for OM-PP discrimination: -32.29
Rule: outer membrane or periplasmic protein
Score for OM-PP discrimination: -32.29
Rule: outer membrane or periplasmic protein
*** Reasoning Step: 2
Periplasmic space?   Score: 3.22889
Periplasmic space?   Score: 3.22889
----- Final Results -----
    bacterial periplasmic space --- Certainty=
        0.933(Affirmative) < succ>
        bacterial outer membrane --- Certainty=
            0.253(Affirmative) < succ>
        bacterial inner membrane --- Certainty=
            0.000(Not Clear) < succ>
            bacterial cytoplasm --- Certainty=
                0.000(Not Clear) < succ>

GvH Examining signal sequence (von Heijne)
    Signal Score (-7.5): -5.46
    Possible cleavage site: 18
>>> Seems to have an uncleavable N-term signal seq
Amino Acid Composition of Predicted Mature Form:
    calculated from 1
ALOM: Finding transmembrane regions (Klein et al.)
    count: 1   value: -3.19 threshold: 0.0
    INTEGRAL   Likelihood = -3.19   Transmembrane
    368-384 (367-384)
    PERIPHERAL   Likelihood = 0.53
    modified ALOM score: 1.14
Rule: cytoplasmic membrane protein
*** Reasoning Step: 2
----- Final Results -----
    bacterial inner membrane --- Certainty=
        0.227(Affirmative) < succ>
    bacterial periplasmic space --- Certainty=
        0.000(Not Clear) < succ>
        bacterial outer membrane --- Certainty=
            0.000(Not Clear) < succ>
            bacterial cytoplasm --- Certainty=
                0.000(Not Clear) < succ>

The protein has homology to the following sequences in the databases:

The protein has homology to the following sequences in the databases:

```
^ **gsa_AAY75310 Neisseria gonorrheae ORF 649 protein sequence
SEQ ID NO:2094|WO9957280-A2|21-MAR-2000
Length = 103
Score = 35.4 bits (80), Expect = 0.32
Identities = 25/85 (29%), Positives = 38/85 (44%), Gaps = 5/85 (5%)

Query:   7 ILTGILLATALPASAHGMHKSKPLAMDELPPIQQYFKRAETCYNKAGNKADFARN-NTK    65
             + T    T+ PA  H  H SK      L P C++Y +R    Y   GN  +  N   +
Sbjct:  13 VSTTAAAGTSEPAHRHTKHISKA-NKQMLHPECRKYLERRAAWYRSQGNVQELRENKKAR  71

Query:  66 FLFQALPAADLGQRKQMCQIAMDSF                                    90
             F+ LP A    ++K  C+ A ++F
Sbjct:  72 KAFRTLPYA---EQKIQCRAAYEAF                                    93
```

The protein was expressed in *E. coli* as a soluble 9.35 kDa His-fusion product and then purified.

Based on this analysis, it was predicted that this protein from *N. gonorrhoeae*, and its epitopes, could be useful antigens for vaccines or diagnostics.

EXAMPLE 149

A DNA sequence was identified in *N. gonorrhoeae* <SEQ ID 297> which encodes amino acid sequence <SEQ ID 298; NGS152>. Analysis of this protein sequence reveals the following:

```
^ **gsa_AAY81609 Streptococcus pneumoniae type 4 protein sequence #109
|WO200006737-A2|24-MAY-2000
Length = 1237
Score = 48.1 bits (113), Expect = 4e-04
Identities = 80/312 (25%), Positives = 142/312 (44%), Gaps = 59/312 (18%)

Query:  57 RRQARIRVGNLITDSLEHIRVKALLPLPL----KLPVKRI---NLPRNLPALPVRLRKTI  109
           RRQ R +    ++ L+H RV  L   P+     ++PV+++    +PR   A    RL++ +
Sbjct: 941 RRQVR-QPQQVLVHQLQHQRVHRLRRQPVHQSQQVPVRQLPHQQVPRLQQAPVRRLQQVL  999

Query: 110 SPRQIGDALPILKLQRI--RLTLHLKPLPLHPQLGLLHIKRPVRIPLRHLAVQRTLVRLN  167
            +P+        P+ + Q++    RL  H +   PL    L       +P R  +  L  QR  VRLN
```

```
-continued
Sbjct:  1000 APQP--QPQPVRQPQQVSQRLNRHQRVRPLQQVLA----PQPQRQQVHRL--QRQRVRLN  1051

Query:   168 RRIKPPLLQHRLTVRRILRRSRRQPFPAQFPDRRIFIMFRHNPARRIKLCRRQLTVQGPR   227
              R  +    LQ  L                 A  P R+        +H   +R++  ++ L   Q   R
Sbjct:  1052 RHQRVRPLQQVL---------------APQPQRQQVHRLQH---QRVRPLQQVLAPQPQR  1093

Query:   228 IRRSRPLIKLPLLRRQRIRPGRHQRTLRVKITHRLAAPIHIPVKSQRRRRPSARIRRARI   287
              +   R       L+RQR+R   +HQR  + +   H+L      +H  PV+  Q  +  R  +  ++++   +
Sbjct:  1094 QQVHR------LQRQRVRLSQHQRVRQPQQAHQL-LNLHQPVR-QPQHRQAPQLQQVPV  1144

Query:   288 APREIRPGPRIGGKRLIAARKP-QTGIRTPFESTRPAQPPRPILNIVTAQIHHIPITRR   345
              + R    R+    + +   R+P  Q   +R P        R    + P+P+ LN          H P+  R+
Sbjct:  1145 RQPQRRQVRRL---QQVPVRQPQQVPVRQP--QRRQVRRPQPVHLN------ RHQPV-RQ  1192

Query:   346 PGLIIRNGTPHR   357
              P  ++ +     H+
Sbjct:  1193 PQQVLVHQLQHQ  1204
```

Based on this analysis, it was predicted that this protein from N. gonorrhoeae, and its epitopes, could be useful antigens for vaccines or diagnostics.

EXAMPLE 150

A DNA sequence was identified in N. gonorrhoeae <SEQ ID 299> which encodes amino acid sequence <SEQ ID 300; NGS153>. Analysis of this protein sequence reveals the following:

GvH Examining signal sequence (von Heijne)
    Signal Score (−7.5): −5.48
    Possible cleavage site: 13
>>> Seems to have no N-terminal signal seq.
Amino Acid Composition of Predicted Mature Form:
    calculated from 1
ALOM: Finding transmembrane regions (Klein et al.)
    count: 0   value: 6.31   threshold: 0.0
    PERIPHERAL   Likelihood = 6.31
    modified ALOM score: −1.76
Rule: cytoplasmic protein
*** Reasoning Step: 2
----- Final Results -----
        bacterial cytoplasm --- Certainty=
        0.150(Affirmative) < succ>
    bacterial periplasmic space --- Certainty=
    0.000(Not Clear) < succ>
        bacterial outer membrane --- Certainty=
        0.000(Not Clear) < succ>
    bacterial inner membrane --- Certainty=
    0.000(Not Clear) < succ>

The protein has homology to the following sequences in the databases:

```
^ **gbp_15832758 gi|15832758|ref|NP_311531.1|\(NC_002695) hypothetical
protein [Escherichia coli O157:H7]
dbj|BAB36927.1|(AP002562) hypothetical protein [Escherichia coli O157:H7]
Length = 188
Score = 73.9 bits (180), Expect = 3e-12
Identities = 54/169 (31%), Positives = 79/169 (45%), Gaps = 15/169 (8%)

Query:    12 LTQEVLKELLRYDDNTGKLYWAERPRKYFNSGLHYKSWNTGFSGKEVFLYKGRLGYLKLK    71
             LT  + +  ELL +D +TG    W   +            +   S    F                GY  +
Sbjct:    16 LTVKRIFELLSFDKSTGVFRWKVPTQ----GRIALNSVAGAFDSN------------    62
             GYSMIM Query:    72 IFKKQYNAHRLIWLFVYGKH-ASSIGHINRDKTDNRISNLRDVTHAENMKNRGKFKNNTS   130
             I   ++Y  H L++  + +   A   I H+N   +TDNR   NLR+         EN +N       KN+ S
Sbjct:    63 IDGRRYKTHVLVFYITHNRWPAGQIDHNGIRTDNRPENLRECLPIENSRNIRIRKNSKS   122

Query:   131 GHTGVYFKPSKKWQARIWINRKNKILGLFEHIEDAA-KAREAASKDFG  178
             G   GV  +HK   KKW   R+     +  K+K   G  F+ +E A     A  EA    K  +G
Sbjct:   123 GCRGVTWMKRQKKWNVRLGFHGKSKHFGCFDDLELAVLVAEEARDKYYG  171
```

Based on this analysis, it was predicted that this protein from N. gonorrhoeae, and its epitopes, could be useful antigens for vaccines or diagnostics.

EXAMPLE 151

A DNA sequence was identified in N. gonorrhoeae <SEQ ID 301> which encodes amino acid sequence <SEQ ID 302; NGS154>. Analysis of this protein sequence reveals the following:

GvH Examining signal sequence (von Heijne)
    Signal Score (−7.5): −6.98
    Possible cleavage site: 28
>>> Seems to have no N-terminal signal seq.
Amino Acid Composition of Predicted Mature Form:
    calculated from 1
ALOM: Finding transmembrane regions (Klein et al.)

```
            count: 0   value:  8.12  threshold:   0.0
            PERIPHERAL   Likelihood =   8.12
            modified ALOM score:   -2.12
Rule: cytoplasmic protein
*** Reasoning Step: 2
----- Final Results -----
            bacterial cytoplasm --- Certainty=
            0.423(Affirmative) < succ>
            bacterial periplasmic space --- Certainty=
            0.000(Not Clear) < succ>
            bacterial outer membrane --- Certainty=
            0.000(Not Clear) < succ>
            bacterial inner membrane --- Certainty=
            0.000(Not Clear) < succ>
```

The protein has homology to the following sequences in the databases:

```
^ **gbp_15830449 gi|15830449|ref|NP_309222.1|\(NC_002695) hypothetical
protein [Escherichia coli O157:H7]
dbj|BAA94132.1|(AP000422) hypothetical protein [Escherichia coli O157:H7]
dbj|BAB34618.1|(AP002554) hypothetical protein [Escherichia coli O157:H7]
Length = 148
Score = 42.7 bits (99), Expect = 0.003
Identities = 27/99 (27%), Positives = 49/99 (49%), Gaps = 10/99 (10%)

Query:  37 IRPRKSKRSVEQNRRLWFLYREISEKVFIDGRRFSQDVWHE-----FLKRKFIGCIEHPN    91
              +  ++ KRS  QN R+W +   ++S +V    G+R + + W +      +LK K +      +P
Sbjct:  33 VHVKEPKRSKAQNDRMWPMLNDVSRQVLWHGQRLAPEDWKDLFTALWLKTKKLEQRSVPG    92

Query:  92 GQ----LMGISTTKLSVEEMSEYQEKIISWASNEHGVLW                        126
              ++G+  T+K+      M+E   E I+ W    E   V W
Sbjct:  93 IDGGVVMLGVRTSKMRKASMTELIE-IMFEFGSERNVRW                        130
```

Based on this analysis, it was predicted that this protein from N. gonorrhoeae, and its epitopes, could be useful antigens for vaccines or diagnostics.

EXAMPLE 152

A DNA sequence was identified in N. gonorrhoeae <SEQ ID 303> which encodes amino acid sequence <SEQ ID 304; NGS155>. Analysis of this protein sequence reveals the following:

```
GvH Examining signal sequence (von Heijne)
    Signal Score (-7.5): -4
    Possible cleavage site: 27
>>> Seems to have an uncleavable N-term signal seq.
Amino Acid Composition of Predicted Mature Form:
    calculated from 1
ALOM: Finding transmembrane regions (Klein et al.)
    count: 0   value:  4.98 threshold:   0.0
    PERIPHERAL   Likelihood =   4.98
    modified ALOM score:   -1.50
*** Reasoning Step: 2
----- Final Results -----
    bacterial inner membrane --- Certainty=
    0.046(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>
```

The protein has homology to the following sequences in the databases:

```
^ **gbp_15801502 gi|15801502|ref|NP_287519.1|\(NC_002655) putative
endonuclease of prophage CP-9330 [Escherichia coli O157:H7 EDL933]
ref|NP_309804.1|(NC_002695) endonuclease [Escherichia coli O157:H7]
gb|AAG56131.1|AE005344_7 (AE005344) putative endonuclease of prophage
CP-9330 [Escherichia coli O157:H7 EDL933]
dbj|BAB35200.1|(AP002556) endonuclease [Escherichia coli O157:H7]
Length = 119
Score = 47.4 bits (111), Expect = 2e-04
Identities = 38/122 (31%), Positives = 54/122 (44%), Gaps = 8/122 (6%)

Query:   71 LILPYPVSANRYWRIWRNRAVRSAEAAAYKETVRRIA-QGAGAMPSEGAVAVYVRLIPKA   129
               L+LPYP +  N  YWR    +      S     Y+  V    I   Q       +      G +A+  +       P
Sbjct:    5 LVLPYPPTVNTYWERRGSTYFVSKAGERYRRAVVLIVRQQRLKLSLSGRLAIKIIABP--    62

Query:  130 NKDGGANKTVIDLDNLKVTLDALQGVAYHNDRQVRRIAAEYGGEPVTGGGLAVEVGELE    189
                +K      DLDN LK     LDAL           D +                   G+PV+GG  L  V++   ++E
Sbjct:   63 -----PDKRRRDLDNILKAPLDALTHAGVLMDDEQFDEINIVRGQPVSGGRLGVKIYKIE   117

Query:  190 ME                                                            191
               E
Sbjct:  118 SE                                                            119
```

Based on this analysis, it was predicted that this protein from *N. gonorrhoeae*, and its epitopes, could be useful antigens for vaccines or diagnostics.

EXAMPLE 153

A DNA sequence was identified in *N. gonorrhoeae* <SEQ ID 305> which encodes amino acid sequence <SEQ ID 306; NGS156>. Analysis of this protein sequence reveals the following:

```
GvH Examining signal sequence (von Heijne)
    Signal Score (-7.5): -2.61
    Possible cleavage site: 49
>>> Seems to have no N-terminal signal seq.
Amino Acid Composition of Predicted Mature Form:
    calculated from 1
ALOM: Finding transmembrane regions (Klein et al.)
    count: 0   value:  7.96 threshold:  0.0
    PERIPHERAL   Likelihood =   7.96
    modified ALOM score:   -2.09
Rule: cytoplasmic protein
*** Reasoning Step: 2
----- Final Results -----
    bacterial cytoplasm --- Certainty=
    0.307(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>
```

The protein has homology to the following sequences in the databases:

```
GvH Examining signal sequence (von Heijne)
    Signal Score (-7.5): -5.65
    Possible cleavage site: 42
>>> Seems to have no N-terminal signal seq.
Amino Acid Composition of Predicted Mature Form:
    calculated from 1
ALOM: Finding transmembrane regions (Klein et al.)
    count: 0   value:  3.98 threshold:  0.0
    PERIPHERAL   Likelihood =   3.98
    modified ALOM score:   -1.30
Rule: cytoplasmic protein
*** Reasoning Step: 2
----- Final Results -----
    bacterial cytoplasm --- Certainty=
    0.291(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>
```

The protein has homology to the following sequences in the databases:

```
^ **gsa_AAG90098 C glutamicum protein fragment SEQ ID NO: 3852
|EP1108790-A2|26-SEP-2001
Length = 148
Score = 102 bits (253), Expect = 7e-21
Identities = 60/147 (40%). Positives = 88/147 (59%), Gaps = 18/147 (12%)

Query:    3 NAYDVADFFLSPFEEEDGEQISNLKLQKLLYYAQGYALAILNRPLFAENIEHWQHGPVVP   62
            +A ++A++F++  +E D E +S LKLQKLLYY+QG  +A   R LF++ I  WQHGPV P
Sbjct:    5 SAREIAEWFVAWGDELDAE-VSPLKLQKLLYYSQGEHIAATGRKLFSDKILAWQHGPVTP   63

Query:   63 CIYRTYKKYGGSPLPAAHIEPDKYADEEL---------VVLNRVRKEQGCYTAWALRNKT  113
            +Y   K YG +P     I+PD++  E            L  V ++ G Y+AWALR  KT
Sbjct:   64 GVYSDTKSYGRNP-----IDPDEFVSDEFNWDDYSDVSDELVTVWRKYGIYSAWALREKT  118

Query:  114 HQEAPWIQT-RQGEVIGI--AIMGEYF                                  137
            H E+PW+    QG+ I I  A + ++F
Sbjct:  119 HSESPWLDAWAQGQNIEITDAALKDFF                                  145
```

Based on this analysis, it was predicted that this protein from *N. gonorrhoeae*, and its epitopes, could be useful antigens for vaccines or diagnostics.

EXAMPLE 154

A DNA sequence was identified in *N. gonorrhoeae* <SEQ ID 307> which encodes amino acid sequence <SEQ ID 308; NGS157>. Analysis of this protein sequence reveals the following:

```
^ **gbp_6274533 gi|6274533|gb|AAF06681.1|AF163663_6 \(AF058689) Toul
[Neisseria meningitidis]
Length = 272
```

-continued

Score = 546 bits (1408), Expect e-154
Identities = 267/272 (98%), Positives = 271/272 (99%)

```
Query:  19 MKGMDKLRYQRDFLNIRPIFTAGEQEYLTELSDRLPLSVLTDSVRNIEEIGIDVYSPAK    78
           MKGMDKLRYQ+DFLNIRPIFTAGEQEYLTELSDRLPLSVLTDSVRNIEEIGIDVYS AK
Sbjct:   1 MKGMDKLRYQQDFLNIRPIFTAGEQEYLTELSDRLPLSVLTDSVRNIEEIGIDVYSSAK    60

Query:  79 LEGNTYNQYDTQALLKLGQTAGGKLYSDAVMLINLRESYRHLLSGLDSPKPFDWLDFLKT   138
           LEGNTYNQYDTQALLKLGQTAGGKLYSDAVMLINLRESYRHLLSGLDSP+PFDWLDFLKT
Sbjct:  61 LEGNTYNQYDTQALLKLGQTAGGKLYSDAVMLINLRESYRHLLSGLDSPEPFDWLDFLKT   120

Query: 139 THSLISENLLEKGSGGVVRRDSVTISGTDYTPLSNPQSLDTELKWLLQEAPKIENPFDRA   198
           THSLISENLLEKGSGGVVRRDSVTISGTDYTPLSNPQSLDTELKWLLQEAPKIENPFDRA
Sbjct: 121 THSLISENLLEKGSGGVVRRDSVTISGTDYTPLSNPQSLDTELKWLLQEAPKIENPFDRA   180

Query: 199 VYLHNNLAYLRYFKDCNKRTARNCMTLSLMRSGFFPCVFSPDSYPAYAEAVVAYYETGDY   258
           VYLHNNLAYL+YFKDCNKRTARNCMTLSLMRSGFFPCVFSPDSYPAYAEAVVAYYETGDY
Sbjct: 181 VYLHNNLAYLQYFKDCNKRTARNCMTLSLMRSGFFPCVFSPDSYPAYAEAVVAYYETGDY   240

Query: 259 GLFKKYFISAYENTVNKYGPQPDVDIFRNFSI                              290
           GLFKKYFISAYENTVNKYGPQPDVDIFRNFS+
Sbjct: 241 GLFKKYFISAYENTVNKYGPQPDVDIFRNFSL                              272
```

A homolog was found in serogroup A *N. meningitidis* but not in serogroup B, so NGS157 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 155

A DNA sequence was identified in *N. gonorrhoeae* <SEQ ID 309> which encodes amino acid sequence <SEQ ID 310; NGS158>. Analysis of this protein sequence reveals the following:

---

GvH Examining signal sequence (von Heijne)
    Signal Score (−7.5): −6.98
    Possible cleavage site: 18
>>> Seems to have no N-terminal signal seq.
Amino Acid Composition of Predicted Mature Form:
    calculated from 1

-continued

ALOM: Finding transmembrane regions (Klein et al.)
    count: 0   value: 0.16 threshold: 0.0
    PERIPHERAL   Likelihood = 0.16
    modified ALOM score: −0.53
Rule: cytoplasmic protein
*** Reasoning Step: 2
----- Final Results -----
    bacterial cytoplasm --- Certainty=
    0.185(Affirmative) < succ>
    bacterial periplasmic space --- Certainty=
    0.000(Not Clear) < succ>
    bacterial outer membrane --- Certainty=
    0.000(Not Clear) < succ>
    bacterial inner membrane --- Certainty=
    0.000(Not Clear) < succ>

---

The protein has homology to the following sequences in the databases:

```
> ^^ **gbp_15791833 gi|15791833|ref|NP_281656.1|\(NC_002163) amino-acid
ABC transporter ATP-binding protein [Campylobacter jejuni]
pir||H81391 amino-acid ABC transporter ATP-binding protein Cj0469
[imported]-Campylobacter jejuni (strain NCTC 11168)
emb|CAB75107.1|(AL139075) amino-acid ABC transporter ATP-binding protein
[Campylobacter jejuni]
Length = 253
Score = 301 bits (772), Expect = 6e-81
Identities = 153/244 (62%), Positives = 195/244 (79%), Gaps = 2/244 (0%)

Query:   1 MALLSIRKLHKQYGSVAIQSLDLDLEKGEVIVLLGPSGCGKSTLLRCVNGLEPHQGGSI    60
           M++L  I   L K YGS  A++ ++L+++  EV+V+LGPSGCGKSTLLRC+NGLE      G+I
Sbjct:   1 MSILKIENLQKYYGSHHALKDINLEVKAKEVVVILGPSGCGKSTLLRCINGLEEIASGNI    60

Query:  61 VMDGVGEFGKDVS-WQTARQKVGMVFQSYELFAHMTVIENILLGPVKVQNRDRAEAEAQA   119
           +D  +  KD   W RQKVGMVFQSYELF H++V ENILLGP+KVQ R + E     +A
Sbjct:  61 YIDNE-KIDKDFKEWPRMRQKVGMVFQSYELFEHLSVEENILLGPMKVQKRKKDEVLKEA   119

Query: 120 GKLLERVGLLDRKNAYPRELSGGQKQRIAIVRALCLNPEVILLDEITAALDPEMVREVLE   179
              LE+VGLL +  +AYPRELSGGQKQRIAIVR+LC+NPE++L DE+TAALDPE+VREVLE
Sbjct: 120 KIWLEKVGLLHKIHAYPRELSGGQKQRIAIVRSLCMNPELMLFDEVTAALDPEIVREVLE   179

Query: 180 VVLELAREGMSMLIVTHEMGFARKVADRIVFMDKGGIVESSDPETFFSAPKSERARQFLA   239
           V+L  LA+EGM+MLIVTHEMGFA+ VAD+I+FMD+G I+E  +DP++FF   PKSERA++FL
Sbjct: 180 VMLNLAKEGMTMLIVTHEMGFAKAVADKIIFMDEGKIIEENDPKSFFKNPKSERAKKFLN   239

Query: 240 GMDY                                                         243
              DY
Sbjct: 240 LFDY                                                         243
```

Based on this analysis, it was predicted that this protein from *N. gonorrhoeae*, and its epitopes, could be useful antigens for vaccines or diagnostics.

EXAMPLE 156

A DNA sequence was identified in *N. gonorrhoeae* <SEQ ID 311> which encodes amino acid sequence <SEQ ID 312; NGS159>. Analysis of this protein sequence reveals the following:

```
GvH Examining signal sequence (von Heijne)
    Signal Score (-7.5): -4.16
    Possible cleavage site: 13
>>> Seems to have no N-terminal signal seq.
Amino Acid Composition of Predicted Mature Form:
    calculated from 1
ALOM: Finding transmembrane regions (Klein et al.)
    count: 0   value:   6.47 threshold:   0.0
    PERIPHERAL   Likelihood =   6.47
    modified ALOM score:   -1.79
Rule: cytoplasmic protein
*** Reasoning Step: 2
----- Final Results -----
        bacterial cytoplasm --- Certainty=
            0.312(Affirmative) < succ>
        bacterial periplasmic space --- Certainty=
            0.000(Not Clear) < succ>
        bacterial outer membrane --- Certainty=
            0.000(Not Clear) < succ>
        bacterial inner membrane --- Certainty=
            0.000(Not Clear) < succ>
```

The protein has homology to the following sequences in the databases:

A homolog was found in serogroup A *N. meningitidis* but not in serogroup B, so NGS159 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 157

A DNA sequence was identified in *N. gonorrhoeae* <SEQ ID 313> which encodes amino acid sequence <SEQ ID 314; NGS160>. Analysis of this protein sequence reveals the following:

```
GvH Examining signal sequence (von Heijne)
    Signal Score (-7.5): -8.3
    Possible cleavage site: 33
>>> Seems to have no N-terminal signal seq.
Amino Acid Composition of Predicted Mature Form:
    calculated from 1
ALOM: Finding transmembrane regions (Klein et al.)
    count: 0   value:   7.85 threshold:   0.0
    PERIPHERAL   Likelihood =   7.85
    modified ALOM score:   -2.07
Rule: cytoplasmic protein
*** Reasoning Step: 2
----- Final Results -----
        bacterial cytoplasm --- Certainty=
            0.407(Affirmative) < succ>
        bacterial periplasmic space --- Certainty=
            0.000(Not Clear) < succ>
        bacterial outer membrane --- Certainty=
            0.000(Not Clear) < succ>
        bacterial inner membrane --- Certainty=
            0.000(Not Clear) < succ>
```

The protein has homology to the following sequences in the databases:

```
> ^^ **gbp_15794799 gi|1579479.9|ref|NP_284621.1|\(NC_003116)
hypothetical protein [Neisseria meningitidis Z2491]
pir||B81819 hypothetical protein NMA1914 [imported]- Neisseria
meningitidis (group A strain Z2491)
emb|CAB85135.1|(AL162757) hypothetical protein [Neisseria meningitidis
Z2491]
Length = 206
Score = 265 bits (678), Expect = 8e-70
Identities = 131/146 (89%), Positives = 138/146 (93%)

Query:    1 MTKLYAQIAKTEAQDDGTVKVWGYASSEAVDSDGEVVAAEAMKAAIPDYMKFGAVREMHG   60
            MTKLYA+IAK E QDDGTVKVWGYASSE +DSDGEV+AA AMKAAIPDYMKFGA REMHG
Sbjct:    1 MTKLYAEIAKMETQDDGTVKVWGYASSEEIDSDGEIAAAAMKAAIPDYMKFGAGREMHG   60

Query:   61 SNAAGTAIEINVEDDGRTFFGAHIVDPVAVTKVKTGVYKGFSIGGSVTARNDLNKSQITG  120
            SNAAGTAIEINVEDDG TFFGAHI+DPV V+KVKTGVYKGFSIGGSVTAR+DLNKSQITG
Sbjct:   61 SNAAGTAIEINVEDDGITFFGAHIIDPVVVSKVKTGVYKGFSIGGSVTARDDLNKSQITG  120

Query:  121 LKLTEISLVDRPANPDAVFTCFKADK                                   146
            LKLTEISL+DRPANPDAV TCFKADK
Sbjct:  121 LKLTEISLIDRPANPDAVSTCFKADK                                   146
```

```
> ^^ **gbp_2126352 gi|2126352|pir||JC5218 type I site-specific
deoxyribonuclease (EC 3.1.21.3) Hsd chain S [validated]-Pasteurella
haemolytica
gb|AAC44667.1|(U46781) HSDS [Mannheimia haemolytica]
Length = 442
Score = 97.1 bits (240), Expect = 3e-19
Identities = 55/149 (36%), Positives = 81/149 (53%), Gaps = 3/149 (2%)

Query:   26 EVAEYSKNRICSDKLNEHNYVGVDNLLQNREGKKLSGYVPSEGKMTEYIVNDILIGNIRP    85
            ++E   +I   L + NY+  DN+L N  G  L+  +P+       +   DIL  NIR
Sbjct:   10 DIVELISEKIKIKDLKKENYISTDNMLPNFGGITLAENLPNSASCNRFAKKDILFSNIRT   69

Query:   86 YLKKIWQADCTGGTNGDVLVIRV--TDEKVNPKYLYQVLADDKFFAFNMKHAKGAKMPRG   143
            Y  KK+W A+  +GG + DVLV+R     TD  +N +YL+ ++  D F   F +  A GAKMPRG
Sbjct:   70 YFKKVWLAEFSGGCSPDVLVMRSKNTDILLN-EYLFLLIRSDDFINFTVISANGAKMPRG  128

Query:  144 SKAAIMQYKIPIPPLPEQEKIVAILGKFD                                172
            K A+  +    IP +  Q+K +A      FD
Sbjct:  129 DKNAMKGFIFNIPSIEYQKKCIANYFAFD                                157
```

Based on this analysis, it was predicted that this protein from *N. gonorrhoeae*, and its epitopes, could be useful antigens for vaccines or diagnostics.

EXAMPLE 158

A DNA sequence was identified in *N. gonorrhoeae* <SEQ ID 315> which encodes amino acid sequence <SEQ ID 316; NGS161>. Analysis of this protein sequence reveals the following:

GvH Examining signal sequence (von Heijne)
    Signal Score (-7.5): -5.08
    Possible cleavage site: 36
>>> Seems to have no N-terminal signal seq.
Amino Acid Composition of Predicted Mature Form:
    calculated from 1
ALOM: Finding transmembrane regions (Klein et al.)
    count: 1   value: -1.59 threshold: 0.0
    INTEGRAL    Likelihood = -1.59    Transmembrane
    302-318 (302-318)

-continued

PERIPHERAL    Likelihood = 3.76
modified ALOM score: 0.82
Rule: cytoplasmic membrane protein
*** Reasoning Step: 2
----- Final Results -----
    bacterial inner membrane --- Certainty=
    0.164(Affirmative) < succ>
    bacterial periplasmic space --- Certainty=
    0.000(Not Clear) < succ>
    bacterial outer membrane --- Certainty=
    0.000(Not Clear) < succ>
    bacterial cytoplasm --- Certainty=
    0.000(Not Clear) < succ>

The protein has homology to the following sequences in the databases:

```
pir||E81921 probable DNA-invertase NMA0772 [imported]-Neisseria
meningitidis (group A strain Z2491)
emb|CAB84055.1|(AL162754) putative DNA-invertase [Neisseria
meningitidis Z2491]
Length = 321
Score = 295 bits (755), Expect = 9e-79
Identities = 151/322 (46%), Positives = 216/322 (66%), Gaps = 3/322 (0%)

Query:   14 LRNAVGLDISKLTFDATAIVGNAEYSKFDNDSKGLDQFSDRLKSLGCQNLHICMEATGN    73
            +RNAVGLDIS  TFD  I+     KF ND +G   + +  +    ++++CMEATGN
Sbjct:    1 MRNAVGLDISAKTFDVVTIINGETDYRKFSNDEQGCKNLKEWISAKREKDIYVCMEATGN   60

Query:   74 YYEEVADYFAQYYSVYVVNPLKISKYAESRFKRTKTDKQDAKLIAQYCRSAQESELVKRQ  133
            YYE+ AD  A+ Y V V+NPLKI  YA+ RF R K DKQDAKLIA++C++A    EL KR+
Sbjct:   61 YYEQAADCLAEEYHVSVINPLKIKAYAQKRFSRVKNDKQDAKLIAEFCQTALIEELPKRE  120

Query:  134 KPTDEQYRLSRMTAAYAQIKSECAAMKNRHHAAKDEEAAKAYAEIIKAMNEQLEVLKEKI  193
            KPT++QY L R+ +  +Q+  +  + KNR  AAKD    K + ++K +     L  +K+KI
Sbjct:  121 KPTEQQYSLKRLLSLQSQLLEQQTSQKNRIRAAKDSFVQKIHEKQLKELENHLNAVKKKI  180

Query:  194 KEQTEKPN--CKEGVKRLETIPAIGRMTAAVLFHHLTSSKFETSNKFAAFAGLSPQQKES  251
            ++QT K +   KE KRLETIP++G+ TA   L  +L +S  FE  +FA +AGL+P Q    S
Sbjct:  181 -DQTIKSDKKMKELTKRLETIPSVGKTTAISLMSYLINSTFENAKQFTAYAGLNPHQNIS  239

Query:  252 GTSVRGKGKLTKFGNRKLRAVLFMPAMVAYRIRAFPDFIKRLEEKKKPKKVIIAALMRKL  311
            GTSV  K K+TK+GNR++R   LFM A+VA++      FP F  RL++ KKPK +II ALMRK+
Sbjct:  240 GTSVNKKSKMTKYGNRRIRGSLFMAALVAFKNNYFPAFTNRLKKAKKPKMLIIGALMRKI  299

Query:  312 AVIAYHVHKKGGDYDPSRYKSA                                       333
            V+A++++K    D+D +RY++A
Sbjct:  300 LVVAFNLYKTETDFDKTRYQTA                                       321
```

A homolog was found in serogroup A *N. meningitidis* but not in serogroup B, so NGS161 protein and nucleic acid are useful for distinguishing between gonococcus and serogroup B *N. meningitidis*.

Based on this analysis, it was predicted that this protein from *N. gonorrhoeae*, and its epitopes, could be useful antigens for vaccines or diagnostics.

EXAMPLE 159

A DNA sequence was identified in *N. gonorrhoeae* <SEQ ID 983> which encodes amino acid sequence <SEQ ID 984; NGS162>. Analysis of this protein sequence reveals the following:

---

GvH: Examining signal sequence (von Heijne)
　　Signal Score (−7.5): −0.86
　　Possible cleavage site: 33
>>> Seems to have no N-terminal signal seq.
Amino Acid Composition of Predicted Mature Form:

---

-continued

--- calculated from 1
ALOM: Finding transmembrane regions (Klein et al.)
　　count: 0　value:　4.08 threshold:　0.0
　　PERIPHERAL　Likelihood =　4.08
　　modified ALOM score:　−1.32
Rule: cytoplasmic protein
*** Reasoning Step: 2
----- Final Results -----
　　　　bacterial cytoplasm --- Certainty=
　　　　0.032(Affirmative) < succ>
　　bacterial periplasmic space --- Certainty=
　　0.000(Not Clear) < succ>
　　　bacterial outer membrane --- Certainty=
　　　0.000(Not Clear) < succ>
　　　bacterial inner membrane --- Certainty=
　　　0.000(Not Clear) < succ>

---

The protein has homology to the following sequences in the databases:

```
ref|NP_312507.1|(NC_002695) hypothetical protein [Escherichia coli
O157:H7]
gb|AAG5B749.1|AE005587_7 (AE005587) putative adhesin [Escherichia coli
O157:H7 EDL933]
dbj|BAB37903.1|(AP002566) hypothetical protein [Escherichia coli O157:H7]
Length = 1588
Score = 120 bits (302), Expect = 4e-26
Identities = 109/359 (30%), Positives = 170/359 (46%), Gaps = 65/359 (18%)

Query:   22 AVALGSSSTASGEYSYASGYNSVASGNKSYAAGYASVASAEGSVVIGDSRQVKPEADQGV   81
            + A+G  + A G+YS A G  + AG  SAG ++++  + S+ +G S       +    +
Sbjct:   93 STAVGYDAIAEGQYSSAIGSKTHAIGGASMAFGVSAISEGDRSIALGASSYSLGQYSMAL  152

Query:   82 AVGSKATVKNKAKQRVVVGSEAKVNAERGIAIGKEAKAGGKTTNTLLDGPAYYADAIAVG  141
               SKA       K  + +G  +K      IA+G    KA       T  +       +IA+G
Sbjct:  153 GRYSKAL----GKLSIAMGDSSKAEGANAIALGNATKA----TEIM---------SIALG  195

Query:  142 YQAEAGKGGAIALGKQAKATKQNGMALGVESEAAGDFSTAVGNESKAKGQGG--------  193
             A  A K  ++ALG  + A+++N +A+G E+EAA +  +TA+GN +KAKG
Sbjct:  196 DTANASKAYSMALGASSVASEENAIAIGAETEAA-ENATAIGNNAKAKGTNSMAMGFGSL  254

Query:  194 ------VGLGNQSKAEADFAVAV--GNKAEATKE-----------NSLVIGRYARANGN  233
                  + LGN S+A AD A+A+  GNKA+            N++ +G   A G+
Sbjct:  255 ADKVNTIALGNGSQALADNAIAIGQGNKADGVDAIALGNGSQSRGLNTIALGTASNATGD  314

Query:  234 HSVSLGSRSEIKDGVSNSVAPGYGSVASENNVVSVAYKETPQSTELSYRKIVGVDDGV--  291
            S++LGS S   +G+ NSVA G  S+A  +N VSV           RKIV  V +G
Sbjct:  315 KSLALGSNSS-ANGI-NSVALGADSIADLDNTVSVGNSSLK-------RKIVNVKNGAIK  365

Query:  292 -NDFDAVNVRQLKAMQGQNMAELFSVRSEVRGVAASSAALSALTPLSYDANNPTQFMVG  349
             + +DA+N  QL A+        SV   + G AA        +T  +Y+  N  ++  VG
Sbjct:  366 SDSYDAINGSQLYAISD-------SVAKRLGGGAAVDVDDGTVTAPTYNLKNGSKNNVG  417

Score =  86.3 bits (212), Expect = 1e-15
Identities = 68/253 (26%), Positives = 118/253 (45%), Gaps = 39/253 (15%)

Query:   28 SSTASGEYSYASGYNSVASGNKSYAAGYASVASAEGSVVIGDSRQVKPEADQGVAVGSKA   87
             S+  +G    +G + A  +         Y S ++ +G V IG          G+KA
Sbjct:   38 SALVAGGMLSSFGALANAGNDNGQGVDYGSGSAGDGWVAIGK--------------GAKA   83

Query:   88 -TVKNKAKQRVVVGSEAKVNAERGIAIGKEAKAGGKTTNTLLDGPAYYADAIAVGYQAEA  146
              T  N +       VG +A      +      AIG +       +           +A G   A +
Sbjct:   84 NTFMNTSGSSTAVGYDAIAEGQYSSAIGSKTHAIGGAS------------MAFGVSAIS  130

Query:  147 GKGGAIALGKQAKATKQNGMALGVESEAAGDFSTAVGNESKAKGQGGVGLGNQSKAEADF  206
                  +IALG  +  + Q  MALG  S+A G  S  A+G+ SKA+G      + LGN +KA
Sbjct:  131 EGDRSIALGASSYSLGQYSMALGRYSKALGKLSIAMGDSSKAEGANAIALGNATKATEIM  190

Query:  207 AVAVGNKAEATKENSLVIGRYARANGNHSVSLGSRSEIKDGV-----------SNSVAPG  255
             ++A+G+  A A+K  S+ +G  + A+     ++++G+ +E  +            +NS+A G
Sbjct:  191 SIALGDTANASKAYSMALGASSVASEENAIAIGAETEAAENATAIGNNAKAKGTNSMAMG  250

Query:  256 YGSVASENNVVSV                                                268
             +GS+A  + N +++
Sbjct:  251 FGSLADKVNTIAL                                                263
```

Based on this analysis, it was predicted that this protein from *N. gonorrhoeae*, and its epitopes, could be useful antigens for vaccines or diagnostics.

EXAMPLE 160

Further open reading frames were identified in gonococcus <SEQ IDs 317/318 to 8621/8622>. These polypeptide and nucleotide sequences are useful for studying gonococcus, for diagnostic purposes, as antibiotic targets, and as vaccine antigens.

It will be understood that the invention has been described by way of example only and modifications may be made whilst remaining within the scope and spirit of the invention.

SEQUENCE LISTING (9218 sequences)

SEQ ID NO: 1 - DNA, 540 bp, Neisseria gonorrhoeae
atgattaatcatattgaaaaatatataggcactatttctcatggctcgaaaagcgattcgggaagtcagtacaaattaaatatcgcagctattccctcttcccctaacagggatttaaaaacttatattactttagggttaagcaaacatgatctgaattataaaagcagatttgaaatactttttgtatgttctttaaaatatgatgaaaatcagattttcccatttttaagatggttagcagaaaccatcattgagaataaaaaaatccttcttcgggggcaggttgtttatttgcctagaagcattgttaattcaacaaaaatggatgcactgtatgtttccgccccattttatttcgacgatgatttccaagtctgttatggcgaacactacaatattgttttccctttgcttgtccccttgtataaacaggaagccgaattggtggaaaaaaagggttggaatgcttttgagcagttcttgctggataatgaagttggcaacctttcggatatgaatcggaaaccgtttacttgg

SEQ ID NO: 2 - protein, 180 aa, Neisseria gonorrhoeae
MINHIEKYIGTISHGSKSDSGSQYKLNIAAIPSSPNRDLKTYITLGLSKHDLNYKSRFEILFVCSLKYDENQIFPFLRWLAETIIENKKILLRGQVVYLPRSIVNSTKMDALYVSAPFYFDDDFQVCYGEHYNIVFPLLVPLYKQEAELVEKKGWNAFEQFLLDNEVGNLSDMNRKPFTW

SEQ ID NO: 3 - DNA, 546 bp, Neisseria gonorrhoeae
atggactataaccaaactgttttatctcacttgcaaaaattttggaaacatcatgatattaaaggatttacttggactttaggaagaattgttgaagaacttcccgatttccaagttttccaagtgattcctaatcatgaagatgagccttgggtttatgtcagctctgggataggtcaatttttagggcaggagttttttatcatcagcccgtttgaaacacctgaacatattgagaccttggcaatgctggcatctgcaagtatgcattatcctgatcaatttcaattagggaaaaccgtcaatatcggtagaccgtgggtcgagcaatcatccttccggcattttctgatttctctgccttatccttatgggcaagagttggaatatatggataatgtccgatttttctggttattgccaattacccagacagaaagacttttcttgaatactcattcggtagaagaattggaaacgaaatttgatgaagcgggtattgattatttagatataaatcgtgcgagtactgtctggcaggcagga

SEQ ID NO: 4 - protein, 182 aa, Neisseria gonorrhoeae
MDYNQTVLSHLQKFWKHHDIKGFTWTLGRIVEELPDFQVFQVIPNHEDEPWVYVSSGIGQFLGQEFFIISPFETPEHIETLAMLASASMHYPDQFQLGKTVNIGRPWVEQSSFRHFLISLPYPYGQELEYMDNVRFFWLLPITQTERLFLNTHSVEELETKFDEAGIDYLDINRASTVWQAG

SEQ ID NO: 5 - DNA, 828 bp, Neisseria gonorrhoeae
atgaaccccgtttggattattaccggcaaagaagcccgcgacagcctgcgtaaccgctgggtgcttgccgccgtcctcctgcttgccgcactcgccctttctttgggtttcctcggcagctcgcccaccggttcggtcaaggtcgatccgctgaccgttaccgtcgtcagcctgtcgagcctgtctattttcctgattccgctgattgcgatgctgctttcttatgacgcactgatcggcgaaatcgaacgcggtacgatggcgttgctgttgagttatcccatttggcgcaaccaaatccttgccggcaagtttgtcggacacctcatcatcctcgcccttgccaccacggcaggttacggattggcaggcattacgctgcaacttgccaacggcggtttcgacatcgccgcttggaaaccctttgcgctgttgattgccgccagcgtgattttaggtgcggcatttctgtctatgggctacttgattagtgcaaaggtcaaagagcgggggacggcggccggtatttccatcggcgtatggttgtttttcgtcgtcatcttcgatatggcgcttttgggtattctggttgccgactcgaaacaggtcatcaccgcgcccgtcgttgaaacggtgctgctgttcaatcccaccgacatttaccgcctgctcaacctgaccggttacgaaaatacggctatgtatgcgggtatggcgggtttgagcggacaaatcggcctgaccgtccccgttttgctgaccgcgcaggttttatgggttatcattccgcttgttttggcagccggaatttttagaaagcgacgaata

SEQ ID NO: 6 - protein, 276 aa, Neisseria gonorrhoeae
MNPVWIITGKEARDSLRNRWVLAAVLLLAALALSLGFLGSSPTGSVKVDPLTVTVVSLSSLSIFLIPLIAMLLSYDALIGEIERGTMALLLSYPIWRNQILAGKFVGHLIILALATTAGYGLAGITLQLANGGFDIAAWKPFALLIAASVILGAAFLSMGYLISAKVKERGTAAGISIGVWLFFVVIFDMALLGILVADSKQVITAPVVETVLLFNPTDIYRLLNLTGYENTAMYAGMAGLSGQIGLTVPVLLTAQVLWVIIPLVLAAGIFRKRRI

SEQ ID NO: 7 - DNA, 1599 bp, Neisseria gonorrhoeae
atgtcagacgaaaaattagaacaaaacggcttgagccgtcgttcgttcttaggtacggccgccgcttccggtgcaggtattgccggtgcgggcctgttgggtttggcgggttgctctaaagacggcgaacaggctgccgctaacgcttccggcgcggctcccgtcgccaaggcgcaaggggaatccaaacccggccaactgtcttccgaagtcggtccgggcgaactcgatcaatattacggtttcctttccggcggccagtccggcgagatgcgcctgatcggtctgccttctatgcgcgaactgatgcgtatccccgtgttcaatatggacagcgcgaccggttggggacgcaccaatgagagcttgaaagtcctcaacggcaatattaccgaagaaacccgtaaattcttaaaagacagcggcctgcgctgctaccccaacggcgacttgcaccacccgcacctgtcgtttaccgaccaaacttatgacggccgctatgcctatgccaacgacaaggcaaacaaccgcgtctgccgcgtgcgtttggatgtgatgaaggccgacaaaatcatcgacatccctaatgattcaggtattcacggtctgcgtccgcaacgttatccgaaaaccggttatgtttttgccaacggcgaacacattacccctgtcagcggtgtaggcaaactggatgatgcgaaaacctggaatgcagtgtacaccgccatcgacggcgaaaccatggagatcgcatggcaagtattggttgacggtaacctggacaacggcgatgccgactatcaaggcaaatattcttttgccacctgctacaactccgagcgcgcgctgaccgtacaaggtgcgtcttccaacgagcaggactggtgcgtcgttttcgacctgaaagccatcgaagaaggcatcaaagcgggcgacttcaaagaagttaacggtgtgaaaatgctggacggccgcgctgaggccaaatccaaatacacgcgttatatccctgtgccgaactctcctcacggctgtaacgcaagccctgacggtaaatacatcatgcccaacggtaaactgcctccaaccgttaccgtattggatgtcagcaaactggacgatttgttcgccggcaaaatcaaagagcgcgatgtggtcgtagccgaaccgcaactgggtctcggcccgttacacactgcattcgacggtcgcggcaatgcttatacgacattgtttatcgacagccaaatggtgaaatggaatattgacgatgcgatcaaagcctacaaaggcgagaaaatcgatccgatcaaacaaaaactcgacgttcactatcaaccgggtcacaaccatacgaccatgggcgaaaccaaagaagccgacggtcaatggctggtgtccttgaacaaattctccaaagaccgcttcttgaatgccggtcctttgaaacccgagtgcgaccaattgatcggcatctccggcgacgaaatgcgtctggtacacgacaacccgacttttgccgaaccgcacgacttgtgtttggttgccgcgtccaaactgaacccgggcaaaacttgggaccgcaaagacccgtggttc

SEQ ID NO: 8 - protein, 533 aa, Neisseria gonorrhoeae
MSDEKLEQNGLSRRSFLGTAAASGAGIAGAGLLGLAGCSKDGEQAAANASGAAPVAKAQGESKPGQLSSEVGPGELDQYYGFLSGGQSGEMRLIGLPSMRELMRIPVFNMDSATGWGRTNESLKVLNGNITEETRKFLKDSGLRCYPNGDLHHPHLSFTDQTYDGRYAYANDKANNRVCRVRLDVMKADKIIDIPNDSGIHGLRPQRYPKTGYVFANGEHITPVSGVGKLDDAKTWNAVYTAIDGETMEIAWQVLVDGNLDNGDADYQGKYSFATCYNSERALTVQGASSNEQDWCVVFDLKAIEEGIKAGDFKEVNGVKMLDGRAEAKSKYTRYIPVPNSPHGCNASPDGKYIMPNGKLPPTVTVLDVSKLDDLFAGKIKERDVVVAEPQLGLGPLHTAFDGRGNAYTTLFIDSQMVKWNIDDAIKAYKGEKIDPIKQKLDVHYQPGHNHTTMGETKEADGQWLVSLNKFSKDRFLNAGPLKPECDQLIGISGDEMRLVHDNPTFAEPHDLCLVAASKLNPGKTWDRKDPWF

SEQ ID NO: 9 - DNA, 1245 bp, Neisseria gonorrhoeae
atgaaactaaatactctcacatgggctttgatgaccgttttttccgttgcgccatcttgggcagaacaaccggcaaatactgaagaaatacaacccgtcaaaaccttctccccgcccaaaccgattgcaccgaccgccgcacaaggctatttccccgaaaaccaattcgaccgctccgaccgcagcgattattactttgttaccgaaaacatagaccaagccttccgtccgctgaaggcaaacagcagtttttacggcaaaagcttttacaactccgttaccgcgcaagcactcggggcgaaggtatacggcgtagccaacctcaatcgcaccaaggcaaacggctacaaagatggcggtgggcgcgacactgattggaaatacagccgcttcaatcaggctttggtactcggtttcgtgccgtctgaaaatcaagaataccgcctcacttatctgcacgacgacatcaacaacgaccgccagccgcaggtcgtcaacgacgcattggacaccgaacgccacatctccaaactcaacgtgcgttggggcaatgccgatttgagcaatacggtcagcgcggaagcaggcgtcatcaaactcaaacgccatgccgacaattactccttgcgaccaaacaacacgccgcagcaagtgttcgtagaacttgaccgcaaagtgtatgatttctcgctcaaacacgatgcggatttcggcaaattccacaacacggcagccgtcagctaccgcaacgacagccaaaacggcgaacgcaacacccacactgccatgtgcgatttcctcaacggctaccgtttcgccgatgtgcacatcgaccgctggtgcattgccgataccttatcttacaagtttgacgaccgacacaaactgggcttgggcttaagctacgaactcaacgaagcggacattcgcaaaaatacggcacagcctgaaaacccaataaaacccggtttccccttcgcctcatcacaacaaatctggaaaacccattacggctacgacttcaacggcaaagtgcgccgtcatgctttgtcaggcgaactcaaatacgatttcacgccgtctgaaacgcaaaaatacagcgtttccctcgcgcatttggaacgcatcggcgacaacaccgaacgcttcaactcgcttgctgccatcgtgcaaaaccgtatgagcggcatgctgatgaaccaaaatccagccgccgccattgcaggcaatccccctgctgaaaac

SEQ ID NO: 10 - protein, 415 aa, Neisseria gonorrhoeae
MKLNTLTWALMTVFSVAPSWAEQPANTEEIQPVKTFSPPKPIAPTAAQGYFPENQFDRSDRSDYYFVTENIDQAFRPLKANSSFYGKSFYNSVTAQALGAKVYGVANLNRTKANGYKDGGGRDTDWKYSRFNQALVLGFVPSENQEYRLTYLHDDINNDRQPQVVNDALDTERHISKLNVRWGNADLSNTVSAEAGVIKLKRHADNYSLRPNNTPQQVFVELDRKVYDFSLKHDADFGKFHNTAAVSYRNDSQNGERNTHTAMCDFLNGYRFADVHIDRWCIADTLSYKFDDRHKLGLGLSYELNEADIRKNTAQPENPIKPGFPFASSQQIWKTHYGYDFNGKVRRHALSGELKYDFTPSETQKYSVSLAHLERIGDNTERFNSLAAIVQNRMSGMLMNQNPAAAIAGNPPAEN

SEQ ID NO: 11 - DNA, 699 bp, Neisseria gonorrhoeae
ttgcaggcaatccccctgctgaaaactgaaaaacacaaccgcatcaggctcaccgccgacagccgcaacgactactacaacggctacatgaactcgctcgcaggcgcgggctggaacgtgggcggcacgcttgtggcggacaaagtcaaagacctgattatttttgaccgcgcacacggacaaagcggcacagcttccaaagacggcggcatcatcacacgcaacgtggacgcacgattgtttaccgcgcaggcctacgcgcgttacaacttcaatccgcattgggcggcaggcatcaaagccgcctacaactacggacacaacgaaaccgacggcaggccgccctatcaaatccgtccgtttgaagccgccgtccaagccgactacaaaaactactttgcccacggcagctacaacatcggcgcggcaacacgctttgtcgccaaacaaacgcgcggtgattttgatatggcaagcggtctgggcatagacaaacgcgaagccgccaaaggctttaccgttgccgacgtgtacgcaggcgtaaacatcaaagacaaatacggcttgcgcttgggcgtgaacaacgtattcaacaaaaaatacgtcgaatacatcagcggcgaccacgtcctcgccctatcccccagcgtagtgtatgcaccgggcaggacatattggttgagtttgcatgcggcattt

SEQ ID NO: 12 - protein, 233 aa, Neisseria gonorrhoeae
LQAIPLLKTEKHNRIRLTADSRNDYYNGYMNSLAGAGWNVGGTLVADKVKDLIIFDRAHGQSGTASKDGGIITRNVDARLFTAQAYARYNFNPHWAAGIKAAYNYGHNETDGRPPYQIRPFEAAVQADYKNYFAHGSYNIGAATRFVAKQTRGDFDMASGLGIDKREAAKGFTVADVYAGVNIKDKYGLRLGVNNVFNKKYVEYISGDHVLALSPSVVYAPGRTYWLSLHAAF

SEQ ID NO: 13 - DNA, 975 bp, Neisseria gonorrhoeae
atggatatgaaaagacgcgatttcttaaaaatgaccgccgcgctggcagccgcaggcgtttcgccttctctgcttgctgccggtaaagagcaatttaccgtgtacggcgcaccggcaatgcccagcgttaccattgccgtagcggcgttgcaaggtaaactggcgaaacaggcggacgtgtcgctgaaaatctggcgttcgcccgaccaactgcgcgcgggcgtggcaagcgggcaatttaaagtgatgatgagtccgagcaatgtcggcgtaaacctgcgcaaccaagggcagaaagtcggcatggtgaatattttgaccaacggcatcacgcagttggtctgcaaaggcagcgcgattgcctcgccgcaggatttggtcggcaaaaaaatcctcgtgccgtttaaaaacgatatgcccgacatcgtgctgcaagccttgttgaaaaaactgaaaatcgacgcacacaaagtcagcattacctacgctgccacaccgcccgaagcagtcggactatttccaagtaaaggttaccatgccgtcatcctgcccgaaccgatggcaaccgccagcctactgaaaggcaaaaccataggtataaacgtcgtgcacggttttgatttggtgaaagcatgggggcaggcgtttgacaccaaaccgctgattccgatggcaggtatcatcgccaacgaagaatatttccacgcacacaaggcgcagttcgacatcttccatcaagatttgaaaaacgcgctcaactggatattggccaaccgccaaaacgcggcgaaaatcggcaaaaactacctacccgcccccgaacccgccctagtcatgggcttggacggcgcacggctgacggtaagcaaaggcagcgaagtgaaaaacgagattttgaagttttacgaaatcctgatgcagttcaacccggaacttttgggcggcaagctgccggataacgggttcttcttggct

SEQ ID NO: 14 - protein, 325 aa, Neisseria gonorrhoeae
MDMKRRDFLKMTAALAAAGVSPSLLAAGKEQFTVYGAPAMPSVTIAVAALQGKLAKQADVSLKIWRSPDQLRAGVASGQFKVMMSPSNVGVNLRNQGQKVGMVNILTNGITQLVCKGSAIASPQDLVGKKILVPFKNDMPDIVLQALLKKLKIDAHKVSITYAATPPEAVGLFPSKGYHAVILPEPMATASLLKGKTIGINVVHGFDLVKAWGQAFDTKPLIPMAGIIANEEYFHAHKAQFDIFHQDLKNALNWILANRQNAAKIGKNYLPAPEPALVMGLDGARLTVSKGSEVKNEILKFYEILMQFNPELLGGKLPDNGFFLA

SEQ ID NO: 15 - DNA, 606 bp, Neisseria gonorrhoeae
atggcgatggtggcgttgtgggcgtggggcagcgccgtgttcggcgagtttatgctgcctgcgccggtagaggtgtttcaaaaatctttggatttattgaaacattttcaggaaaatgaaatcgggatttcgctgtggcggtcggtagtgggtatttcggttgctttgatagcaggattggcggcggggctggtggcggggctggtggcgggcagttttaagacggcgatggcgttgcttaagcctgtgattacgattttgttagcaatgccgccgattatttgggtggtgatggcgttgttttggttcgggttcggcaatccgagcgtgttgtttaccatcattgtgttggttgcgccgctgacgtttgcgagtgcggcggtcggaatggcgagcgtgaacaagcagcatgaggagttgtttgacgcttataaattaggccgtctgaaaaaaatccgctatctgtatatcccgcatctgacgggctatgtgatttccagcgtcggcgtggcggtggcgatgggggtgaaggcggtgatcatggcggaactcttaggcgcgagcaaaggcgtgggcgcgcggattgcggacgcgagggcaatgctg

SEQ ID NO: 16 - protein, 202 aa, Neisseria gonorrhoeae
MAMVALWAWGSAVFGEFMLPAPVEVFQKSLDLLKHFQENEIGISLWRSVVGISVALIAGLAAGLVAGLVAGSFKTAMALLKPVITILLAMPPIIWVVMALFWFGFGNPSVLFTIIVLVAPLTFASAAVGMASVNKQHEELFDAYKLGRLKKIRYLYIPHLTGYVISSVGVAVAMGVKAVIMAELLGASKGVGARIADARAML

SEQ ID NO: 17 - DNA, 606 bp, Neisseria gonorrhoeae
gtgaaagccttgttcgggccgagcggctgtggcaagacgacggttttacggctgattgcgggcttggaaacgccgaaatcgggcacgatacgtaatactttccacaaaacgggttttctgtttcaggaaaaccgcctgccggaaaacctgaccgcgatgcagaatatcgcgatttttatggacaacccagacgaaggcgaaatcgtcgcgctggcggcgaaagtcgggctgactgcgggcgatttgaacaaatatccgaccgaattgtccggcggcatggcgaaacgggtggcgtttttgcgcctgctgctgtgcggctgcgacctagccttgctggacgaaccgtttgtcggtttggaccgcgatttgcgcgatattttggttgctatgctggtggaaaaaatcgagcggcagggcatggcgtgtatactggtaacgcacgaccgcttcgaagccgcgcgcctgagccatgaaattatgctgctttccgctaagggcatgaacgtgcaaaacgtgataaccctgcccacgccgctgtccgaacgcgattcggcttttgaagaagtcgtggtggcaagggagtttcaggggattcattattatgag

SEQ ID NO: 18 - protein, 202 aa, Neisseria gonorrhoeae
VKALFGPSGCGKTTVLRLIAGLETPKSGTIRNTFHKTGFLFQENRLPENLTAMQNIAIFMDNPDEGEIVALAAKVGLTAGDLNKYPTELSGGMAKRVAFLRLLLCGCDLALLDEPFVGLDRDLRDILVAMLVEKIERQGMACILVTHDRFEAARLSHEIMLLSAKGMNVQNVITLPTPLSERDSAFEEVVVAREFQGIHYYE

SEQ ID NO: 19 - DNA, 666 bp, Neisseria gonorrhoeae
ttggggttgaggcaaaagctcagggggataataccaaacttagcaacctcaatcggcacatctgccgaagcaaatgcacccggggcattggctttagggggaagttctgaagcatcgaaaaaatttagtatagcagaaggctatctggcatctagtgatggctatggtgcaatagcgattggttctgccgccaagataaagcaattggaaaaaggcacaataaatcatattgtgggaaacgataataaaggtctttatgtcgatgcagacggcaatgtaacaaagataaccgtaaggactgagtcggaaaaagatattctctcaagatacggtcaaacttacggtgcggtggcactagggtttagatcttcttcacataatctttttgccagttcatttggagcgttttctacagccacagctattgaaagcttggcagtcggcgacagcagccaatcaacgggctaccgcagtgctacttttggcagtcacagcagggctttggcagaagaaagtttggcattaggttatgaaactcgggcaaatgcttatggttctgttgctttaggtgcagaatctgtggcgaatgaagaaaataccgtatcagtgagttccgatacattgaaacggaaaatcgttaatgtcgccgatggcacggaagattta

SEQ ID NO: 20 - protein, 222 aa, Neisseria gonorrhoeae
LGLRQKLRGIIPNLATSIGTSAEANAPGALALGGSSEASKKFSIAEGYLASSDGYGAIAIGSAAKIKQLEKGTINHIVGNDNKGLYVDADGNVTKITVRTESEKDILSRYGQTYGAVALGFRSSSHNLFASSFGAFSTATAIESLAVGDSSQSTGYRSATFGSHSRALAEESLALGYETRANAYGSVALGAESVANEENTVSVSSDTLKRKIVNVADGTEDL

SEQ ID NO: 21 - DNA, 483 bp, Neisseria gonorrhoeae
atgtcgccgatggcacggaagatttatgatgcagtaaatgtccgccagttgaaccgcttaagcaaacgtacaaaccgcgtcggcgcaagtgctgcggcgttggcttcgttaaaacctgcacaattaggcaaaaacgacaaattcgccttttctttgggctttggaagctataaaaatgcccaagcggtggcaatgggggcggtgtttaagcccgctgaaaatgtgttgcttaatgtggcgggcagttttgccggaccggaccgggctttcggcgcgggggttttttggaaattcggcggcaaaccgacacctgcggttgccgcacaaaacgcggcgcatcctgcaaaagttttgcaattgcggcaggaagtggcggcgttgcgcgcccggcaggcagaaaccgaccgcaaactgcacaaacaggccgaaatggaaaacgagctgcaacagttgcgccgcgcgttgtccgaattgaaaaaacat

SEQ ID NO: 22 - protein, 161 aa, Neisseria gonorrhoeae
MSPMARKIYDAVNVRQLNRLSKRTNRVGASAAALASLKPAQLGKNDKFAFSLGFGSYKNAQAVAMGAVFKPAENVLLNVAGSFAGPDRAFGAGVFWKFGGKPTPAVAAQNAAHPAKVLQLRQEVAALRARQAETDRKLHKQAEMENELQQLRRALSELKKH

SEQ ID NO: 23 - DNA, 627 bp, Neisseria gonorrhoeae
atgacggaggggaacggcgcacggacatttgccggaatcttttatgtttccattatcatactcttttcaatgcgctattccaggaaaaagaaaatagcttgtgcaggctgctttttgtttttcagacgacctgtaattaacggctgcttatccaatctgcttttcaaactacctgcaaccgcaaaatctgctgcaacccgctccctcccctgtgggggagggtttgggagagggcatttttcaagttgcggcaattccccccccccgctcaaaaaattccctaaccgccccaatacaagccttgcggcttactgccctctctctaactctctcccacggggagagaggactatgatgcccgccggcggcttgctattaggaatatctgaatcgtcattcccacgaaagtgggaatctagaaaccccaacgcagcgagaatctatcggagaaaccgaaacccgacagacccggattcccgcctgagcgggaatgacggaggggaacggcgcacggacatttgccggaatcttttatgtttccattatcatactcttttcaatgcgctattccaggaaaaagaaaatagcttgtgcaggctgctttttgtttttcagacgacctgtaat

SEQ ID NO: 24 - protein, 209 aa, Neisseria gonorrhoeae
MTEGNGARTFAGIFYVSIIILFSMRYSRKKKIACAGCFLFFRRPVINGCLSNLLFKLPATAKSAATRSLPCGGGFGRGHFSSCGNSPPPLKKFPNRPNTSLAAYCPLSNSLPRGERTMMPAGGLLLGISESSFPRKWESRNPNAARIYRRNRNPTDPDSRLSGNDGGERRTDICRNLLCFHYHTLFNALFQEKENSLCRLLFVFQTTCN

SEQ ID NO: 25 - DNA, 720 bp, Neisseria gonorrhoeae
ttgcttatagttgtacggtttgacatatgcacggaaggaaacgccatgactttcttcaaaccctctaccgtcgtgctgaccgcatccgcactcgcgctttccggctgcgttgccgaccccgtaaccggacagcagtccccaaacaaatccgccatgtacggtttgggtggcgcggcagtgtgcggcatcgtcggcgcactgacccacagcggcaaaggcgcacgcaattccgcgcttgcctgcggcgcaatcggcgcaggcgtgggcggctatatggactaccaagagcagcgtttgcgccaaaaccttgccggcacgcaaatcgaaatccaacgccaaggcaaccaaatcaggctggtgatgcccgaaagcgttaccttcgccaccggcagcgcggcgttgggcggcagtgcgcaatacgccctgaacactgccgcacagacgctggtgcagtatcccgacacgacgctgaccatcaacgggcacaccgacaacacaggttccgatgcagtcaacaatccgctttcgcaacaccgcgcccaagcggttgcctactatctgcagacgcgcggcgtggcggcttcgcgcctgacggtttacggctacggttcgcatatgccggtcgcgtccaacgctacggttgaaggccgcgcgcaaaaccgccgcgtcgaaatcctcatcaaccccgaccaacgcgccgtcaacgccgcacggcacatg

SEQ ID NO: 26 - protein, 225 aa, Neisseria gonorrhoeae
MTFFKPSTVVLTASALALSGCVADPVTGQQSPNKSAMYGLGGAAVCGIVGALTHSGKGARNSALACGAIGAGVGGYMDYQEQRLRQNLAGTQIEIQRQGNQIRLVMPESVTFATGSAALGGSAQYALNTAAQTLVQYPDTTLTINGHTDNTGSDAVNNPLSQHRAQAVAYYLQTRGVAASRLTVYGYGSHMPVASNATVEGRAQNRRVEILINPDQRAVNAARHM

SEQ ID NO: 27 - DNA, 417 bp, Neisseria gonorrhoeae
atgaaatcgaaacttactgtcgtctattacgatttggaaagcaatattgcagaagaaatactgtcaggaaacataatgcctgatggaaattttcttattcaagagattcctcttttcgcaccgaatttggctttaaacgacattgttgccatagaacgtgaggataagatgctgtttttcgaccacttgataaaagcttcaggaaataccacgataaacatcgttgttttggatcatttcccaaaggatttattggcagccatagaagaacacagtggtaaaatcagaaaaaatggagagaattatttatcggttaattttccgcccaaaaaatataattctgatttaaaaggaattttaaatagatatgaggaagcaaatatcctcagctacagggaagcttgtttgggcttctct

SEQ ID NO: 28 - protein, 139 aa, Neisseria gonorrhoeae
MKSKLTVVYYDLESNIAEEILSGNIMPDGNFLIQEIPLFAPNLALNDIVAIEREDKMLFFDHLIKASGNTTINIVVLDHFPKDLLAAIEEHSGKIRKNGENYLSVNFPPKKYNSDLKGILNRYEEANILSYREACLGFS

SEQ ID NO: 29 - DNA, 1161 bp, Neisseria gonorrhoeae
atggtgcaaatggcaacaataaccaagcggcgcaatccttccggcgaaacagtatatcgggttcaggtacgggtcggcaagaaaggctatcctgctttcaatgagagcaggacgttcagtaaaaaggctttggcggtcgaatgggggaagaaacgggaggcggaaatcgaagccggcccagaactgcttttcaagcgcggcaaggtcaagatgatgacgctgtccgaagctatgcggaagtatcttaacgaaacgcttggagcgggtcggtcaaagaaaatgggcttgcgttttctgatggagttcccgattggcggcatcggcatcgataagctgaaacggtctgatttcgcggaacacgttatgcagaggcggcgcggaatccccgaactggacattgcgccaatcgcggcttctacggcattgcaggagctgcaatatatccgttccgtgctaaaacacgccttttatgtgtgggggcttgaaataggctggcaggaattggatttcgcggcaaacgggctgaaacgctcgaatatggttgcgaaatctgcaatcagggacagattgccgaccacggaagaactgcaaaccctgacaacttatttcctgcggcaatggcaaagcaggaaatcttccataccgatgcacctgattatgtggctggcgatttatacgtcaaggcggcaggatgagatttgccgcctgctgtttgacgactggcacaaaaatgattgtacccggccggttcgtgatttaaaaaatccgaacggcagcacagggaataataaggagtttgatattctgcctatggctttgccggtcattgacgagctgccggaggaatcggtcaggaagcgtatgcttgccaacaaaggcatcgccgacagccttgtaccgtgcaacggaaaatcggtttccgccgcttggacgagggcgtgcaaggttcttggaattaaagacttgcgcttccacgatttacggcacgaggctgctacccgtatggctgaagacggcttcacgattccgcaaatgcaacgggtaacgctgcatgacggttggaacagcctgcagaggtatgtgagcgtacgcaaacgctcgacgcggctggattttaaagaggcaatgatgcaggcgcaaagcgatataaaatccgggaag

SEQ ID NO: 30 - protein, 387 aa, Neisseria gonorrhoeae
MVQMATITKRRNPSGETVYRVQVRVGKKGYPAFNESRTFSKKALAVEWGKKREAEIEAGPELLFKRGKVKMMTLSEAMRKYLNETLGAGRSKKMGLRFLMEFPIGGIGIDKLKRSDFAEHVMQRRRGIPELDIAPIAASTALQELQYIRSVLKHAFYVWGLEIGWQELDFAANGLKRSNMVAKSAIRDRLPTTEELQTLTTYFLRQWQSRKSSIPMHLIMWLAIYTSRRQDEICRLLFDDWHKNDCTRPVRDLKNPNGSTGNNKEFDILPMALPVIDELPEESVRKRMLANKGIADSLVPCNGKSVSAAWTRACKVLGIKDLRFHDLRHEAATRMAEDGFTIPQMQRVTLHDGWNSLQRYVSVRKRSTRLDFKEAMMQAQSDIKSGK

SEQ ID NO: 31 - DNA, 1242 bp, Neisseria gonorrhoeae
ttgcgacaacggcgccggcttcagctgcttcaactggaccgaacatttcaaacggacggcaaacctgatcagcctcatgcacagggaagcggcggcatgaggacgcacatccgaacctgcgtgtatcacgattccggcacaaaaggctcaaacacggcatcaggcataagcggcacggctgccggcgcggcggaacaagcgtttttcagcgcggcgaagacggcaaaccgcagcgcgtcagccgcatccgcaaacgctccgccacacccggacaagccaaagaacggacgaaaacccatgacgtttcaaggacacaacaaccgtaaaaaagccggcggctacgccgaatacatcacgggcggcagcttgaggcggctggttgccgccaaagtccgccgatactgcggcgaacacccgggcgtatttgacggcgcggcaggaagcgggcagctggagcagtacatcgaaccgtccgatttccgcgccgtagagatacaggcggaagcgtgtaaagccttgttgcaaaactaccctgccgccaaagtatacaacacaagccttttcctttataccgacggcgaaccgcaagactgcaccgtcatgaatccgccgttttccatcaagctaaaggatttgagcgaagacgaaaaaagccgtatcgcacaggaatacccgtggaagaaatcgggcgtagccgatgaaatcttcgttttaaaaggattggaaaacgcccgccgcttcggattcttcatcctgttccccggcatcgcctaccgcaaaagcgagcagcgattccgcgaaatcatcggcaaccggctggcagaactcaaccgcatacaaaacgcgtttgaagacacgccgatcgaagtgcttttactggttatcgacaaagacaaaaccgacggcggctgcatccgcgaactgtacgactgcaaaacagacaccctgcttgccgccgacacttggcaaatcgaaccggacttgtggcaaaccgtgcaagaacctgcaccgccgaaggaaaaggaagaccccgtcctcttggaacacgaatgccgtgacgcagcggcaaagcggattgcccgggaattgaggttcagcaaaatggtcaacgagatagaaggctggccgcatgccgaatttgacggcttttgcgaccgcctgtgcaacctgatacaggcagagaaatacggaaaaaaacactacttcccgtgcagcctgccacttttcggaggggcggccggc

SEQ ID NO: 32 - protein, 414 aa, Neisseria gonorrhoeae
LRQRRRLQLLQLDRTFQTDGKPDQPHAQGSGGMRTHIRTCVYHDSGTKGSNTASGISGTAAGAAEQAFFSAAKTANRSASAASANAPPHPDKPKNGRKPMTFQGHNNRKKAGGYAEYITGGSLRRLVAAKVRRYCGEHPGVFDGAAGSGQLEQYIEPSDFRAVEIQAEACKALLQNYPAAKVYNTSLFLYTDGEPQDCTVMNPPFSIKLKDLSEDEKSRIAQEYPWKKSGVADEIFVLKGLENARRFGFFILFPGIAYRKSEQRFREIIGNRLAELNRIQNAFEDTPIEVLLLVIDKDKTDGGCIRELYDCKTDTLLAADTWQIEPDLWQTVQEPAPPKEKEDPVLLEHECRDAAAKRIARELRFSKMVNEIEGWPHAEFDGFCDRLCNLIQAEKYGKKHYFPCSLPLFGGAAG

SEQ ID NO: 33 - DNA, 981 bp, Neisseria gonorrhoeae
atgcaaacagtagcaacaaaaccgacggcaaaacagatgcttgccgccaaacgcgcggcgaaggaatcaacgcggcaggaacgcgccgtcaaacgcgccgggacggtcagaaacgttgaccggaaccggctgtccgcccggtcaaaagcgcaaaaagaaaacatcgcccggatgttgtctggcgcaaaggtatcggaagacgaagccctgacgtgcggcatcatgatgcggctgtccctgcaggatatgcgctatgcctgcaatcaggaattaatcaacttcgccgaacatatcgtcaaacaggtgcaacgcttgggcctgtactgcaacactgacgaccccgcgaacggggaaagcgtactgtttgcctgccgcgaagcatcgcaggccgtcgctcaatggactaaagattttgacaatttaagcccgaatcagcgccaactcgtgctgcgtccgctgtcaaatctcttcgccgcgtacgaagaatttctgaaagacgcgcctgcacggctgatagccgaagtatcggcatactcattggccgtgcgggttgccaagaaagccatggcgtttttagagcttgacggcggtttgatttcggcggttggcaaagtcgtcaacggcgcggattcgcgcgcggaagcccgccgccttaaaatgccgtacgcggaatttacaggccggatcctacacgccgcgaacctgctttacgatgtgggcattcaggcggacaaggagctttcggcgatgtacggcaagccgctgaatcccgtgcgcccccgacggataagcgacgtgcgccggccgatgatgaaaatgcttgttgcggacaaaggcggcgcgttggtccgggccgtaaaagactcggaagacgtcatccggcattgcgacaacggcgccggcttcagctgcttcaactggaccgaacatttcaaacggacggcaaacctgatcagcctcatgcacagggaagcggcggca

SEQ ID NO: 34 - protein, 327 aa, Neisseria gonorrhoeae
MQTVATKPTAKQMLAAKRAAKESTRQERAVKRAGTVRNVDRNRLSARSKAQKENIARMLSGAKVSEDEALTCGIMMRLSLQDMRYACNQELINFAEHIVKQVQRLGLYCNTDDPANGESVLFACREASQAVAQWTKDFDNLSPNQRQLVLRPLSNLFAAYEEFLKDAPARLIAEVSAYSLAVRVAKKAMAFLELDGGLISAVGKVVNGADSRAEARRLKMPYAEFTGRILHAANLLYDVGIQADKELSAMYGKPLNPVRPRRISDVRRPMMKMLVADKGGALVRAVKDSEDVIRHCDNGAGFSCFNWTEHFKRTANLISLMHREAAA

SEQ ID NO: 35 - DNA, 645 bp, Neisseria gonorrhoeae
atgtacggaaatgtgccggatttagattgcctgctttacaggaaaccgcatataatcaaaagtatgaaaccgcacaacgataccattttccaagagccaaaggctgcccaagcggccgccttcctgctgtacaaggcaaacggcaggcttgaagtactgaagctgatgaagctgatgtacttggctgaacgtgagtcttttttacgcttcggagaaggcctgacaggtgacgcgttggtttcaatgccgcatggtccggtactctccatgaccttggatttcattaacggcggacatgagtccgttccgaacggatgggcaacgtgggttagcgaccgcgaaaacaggatgcttgccttacgcgatccaagtatgattcggacgcccgggcaagacttatcggcattatccgaagctgatttggaagtactggaatcggtttgggagaattacggccattattccgcatgggatctgcgcaacatgacccacaacgggttatgcccggaatgggaagaccctcacggctcaagccgcccgattcccatcaaaaaactgttgtctgtgcttggttatgatgacgaacaagccgtagcgattgtagaaaggctggaagaacaggcttacatcaatcgcgctttcggg

SEQ ID NO: 36 - protein, 215 aa, Neisseria gonorrhoeae
MYGNVPDLDCLLYRKPHIIKSMKPHNDTIFQEPKAAQAAAFLLYKANGRLEVLKLMKLMYLAERESFLRFGEGLTGDALVSMPHGPVLSMTLDFINGGHESVPNGWATWVSDRENRMLALRDPSMIRTPGQDLSALSEADLEVLESVWENYGHYSAWDLRNMTHNGLCPEWEDPHGSSRPIPIKKLLSVLGYDDEQAVAIVERLEEQAYINRAFG

SEQ ID NO: 37 - DNA, 399 bp, Neisseria gonorrhoeae
atgtttatccctgccgccctgcacaaagacgaacattcggcatatggcgtaaccatccccgaccttcccggctgtttctcttgcggcgacaccgttgaagaagccgtcgccaacgcccgttctgccgcctatatgcatattgacggtatgattgaggacggagggttcaaaaaccttgccgtaagcagcattgccgatttgagccaagaacctgattatcatggggcaacatgggtaatgattgaaatcgaccctgcaaaaatcagtcggcagcaaatccgattcaacgtcagctggccgcaataccttcttgatagagtggatgaatatacatccgcaaatcatgaaacccgtagcggttttttagccaaagccgccctgcttaccatgaatcaggca

SEQ ID NO: 38 - protein, 133 aa, Neisseria gonorrhoeae
MFIPAALHKDEHSAYGVTIPDLPGCFSCGDTVEEAVANARSAAYMHIDGMIEDGGFKNLAVSSIADLSQEPDYHGATWVMIEIDPAKISRQQIRFNVSWPQYLLDRVDEYTSANHETRSGFLAKAALLTMNQA

SEQ ID NO: 39 - DNA, 816 bp, Neisseria gonorrhoeae
atgaaccgatatgccatgcgttttgccgtcatacggtttatgccctatgtccaaacgcgcgaatttgccaacatcggcatcatcataacccacccgcaaagcggctgcttcgactttaaaatcgaacatcgctacagcagattgagccgttttttccgccgcttcgatccgcccgcctataaagcggcgacccgtgcctttgaaaaagaattacagcggattagaaacctggcggcacactccgcgcccgatcagatacgcgccatgcccgaccatctgacccgcccgcgcgaagccctgattatggccgcccaaccgggcgtaaccctcgcccccgacagggggcaggaactgaaccgcctgtttgattattttgtcgcccgcagcttcgccaaaaaccaacccgaagcagaacttacccgacaaatacaggcaatgttaaagccgcttcagacggcataccccttcaaagaaagcacaatcggcgacccgtcaggctttcacgcctccatccccttggtgcaaaaggcggaaaacggcgaaatacggaaaatcatcaagcctatctatttcggacggaaagaccctgccgacatctattacaagtctgataagcggattgccggcataaaacggttgcggcgcggcggatacatcgaccgctctgaaatattgtttgcctacgaaccgccggagcgtcccgacaaggcacaagaaaaggcattgcttgacgtatcgggcgacctggaggaacagggcatacagcttgccgataaccgaagcgaaggcaaaatcatcagaaactttgcctgcggc

SEQ ID NO: 40 - protein, 272 aa, Neisseria gonorrhoeae
MNRYAMRFAVIRFMPYVQTREFANIGIIITHPQSGCFDFKIEHRYSRLSRFFRRFDPPAYKAATRAFEKELQRIRNLAAHSAPDQIRAMPDHLTRPREALIMAAQPGVTLAPDRGQELNRLFDYFVARSFAKNQPEAELTRQIQAMLKPLQTAYPFKESTIGDPSGFHASIPLVQKAENGEIRKIIKPIYFGRKDPADIYYKSDKRIAGIKRLRRGGYIDRSEILFAYEPPERPDKAQEKALLDVSGDLEEQGIQLADNRSEGKIIRNFACG

SEQ ID NO: 41 - DNA, 753 bp, Neisseria gonorrhoeae
atgaaaaaaagagaattaaatgaaattgagacggctgaatgtgccgaactaaaaagaatttttaactcaaaaaaagaagaacttaagctaacccaatacaagctggcagaagctgtaggagttactcaaagcgcggtgaaccattatttaaatggcaccaacgccttaaacgcctccattgcaagccagtttgccaaaatcttgcaaattcctgtttcggatttcagcctccgacttgccgaagaaataagcagtatgtccatcggcattgatggagataaattgctggcactgcaagcagacaatctcgacaccaacaccatcaccctcaacctatacgacgtatcagccagttgcggtcatggggtagtcaaccccgactatccgcaactgctacgctcgattgagattcccaatgacgcgctattcgagcttttggggacaaacaatctgacaaacgtgcagcttatgccgccggacggcgacagcatggagccgaccattccacagaaatcgataactttaatcaaaacagacgttagcaagtttcagaccggcggcatctacctgtttacctttgacggttatacctacatcaaacgcctgtccagaggcaaaggcggcgcgatacacgctaccagcgacaacaggcattacgccaagtcggattttctgataaaccctgaagaagccgacaaattccacattcacggcaaattttggaaagttttgccgcttgattttttagacctt

SEQ ID NO: 42 - protein, 251 aa, Neisseria gonorrhoeae
MKKRELNEIETAECAELKRIFNSKKEELKLTQYKLAEAVGVTQSAVNHYLNGTNALNASIASQFAKILQIPVSDFSLRLAEEISSMSIGIDGDKLLALQADNLDTNTITLNLYDVSASCGHGVVNPDYPQLLRSIEIPNDALFELLGTNNLTNVQLMPPDGDSMEPTIPQKSITLIKTDVSKFQTGGIYLFTFDGYTYIKRLSRGKGGAIHATSDNRHYAKSDFLINPEEADKFHIHGKFWKVLPLDFLDL

SEQ ID NO: 43 - DNA, 549 bp, Neisseria gonorrhoeae
atgagtgcgaggctgatggggatggctttcaaaacgggtatcccgagggggcagcgttttgttttggtaaagttgtgcgactgcgccaacgacgatggcttgtgttatccgtcgcaagaaacgctggcggaagatacgggcttcgccgaaaccgccgtacggcagcatatcaagtggctgaaggataacaatttcatcaagtccgcccggcggcagagggggcgggagaggaagtccgacatctaccgcatcaacgtcgccctgcttgaaaaatgctatgcggaggcggcaaaacggaaggcggcgcggcaggcaaaaatgtgggaagaaccattggattacgaaccttcggattttgaaccgtcggattacgaaccttcggattttgaaccgtcggattacgaaccttcggattttgacgctaagaaccatcagattttgagcgatgaaccatcagattttgcgctaagaaccatcagattttgcgctaagaaccatcagattttgagcggcgaaccatcagattttgcgctaagaaccatcagattt

SEQ ID NO: 44 - protein, 183 aa, Neisseria gonorrhoeae
MSARLMGMAFKTGIPRGQRFVLVKLCDCANDDGLCYPSQETLAEDTGFAETAVRQHIKWLKDNNFIKSARRQRGRERKSDIYRINVALLEKCYAEAAKRKAARQAKMWEEPLDYEPSDFEPSDYEPSDFEPSDYEPSDFDAKNHQILSDEPSDFALRTIRFCAKNHQILSGEPSDFALRTIRF

SEQ ID NO: 45 - DNA, 777 bp, Neisseria gonorrhoeae
atggctttgaggaacgcgtctgatttcttgggggcttacggcggcggcgtgcgggtcgagcggaggcaatgcgcggaacacggcggatacgcggcgaaaagcgttttgcgcggcgtgtggacgggctgcccggcctgccggaagctggaggcggcggacgaaatggcggcatacgcggaaacgctgcgccgcggggcgatgcgcgacgcgctggaaaaacgcatcgggcgttcgggcatcgccccgcggttcagaaactgccggattgaaaactacgccgtcagcgattcgatcccggggatggcgagggcgaaggcggccgccgccgagtatgcggcaaacttcgccgatgtgttgcagacggggcggagcatgattttttcgggcaggaggggcacgggcaaaaaccaccttgcctgcggcatcgcccgcgaagtcatcgccgccggcaaaagcgcgctggtcatcacggtgggcgatatgctgcggacggtcaaggacagtttcggcggcggcggcgaggcgggggcggtcgggattttcgtgaagcccgatttgctggtgctggacgagttcggcgcgggcagtctgtcggaaacggacgggcggattttgttttccgtcgtcaacgcccggtacgagcggctgatgccgatgctggtgctgaccaacctgacggcggaagccttccgcgaaaacaccgacgcgcggatcagggacaggctgcgggacggcggcggcaagctgattccgttcgactgggagagctaccgtgcg

SEQ ID NO: 46 - protein, 259 aa, Neisseria gonorrhoeae
MALRNASDFLGAYGGGVRVERRQCAEHGGYAAKSVLRGVWTGCPACRKLEAADEMAAYAETLRRGAMRDALEKRIGRSGIAPRFRNCRIENYAVSDSIPGMARAKAAAAEYAANFADVLQTGRSMIFSGRRGTGKNHLACGIAREVIAAGKSALVITVGDMLRTVKDSFGGGGEAGAVGIFVKPDLLVLDEFGAGSLSETDGRILFSVVNARYERLMPMLVLTNLTAEAFRENTDARIRDRLRDGGGKLIPFDWESYRA

SEQ ID NO: 47 - DNA, 1500 bp, Neisseria gonorrhoeae
atgaatataaaagaatttatgtctaactataccaaccatcccgttctctttattggaacaggtatgagtttgagatacttagataattcatatacttgggatggtttattatctaaaattgcaatagatttatttggagatgatagggaatatttgaacatcaaatcacggtactgtgaagatggtagattccaatatgaagagattgcagaggaattacaaagtaaatttgataaagttttagaaaatgaccctgatggtagatttaaagaaataaatgataagttctttgaaaatatgagggcgggaaacaccttgagcaggtttaagatttatatatccaccctgctctcacaattgaattataaagataattctaatacagaattatctgaattaaaaaaagcgagaaaaaatgtagggtcaatcattacaacaaattatgataaattagcccaagatatttttgaatttaacccactaattggtaatgatattcttttaagcaacccttatggctcagtatacaaaatacatggttgtgtggacgatccatcaaaaattattattaccaaaaaggattatgagaaatttaaagaaaaatatgaacttattagagcccaactattatcgttatttattcacaatccaatcatatttcttggatataatgttggtgacgaaaatatcaaagaaattttaaaaacaatctttacttatgtagaacaaaactctccttcagctaataaaattcgtaggaattttttactcgtagaatatgaacctgagtctaacaatgaagatattgttgaacatgatatagatataactggattctctactatccgtattaataaaatcaaaacagataacttctcacaaatttataaagctcttgcagaactaacactaccaatctcagctatggatgtacgtaaatttcaatctatagcaaaggagatttatactggcggtaacattaaagttagctttacggaagatatggacaatttaaataatagcgataaagtggttgctattggttcaactaaaactatcagctacaactttcaaacaacatcagagatgatgtcaaattatttcaaaataattgaagaggaaaattcacaacttctaaaattaatagataaacatagtatagcatctacgcaatattttcctatttatggatttagtaggatatgttctgatatacataaagaagctgtactaaaacgccaacaaaaagaaaaattagatcattttattgaagaaataaataggcgttgtaaaaataatcattcatccatccaatcaattttagatgatgaaaatatttcagacacatataaaaacgatgcgattgcttggggaatatggaataaccaactttcagaagatgaggttgaaaattatttaaaaaattttgtgaataaaaaaaatacgcactataaaagactactatgtatgttcgattataaaaaatatgcggatactgtc

SEQ ID NO: 48 - protein, 500 aa, Neisseria gonorrhoeae
MNIKEFMSNYTNHPVLFIGTGMSLRYLDNSYTWDGLLSKIAIDLFGDDREYLNIKSRYCEDGRFQYEEIAEELQSKFDKVLENDPDGRFKEINDKFFENMRAGNTLSRFKIYISTLLSQLNYKDNSNTELSELKKARKNVGSIITTNYDKLAQDIFEFNPLIGNDILLSNPYGSVYKIHGCVDDPSKIIITKKDYEKFKEKYELIRAQLLSLFIHNPIIFLGYNVGDENIKEILKTIFTYVEQNSPSANKIRRNFLLVEYEPESNNEDIVEHDIDITGFSTIRINKIKTDNFSQIYKALAELTLPISAMDVRKFQSIAKEIYTGGNIKVSFTEDMDNLNNSDKVVAIGSTKTISYNFQTTSEMMSNYFKIIEEENSQLLKLIDKHSIASTQYFPIYGFSRICSDIHKEAVLKRQQKEKLDHFIEEINRRCKNNHSSIQSILDDENISDTYKNDAIAWGIWNNQLSEDEVENYLKNFVNKKNTHYKRLLCMFDYKKYADTV

SEQ ID NO: 49 - DNA, 1161 bp, Neisseria gonorrhoeae
atgtctttcaaactccgttacctcgcatcagtattggcattgtcttcactgttggcggcatgcggcggtcaggaaaagtctgcggcaggcgatgcttctcctgcttccgagaccgaagcggcttcccaagtacaggcctcggaagccgttccttccgcttcatcggcctcgcccgaagaccaagaccttttgaaacgcgcgcaaggtgtattccaacctttgccgactgtcgaagaaatgcagaaaatccgtccgtttaccgaagaacaggtcaaactcggacaccaactctggtatgaaccacgcctttccaaaggcaataccgtaagctgcaactcttgccacaaccttgcttccgccggtgtggacaatatgccgaccagtcaggggcacaaagggcagttcggcggacgcaactcgcctaccgcattgaatgctgcgctgctgggcagccagttttgggacggacgtgccgccgatgttgaagaacaggctggcgggcctttggtgaatccggtggaaatggcgaatgattcgcaagaggcggctgcagccaaaatcgccaaagttcccgaatatcaagaaatgtttaaaaaagcttttcctgaagacggcgcggtttcgtttaaaaacatcactaccgcattgggtgcgtttgagcgtaccctgctgacgccgaccaaatgggacgaatacctcaaaggcaacgtcaacgccctgagcgaacaggaacgaaaaggcgtgcgcgcgttcatggacaacggctgtattgcctgccacaacggtgtcaaccttggaggcacgaccttccagaaattcggtctggtccaagggccgtattggaaattcattgaagatccgaaacgcgacaaaggccgtgctgacgtaaccaaaaaaaccgaagacgaatttttcttccgtgttccggggttgcgtaacgtggctaaaacttatccgtatttccacaacggcagcgtgtgggagctggataaggcagttaccatcatgggtaaggcgcaattgggtaaagacattccgaaagaagatgtggataacatcgtcgtattcctgaatgcactttccggcaatgtttccgaatcagcgcgcacgatgccggaactgcccctgaccgcaccgatggaatctaagccggacaacaaa

SEQ ID NO: 50 - protein, 387 aa, Neisseria gonorrhoeae
MSFKLRYLASVLALSSLLAACGGQEKSAAGDASPASETEAASQVQASEAVPSASSASPEDQDLLKRAQGVFQPLPTVEEMQKIRPFTEEQVKLGHQLWYEPRLSKGNTVSCNSCHNLASAGVDNMPTSQGHKGQFGGRNSPTALNAALLGSQFWDGRAADVEEQAGGPLVNPVEMANDSQEAAAAKIAKVPEYQEMFKKAFPEDGAVSFKNITTALGAFERTLLTPTKWDEYLKGNVNALSEQERKGVRAFMDNGCIACHNGVNLGGTTFQKFGLVQGPYWKFIEDPKRDKGRADVTKKTEDEFFFRVPGLRNVAKTYPYFHNGSVWELDKAVTIMGKAQLGKDIPKEDVDNIVVFLNALSGNVSESARTMPELPLTAPMESKPDNK

SEQ ID NO: 51 - DNA, 489 bp, Neisseria gonorrhoeae
atgaccgccctcacactctaccggtgcgcggcagacgtacaggcggcgctggattactactttgacagcgaaaccgagcgcgaagacacgctggaagccgttatcgggcagttcgaggtcaaagcgcaatccgttatcgcttatattaaaaaccaagaaatcacggaaaaaatgcttgaagggcacatcaggcagatgaccgggaagctcaaggcggcaaaagcgcggaatcaaagcctgaaagactacttggcgcgcaatatgcaggcggcgggcattaccgaaatcaaagcggatgacggcacttttaaagcctcgttccgcaaatccgaagccgtcgtgatcttagacgaagcacaaatccccgccgaatttatgcgtgaggccgtcaaaaccgaaccggacaaaaccgccatcagaaaagcgattgaaagcggtcggcaagtagcaggcgcgaagattgaagggcggaagaatttgcagattaga

SEQ ID NO: 52 - protein, 163 aa, Neisseria gonorrhoeae
MTALTLYRCAADVQAALDYYFDSETEREDTLEAVIGQFEVKAQSVIAYIKNQEITEKMLEGHIRQMTGKLKAAKARNQSLKDYLARNMQAAGITEIKADDGTFKASFRKSEAVVILDEAQIPAEFMREAVKTEPDKTAIRKAIESGRQVAGAKIEGRKNLQIR

SEQ ID NO: 53 - DNA, 681 bp, Neisseria gonorrhoeae
gtgcaggcggatttagcctacgccgccgaacgcattacccacgattatccggaaccaaccgctccaggcaaaaacaaaataagcacggtaagcgattatttcagaaacatccgtacgcattccatccaccccagggtgtcggtcggctacgacttcggcggctggaggatagcggcagattatgcccgttacagaaagtggaacgacaataaatattccgtcgacataaaagagttggaaaacaagaatcagaataagagagacctgaagacggaaaatcaggaaaacggcagcttccacgccgtttcttctctcggcttatcagccgtttacgatttcaaactcaacgacaaattcaaaccctatatcggtgcgcgcgtcgcctacggacacgtcagacacagcatcgattcgactaaaaaaataacaggtactcttaccgcctaccctagtgatgctgacgcagcagttacggtttatcctgacggacatccgcaaaaaaacacctatcaaaaaagcaacagcagccgccgcttgggcttcggcgcgatggcgggcgtgggcatagacgtcgcgcccggcctgaccttggacgccggctaccgctaccacaactggggacgcttggaaaacacccgcttcaaaacccacgaagcctcattgggcatgcgctaccgcttc

SEQ ID NO: 54 - protein, 227 aa, Neisseria gonorrhoeae
VQADLAYAAERITHDYPEPTAPGKNKISTVSDYFRNIRTHSIHPRVSVGYDFGGWRIAADYARYRKWNDNKYSVDIKELENKNQNKRDLKTENQENGSFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 55 - DNA, 1350 bp, Neisseria gonorrhoeae
atggacggcgttgcggcggtaggcggcattgttgaccgcgccgcccaccgtttcgcgtttcggcacaaaccgcgcaaactgccagccgccgaacacggttgccgagccgcccaaccgccttgccagcgacacataaagcccgtcctgccaaccgtcgttgcgttccgcccggccttgttcgcggtagcgttggcggtaacgttccagcgacaccgaaagctgcgaccggcggctcaggcggtaagaatgcgccaactgcacacccgccccgtgcgccagcatatacggcgcaagccggcggtcggcaggcggtttcgttttcgcatcaaagccgtcgctacccgacaattgcgcctgataaaacggcaaaacccccaccgtctgccgcgcatttttatactgccagcccaaataagccctgccgaaagcatcgtcataagccgatttgcggctgaaataatagcttgtgcccccgacattggcgcggaacagcagataatggttgtccgccagcgcagtcagcttttccgccccggcctcataatccaaccctgccgcacggacaggtccggtaacgctgcatatccggctgccgccgccctgcaggcagtattgcggcgcggcattgttggcgtttttgttcacagaagggctgatgccgcccgaaaaatgccagcccgtcagcccctccgtttttttccggaaacgccccacattttccaaaaccggcgccggcaaatccaattttgccgcctccgcaaaatgcagccctgccgacttcagccggaaatcgtcaaactccgccgccgccaaatccagcaaaacccgctcgtctgccgcattatccctgtgcaacgcccgatagcgcgccaccgcctccgccggccttcccgccaatttcgccagcaaagcccgcgccctgccgtacaacaccgcatcataatccggcagcttggcatacaaatccgccaacgaagcgatcaaatccgcctgattgccgttgagcgcgtcgcgcaaaacgtgttccaacaactgcgggcgcgacagcaggaaatccccgtcgattacgcgcgaaccgccgtttgcggcagaatccccttccggcggcattcccgcccaaccctccgcagccgcacgctgggcgcgcaacgccgccgcatcgtcccgaacgtcgggcaagccggcggcatacgcgccgaccgcaccccaaacacacagcgcggcacacagccggcatacccgatacacactatccttcaatttgccttccttaaaaaacaccgccggacggcggcggcagaaacgccgcaagccccacgcgcggcggacgcggcgcatcatatagtggat

SEQ ID NO: 56 - protein, 450 aa, Neisseria gonorrhoeae
MDGVAAVGGIVDRAAHRFAFRHKPRKLPAAEHGCRAAQPPCQRHIKPVLPTVVAFRPALFAVALAVTFQRHRKLRPAAQAVRMRQLHTRPVRQHIRRKPAVGRRFRFRIKAVATRQLRLIKRQNPHRLPRIFILPAQISPAESIVISRFAAEIIACAPDIGAEQQIMVVRQRSQLFRPGLIIQPCRTDRSGNAAYPAAAALQAVLRRGIVGVFVHRRADAARKMPARQPLRFFPETPHIFQNRRRQIQFCRLRKMQPCRLQPEIVKLRRRQIQQNPLVCRIIPVQRPIARHRLRRPSRQFRQQSPRPAVQHRIIIRQLGIQIRQRSDQIRLIAVERVAQNVFQQLRARQQEIPVDYARTAVCGRIPFRRHSRPTLRSRTLGAQRRRIVPNVGQAGGIRADRTPNTQRGTQPAYPIHTILQFAFLKKHRRTAAAETPQAPRAADAAHHIVD

SEQ ID NO: 57 - DNA, 1164 bp, Neisseria gonorrhoeae
atgaacattaccatagccgccccctactgctcgctgccgtccgaaccgcatttcaaccgcttttggtatctggcagaactattgtcgcaatcgcacgacgtgttgctgattaccagcaacttcaagcactacgacaaatctttcagacggcccgaagatgctaaggccgcctcacaaggccgtctgaaagtcatgctgttggaagaaagcggatacagcaaaaacgtgtctttaggacgcgtgaccagccatcaccgcttcgtcaaacattttgaaaaatggttggaaaactgccgtccgggcgaacaagacgtcgtctattccgcctatccgctgattgccaccaacctgctgttgggcaaacacaaagcgcgtttgggttacaaactgattgtcgatgtgcaggacgtatggccggagtctttctcctctgtcgtgccgtttttgaaaaaaatcccgcacaacctactgccctttgcttcacgcgccaaccgggcctaccgctacgccgacgcgttggtcgccgtatcgcagacctatctcgaccgcgccaaagaagccaatccgaacgtacccggcgaagtcgtctatatcggtgcggattttgccgccatcgccccccccccgcgattccgctccaaaaccgtccgctttttctacttgggcacgctcagttacaactatgacgtggaaaccgtgtgcaaaggcgttcgcaagctgttggacgacggggaaaacgtcgaattgcacattatgggcggcggccccgatttggacaggctcaaacaatatgcctgcgacggcatcaagttttacggctacatcccttacgccgaaatgatgtcggtcgccaaaggctgcgacattgccgtcaacgccatccactcttacgccatgcagtcgattaccaacaaactctccgactatatggctttgcaaaaaccgattctgaacagccaggtccacgacgaagttgccgaagtccttaccctgctgccgcacgaaaactaccgttccggcgatgtggacggtttcgtccaagccgccaaagatattttgaagcgcaaaaacgaccctgttcagtccgacgaaatcgtccgccgcttcaggcacgacatttcctatcggaaaatcgtcaacctgattgaaagattggcaaatgag

SEQ ID NO: 58 - protein, 388 aa, Neisseria gonorrhoeae
MNITIAAPYCSLPSEPHFNRFWYLAELLSQSHDVLLITSNFKHYDKSFRRPEDAKAASQGRLKVMLLEESGYSKNVSLGRVTSHHRFVKHFEKWLENCRPGEQDVVYSAYPLIATNLLLGKHKARLGYKLIVDVQDVWPESFSSVVPFLKKIPHNLLPFASRANRAYRYADALVAVSQTYLDRAKEANPNVPGEVVYIGADFAAIAPPPRFRSKTVRFFYLGTLSYNYDVETVCKGVRKLLDDGENVELHIMGGGPDLDRLKQYACDGIKFYGYIPYAEMMSVAKGCDIAVNAIHSYAMQSITNKLSDYMALQKPILNSQVHDEVAEVLTLLPHENYRSGDVDGFVQAAKDILKRKNDPVQSDEIVRRFRHDISYRKIVNLIERLANE

SEQ ID NO: 59 - DNA, 1152 bp, Neisseria gonorrhoeae
atgggcggcatatctggcaggctgcatcctgcgccaccggaaaaatttgcacaaactgtttcattatttgaaaaaacaaggtttcccattatgaaaatcatcctgactacttctatgtcgggcctgggcggcacagaaaccgccaccgtccgcctcgggcggctgctcaaacggcacgggcacgacatcatcctcgcctcctcggacggcccttttgtcggagaggcgcaagcatcgggcatccgttggcagccggttgatttttaccggggcgggcttgccggctaccttaaaagcacctttgcctacgcccggatgctgcgccgcgaacaacccgacatcatcgactgccaaatggcgcgcgtcgtcccggcctgcgcccttgccgccaaaatcgtttcaccgaaaaccaaaatcatctgccactcgcacggtttggacgcggcaacctaccccaaaaccgccaaactcttcgacaagctgggcgcgtacatcatcggcaactgcaaacacgaacgcgaaaagctcatccgccacggcttccccgccggccggattgcctacgcctacaacacccccccggaatttcatttccggaaaaccgaaaaagaatgcgccgtactcggcacactttcccgtttggacaccgtccgtgccgtgcatctgatgttggatattttgaagaaaatggttggccgcaatatacccgtacgcctgaacatggcgggcataggagaagaaatggacaacctcaaagcccaagccaaacgtttgggtattgaagacaaagtgaccttcctcggcggcgtccgcgatttgaccggctacttcaaagaagtcgatattttagtgaacacgccgcattgcgtaggtgaccacggcgcaggtgtcggcaacaatattttggaagccggcctttacgacacgcctgtcgtgacctacaacatggcgggcatttccgaaatggtcattaccggccaaaccggctactgcattcctttcggcgatgacgaagcgtttatcgaagccgtcgatacactcatcaagcatccagagttgcgcagccaaatgggcaaagccctgcacaaacatgtcgaaaccttatgctccgacgacgaaatctaccgcaccaccatggctgcgtacgaaatg

SEQ ID NO: 60 - protein, 354 aa, Neisseria gonorrhoeae
MKIILTTSMSGLGGTETATVRLGRLLKRHGHDIILASSDGPFVGEAQASGIRWQPVDFYRGGLAGYLKSTFAYARMLRREQPDIIDCQMARVVPACALAAKIVSPKTKIICHSHGLDAATYPKTAKLFDKLGAYIIGNCKHEREKLIRHGFPAGRIAYAYNTPPEFHFRKTEKECAVLGTLSRLDTVRAVHLMLDILKKMVGRNIPVRLNMAGIGEEMDNLKAQAKRLGIEDKVTFLGGVRDLTGYFKEVDILVNTPHCVGDHGAGVGNNILEAGLYDTPVVTYNMAGISEMVITGQTGYCIPFGDDEAFIEAVDTLIKHPELRSQMGKALHKHVETLCSDDEIYRTTMAAYEM

SEQ ID NO: 61 - DNA, 1023 bp, Neisseria gonorrhoeae
ttgaaaaacggtgcggcgttttcgtggggcagccgctataccgagtttgatttcaccgataaattttcagacggccccggcacggtttaccaagtccgccgcgccgtgttcgacaaaatcctgattgaagaagccgccaaacaaggcgttgaagtacgtttcgggcacggcgtaaccgcgttcgacaacagcggcgattttgcccgcttgaacatcgaaaccgacaccggcgagagctatgaactgaccgcgaaattcgtcttggacgcaagcggctacggacgcgtgctgccgcgcctgctaaacttggaaacgccctcgcacctgccgccgcgccaaacgcatttcacgcacatcgacgacaacattacccacccgaaattcgaccgcaacaaaatcctgattaccacccatccgcaacaccgcgacgtgtggatttggctgattcccttcggcgacaaccgttgttccgtcggcgtggtcggcacacccgacaaacttgccggcgaatcggaaacggtgttgaaaaaatttgtttacgaatgcccgatgttgagcgaaattttggacaaagccgtttgggaaaacgattttccgttccgctccatccaaggctattccgccaacgtcaaatcactgcacggcaggcatttcgcgctgttgggcaatgccgccgagttcctcgaccccgtgttctcgtcgggcgtaaccatcgcgctgcactccgccgaacttgctgccgatctgctgacaaaacaactcaaaggcgaagccgccgattggcaaaccgaatttgccgaacccctgatgatcggcgtagacgcgttccgcacctatgtggacggctggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgactgccttgtcagaatgggtcggtcagttggaaagcgaa

SEQ ID NO: 62 - protein, 341 aa, Neisseria gonorrhoeae
LKNGAAFSWGSRYTEFDFTDKFSDGPGTVYQVRRAVFDKILIEEAAKQGVEVRFGHGVTAFDNSGDFARLNIETDTGESYELTAKFVLDASGYGRVLPRLLNLETPSHLPPRQTHFTHIDDNITHPKFDRNKILITTHPQHRDVWIWLIPFGDNRCSVGVVGTPDKLAGESETVLKKFVYECPMLSEILDKAVWENDFPFRSIQGYSANVKSLHGRHFALLGNAAEFLDPVFSSGVTIALHSAELAADLLTKQLKGEAADWQTEFAEPLMIGVDAFRTYVDGWYDFRFQNVVYAPDRSPEISRMLSSILAGYAWDTENPFVAKSEQRLTALSEWVGQLESE

SEQ ID NO: 63 - DNA, 660 bp, Neisseria gonorrhoeae
atgttttcaggcgaacagttaggacaagcaatatcagaagcgattaagagaaaaaatgtcagtcaaaaggaggttgccgatcattttggggtgaaacagccaagcgtttcaggttggataaaaaatggacgaatagataaaaaacatctagataaattaattgattatttctcagacgtagtaacgccaagccatttcggcattgaaacattcagagtcttaaaatcgaatgaacaaagtagcatacgtttcccccgcttaaatgccgaagcgacctgcggcgcaggcacgattaacgaccactatatcgaggttgtggattatgtaaccgtcgctgccgcatgggcgcgggagaaactgggcggaaacctcaacaaaatccaagtcattacagcccgtggcgacagcatggagcccaccatcgaaaacggcgacgtaatgttcgttgataccgccgtcgaagccttcgatggcgacggcctctacctgctttggtatatagacggccttaaggccaagcggctgcaatccaccgtcggcggcggcctgatgatcatcagcgacaacagctcataccgaaccgaaaccgtgcgcggcgaagatttaaacgccgtacgcatcatcggacgcatacgcggcgcatggcgtttgagccagttc

SEQ ID NO: 64 - protein, 220 aa, Neisseria gonorrhoeae
MFSGEQLGQAISEAIKRKNVSQKEVADHFGVKQPSVSGWIKNGRIDKKHLDKLIDYFSDVVTPSHFGIETFRVLKSNEQSSIRFPRLNAEATCGAGTINDHYIEVVDYVTVAAAWAREKLGGNLNKIQVITARGDSMEPTIENGDVMFVDTAVEAFDGDGLYLLWYIDGLKAKRLQSTVGGGLMIISDNSSYRTETVRGEDLNAVRIIGRIRGAWRLSQF

SEQ ID NO: 65 - DNA, 1065 bp, Neisseria gonorrhoeae
ttgatgatgaagccgtctgaaagtttgagagcggcaggcaggccaatcgcgtattacccgaaattggcaaagcctttgggcggtgtaaatgcggcaatattattcgggcatttcttctactggaacgataagacgcagtatgaatcaggcatttaccgaacagcggaagaaattgaaattgaaaccgggctgtccgttcaggaacaaagaacggcacgggcaaagctgagggaacgcggcgtattgattgagactgaaaaacgaattgaacaccgcatttactacaaactgaatttagacgcttttgatgatttgatgttgcaacattcggggggtggggaatcaacagccccgaaatgcaatatcaacagccccgaacttcaaaatcaacattcggggggtggggaatcaacagccccgaaatgcaatatcaacagccccgaacttcaaaatcaacattcggggagtgaggaatcaacagccgttataagaacagaagatttaacagaagatttagcagtatatacccccttacccccaaacgccggaaacggcaaaggcggtttgaacgctgacgcgtttgtttccgctgacgcggaaacgtgcgggcgggaaaccggcgaaccgacttcgccgaaggccgaaagcgacagtaacggcaacggcggcctttcgggaaaaccgaaaaatgcgaatgttccgcgccgccgcaaaacccacggcgtaccgcttcaggaaatcgccgatttgtacaacgaagttttgggcggccggttgccaagcgtccaagtgctgaacgacacgcgcaaacgggcgattgcaaaccgctggtgcgagatgctgggaacggcggcgccaaacggcaaggtgaggttcggggacaaggaaaccggtttggcctggtttgccggtttcttccggaaagtggcgatgaacccgttttggatgggcgaaaaccaaacagggtttgcggtcggcttcgattggattttcaaggcgggcaatttcgtcaaaatccttgaatggcatccgcctaaaacgaaccaggcggcaaggggaagggca

SEQ ID NO: 66 - protein, 355 aa, Neisseria gonorrhoeae
LMMKPSESLRAAGRPIAYYPKLAKPLGGVNAAILFGHFFYWNDKTQYESGIYRTAEEIEIETGLSVQEQRTARAKLRERGVLIETEKRIEHRIYYKLNLDAFDDLMLQHSGGGESTAPKCNINSPELQNQHSGGGESTAPKCNINSPELQNQHSGSEESTAVIRTEDLTEDLAVYTPLPPNAGNGKGGLNADAFVSADAETCGRETGEPTSPKAESDSNGNGGLSGKPKNANVPRRRKTHGVPLQEIADLYNEVLGGRLPSVQVLNDTRKRAIANRWCEMLGTAAPNGKVRFGDKETGLAWFAGFFRKVAMNPFWMGENQTGFAVGFDWIFKAGNFVKILEWHPPKTNQAARGRA

SEQ ID NO: 67 - DNA, 1419 bp, Neisseria gonorrhoeae
atggcactagggcaattcgacgatgttgaaacatcagtaattcgcagtttaagttctgcaagcctgtatatgttcacgcgccggatgttttatcaaaggcgcggctatgtttggcagcgggcgaatcaccatgcgccaatctgcaacgcgctcgagcgtgttttcaacggcgaaacgaaacgcctgattatcaatattccgccgcgatactcgaaaacggaaatcgcggtcgtgaactttatcgcgtgggcgatggggcgcgtgcctgattgcgagtttatccacgcgagctattcggcggcgctggcggtcaataactccgtacagattcggaacttggtgcaacacgaagagtatcgggcgatttttcctgatttggcactggcaggcgaaagcggccatcactggaaaacaaccgcaggcggcgtgatgtacgcaacaggtgcgggcggtacgattacaggtttcggtgcgggcaggcatcgggagggattcggcggctgcatcatcattgacgacccgcacaaagcagatgaagcgcgaagcgaggtcaggcggcagaacgtcatcgactggtttcaaaacacggtcgaatcccggaagaacagccctgacacgccgattatcctgattatgcaacgcctgcacgagaaagacttggcgggctggctgcttgacggcggcaacggcgaagagtgggaacatttgtgcctgcctgccattcaggaagacggcacggcgttgtggcctgaaaagcatgatattgaaacattgcgccgaatggagcaggccgcgccgtatgtgtttgccgggcagtatttgcaaaaacctgcgccgcctgacggcggtacgttcaagcctgacaacctgcaatttgtcaaggcgttgcctgccgggaatatcagatgggtacgcgcgtgggacttggcttcaaccgcaaacggcggcgactacacggcaggcggcaggcttggcgttacggaagacgggcggtatatcatcgccaacgtcgtgcgcggccggtacggcgcggacgagcgggacaggatattacgcaacacggcgcaaaaagacggcgtgaaaacgaaaatatccatcccgcaagaccccgggcaggcaggcaaatcgcaaacactatacctgacccgccagttggcgggtttttccgtatccgccggccccgaatcgggcgacaaggttacacgcgccggaccgttcgcggcacaggtcaacatcggcaatgtgatggtgttggatgacggcacatgggacacggacgcgctgattgcggaaatgcgcatgttcccgaacggccggcatgacgaccaaatagactgtttgggccgtgcgtttggcgagctgctggatacccggacgggcatgattgatttcctgcgatcgcaggtcgaggctgtgaaa

SEQ ID NO: 68 - protein, 473 aa, Neisseria gonorrhoeae
MALGQFDDVETSVIRSLSSASLYMFTRRMFYQRRGYVWQRANHHAPICNALERVFNGETKRLIINIPPRYSKTEIAVVNFIAWAMGRVPDCEFIHASYSAALAVNNSVQIRNLVQHEEYRAIFPDLALAGESGHHWKTTAGGVMYATGAGGTITGFGAGRHREGFGGCIIIDDPHKADEARSEVRRQNVIDWFQNTVESRKNSPDTPIILIMQRLHEKDLAGWLLDGGNGEEWEHLCLPAIQEDGTALWPEKHDIETLRRMEQAAPYVFAGQYLQKPAPPDGGTFKPDNLQFVKALPAGNIRWVRAWDLASTANGGDYTAGGRLGVTEDGRYIIANVVRGRYGADERDRILRNTAQKDGVKTKISIPQDPGQAGKSQTLYLTRQLAGFSVSAGPESGDKVTRAGPFAAQVNIGNVMVLDDGTWDTDALIAEMRMFPNGRHDDQIDCLGRAFGELLDTRTGMIDFLRSQVEAVK

SEQ ID NO: 69 - DNA, 2145 bp, Neisseria gonorrhoeae
atgagtaaaaagacacctttatcgcaaggctttattgcccgcgttgccgccggcgtccgttacgcctttaccggcaacgcggacgggtggttcgacgcgggcgagcctccggcccctgccgcgcagcaggcagaggggcggcggtttgattacgagccgttctacaacgtcgggcattccaagccgcgcgaacgtgaagcggtaggctttgcgcaattacgcgcccttgccgacaactacgatgtattgcgtttggtgatcgaggcgcgtaaagaccaaatggagtgccttaagtggacaatccaaaagcgcgacgtcgaatcaaccgaagacgacgaatcgcaacggaaagaccgaaaggtcgatgaagccgttgcgttcttccggtcgcccgataaagaacatacgtgggcggactggctgcgcatcttgctggaagacctgtttgttattgacgcgccgtgcatctacccgcgcaaaacactgggcggcggcttgtacgccctcgaagtgatggacggggcgacgattaagcgcgttttggacaatacggggcgtatgccgttaccgcccgatacggcgtatcagcaaatcctgcacggcatggcggcggtcgattacacggctgacgagttgatttaccgttcgcggaataaccgaagttacaaggtttacggctattcgcccgtcgagcaaatcatcatgaccgtgaatattgccttaaaacggcaggttcacgcgctggaatactacacggcgggcagcgtgcccgatgctttagtcggcgtgcctgaaacgtggtcggcggacgacatcaggcggtttcaagaatactgggatttgctgctgtcgggcgaaacggcgcagcggcgcaaaatgcgtttcgtgccgggcgagttgtcccgaaacttccgcgagacgaagcagccgccgttgaaggacgtttacgacgaatggctggcgcgtgtcgtctgctttgcgtttagtgtcgagcctacgccgttcgtggcgcaggtaaaccgcagcgtggcagagacgagccgcgagcagtcgctttcagacggcatgggcagcctgaaaaactgggtaaaagccctgattgacgacgtgcttgcccgttacatggatatggcggcgtatgagtttgtctggaagggggaggaatcgctcaacccgaaagaacaggctgaaatctacgccatctacaaaaacgcaggcatcttgaccgccgacgaaatccgcgccgaactgggcaaggagccgttaccggggcaggggcagcctgaaccggataagcaagacggccgaaagcccgaagagccgccgaaccaaggggctgaaaagttgggaaagtcggaaagcccgatgagcgaagacgaatctgccgcgcttattgaggcttatttgctgacacgcattgacggcttggccgaacaaatcgcggcgctgattgagggtgcggccgtcgattggcaggccggggatttggcggcggaattgagccgcgcggcaggggttgttgcaaacggcttggattttggcgattggtcgggattgtccgatgtggtcgagccgataatcaggcgtgttgcggaagacggggcggttgccgccttgttgcgcgtaatgcctgaacctgccgccggtatggttacgaacattcgcagccgcgccgtcaagtgggcgcatgaacgcgccgccgaaatggtcggcatgaagcgggcgggcggcgggcttgtccgaaatcctgccgccgagtggcaaatcaccgaagggacgcgcgaaatgatacgcgcccaagtagccgaagccatgcgaaacggcgacagtgtgcaggaattggcaggccgcctgaaagaatcccatgctttcggcaacgcacgcgcccgaaccattgcccgaacggaaacggcgatggcggacggtatgggcaacctgataggctgggaaggaacggggctggttgccggcaagcagtggataaccgcaaaagacgacaaggtgtccgatgtctgcaatgccaacggcgggatgggcgtaatcggtttgcacgagcctttctcccacggtgcgttgacgatacccggtcatccgaactgccggtgcgcggttgtgcctgttttggcaggggatatgcctgaatct

SEQ ID NO: 70 - protein, 715 aa, Neisseria gonorrhoeae
MSKKTPLSQGFIARVAAGVRYAFTGNADGWFDAGEPPAPAAQQAEGRRFDYEPFYNVGHSKPREREAVGFAQLRALADNYDVLRLVIEARKDQMECLKWTIQKRDVESTEDDESQRKDRKVDEAVAFFRSPDKEHTWADWLRILLEDLFVIDAPCIYPRKTLGGGLYALEVMDGATIKRVLDNTGRMPLPPDTAYQQILHGMAAVDYTADELIYRSRNNRSYKVYGYSPVEQIIMTVNIALKRQVHALEYYTAGSVPDALVGVPETWSADDIRRFQEYWDLLLSGETAQRRKMRFVPGELSRNFRETKQPPLKDVYDEWLARVVCFAFSVEPTPFVAQVNRSVAETSREQSLSDGMGSLKNWVKALIDDVLARYMDMAAYEFVWKGEESLNPKEQAEIYAIYKNAGILTADEIRAELGKEPLPGQGQPEPDKQDGRKPEEPPNQGAEKLGKSESPMSEDESAALIEAYLLTRIDGLAEQIAALIEGAAVDWQAGDLAAELSRAAGVVANGLDFGDWSGLSDVVEPIIRRVAEDGAVAALLRVMPEPAAGMVTNIRSRAVKWAHERAAEMVGMKRAGGGLVRNPAAEWQITEGTREMIRAQVAEAMRNGDSVQELAGRLKESHAFGNARARTIARTETAMADGMGNLIGWEGTGLVAGKQWITAKDDKVSDVCNANGGMGVIGLHEPFSHGALTIPGHPNCRCAVVPVLAGDMPES

SEQ ID NO: 71 - DNA, 3618 bp, Neisseria gonorrhoeae
atgatgtccggattctcccccaaacctaagaccattatcctaagccttgcaggtgcatttggcgcattggcttttgcagacaccccgaacaataccgaacagcagaaagaactgaataccatagtcgtccatggcaaacgcagtgccgaccaaaaaggcgcggacgacgtgtattacaaaaacgtctccaacgcctacgtcggcaaagaatacctcgaacgctaccgcgtccaatccgccggcgacgtactcaaaggcctaaacggcgtgtacaacatgaacacccgcaccgccggcggcgccatcacgcccaacatacgcggtatcaccggcaagggccgcatcccggttaccatagacggcaccgaacaaaccatcgacgtatggatgaacaactacggcgtgggcgaccgcaactacctcgaccccgccctgttccgcagcatcgcggtggaaaaaagccccgccctcacgcgcggcgtgaaatcgggcgtcggcggtgcgatgtccatccgcaccatcgaaccttccgacatcatccccgaaggaagaaactggggaattgaagtcaaaaccgagttttccggcaacaccgtggcgcagaaaaacgacctacgccaattcttaggccgcgactaccgcaccctctcgcccataggcgcgacggcggacggggtatcgggtatgcccgatgtattgaccggctatactggcaaaccttcccccaccgccctgttgttggacgaaggcatagccgacacgaaattctcgggcggtaaaagccacaccaacttcaaagacgacaggcagctgatgttgtccgccgccttcaaaaccgacattacagacggccttgccgcatacagccaccgccaaaaaggcaactactacgcgggcaaacgcggctatcaaagctacctcaacaaccccatttacggtgcggatgcctgttacgaccagtatcctgacaaatcatggcgggaaaaagatatactctgcaaatcttccgccagcctggtgccaaatatggccgtcctgttccggccgggcgaagaaatcatgaacagccacaccgacaccaaaatcctgctgctgaaaaacaactggtatcttccggataaccaaaaaatcagcctgcaatatatggacaacaaaatcggcttcggcgaaatcaaccccctgataacggcatggatactcggtttcgccgaacaatccctaaacgaacctgtgcagcaggcaccgggcatagggacgaaaatcgacagcaaaacctacaaaatcggctacgaatggaagccgcaaaacaacaaatggatagaccttcaagccgatatgtggcgggtgaagaccgacagtaaccgccatcagagcggcggcccagtcgtcggcgtcattacgtccgactttgattacgacctttggtattggtgcaacatacgcaaaaaaccgtcgcccaacctgcggggggaaagctgcgaaagcgcgatgacgtggaacgcctacggctcggcgcgaacccatgaagaagtgctgcgcatgatagaagacacgcccgacaaaatcgcccgcaagctggcagaatacgatgaaaacaaccgtgcgattaccgaccgctggatggggcatacgggcggctactacaccatcacgcccgccgataaaaatgtgctgaccgaccagaccaaccaaatcggcaaaatgatgaatctggccgaactgaagcaaaagctgaatcaggaacgctactacatcgaacatcccgaccgcatcatcgttcccggcgcgcggcagcgtaccgacgtcgtccgcaacggtttcaacctcagcaaccgcctccgcctttccgacaaactcagcctcacccttgccgccgactaccagcgcgaaacgttggaagaacgcaccgataccgccgacagcaatgatttgatgaatactttcggcgtactgacccgcatggcggccttgggcggcccgcagtcggcgaaaaagcgcgaatggggcgcgaacctggtattcgattggaaaccgacttcccgcctgaacatacaggcgggcgtgcgctatcagaattataaggggaacaatatcgaactggcgcggcagcgtgccgcacgcaacccttggtatcagtacggcctgggttcggacagctatgttaccggcctaatgatgccgtattacgaattggcggatgaagaagatattgccaaccaaaagcggatgttgcagctttatgatcccgatagagctgatgggcaggttgcagaatatcaagaccttaaccgccgttttaaggaaaaaaacggttacgattttgatccgcatgatactctcgttggtcaggatacccggttttacgccaaatctgatggaaattttgttcagtatgcggacggcaataaaaataccgatgtactatatgtactgcgccgcaaacagatcattccaatgaatgcaggcaaatttgaccccggcaaagtacaaattacgccggaaatgtaccgcgaaagagtaaacaatccgcaggggaaaagcggcagctatcgccgttatatcccaggatcgcatatctacataacacccggctcggtacgcgaagaaatggaacgtatggccaatgaaaaccaaattccgtcaaaagaagacaacaatcaggcactggaattcaatagcgacctaaaccgtaccgcttggatccggcatcaattcggcgaagccgaccgctggcgcatgccgcaggagcagcgcgcgcattcctggtcgcccatgctggcggtcagctacgatcttgccgacaaccaccgcctcttcgcccgctatgcccgcatgagccgcttccccagcctttacgaactgaccgccgccaccggtagcggagggctgtacggcagcgagaccgtggccgaatacagcctgaagccggaaaaaagcaccaactgggaagtcggctacaatttcaatttcgccccgcatttcgccaaactgcgccaaggcgacctccgcctcacctactacagtaataaaatcaaaaaccaaatcgatacatccaatgaagacggcggtatgatccaatacgacaaggcagtcagcaagggggtagaactgcagagccgcctcgacagcggccgcttcttcgcctccttcggcggcacgtaccgcttgaaacatatggtgtgcgacaagggtatcgccttcaaattcgactattacctgcaacgcgtacccgaatgccttgaaggtggcttcggcctcagccgcttcttccagtccttgcagccgaaatattcgcttacccttgatgtcggcacgcgcttcttcaacgaaaaactggaattgggcatgcgcgccatccatcacagcaaggcggagcggagaaattacgacaagctgatcgccgacggcgcggggcaggtgtatgcccgcaacggtaaaccctacggctggcatgcagccacccttttggatgcctatgcccgctaccgcatagggaagcatatagacttgaacttcagcgtaaccaaccttgccaaccgctattatctagacccgatgtccagcaccccggtccccggcccgggcaggacgattaccttcggcatcaagggcaggttt

SEQ ID NO: 72 - protein, 1206 aa, Neisseria gonorrhoeae
MMSGFSPKPKTIILSLAGAFGALAFADTPNNTEQQKELNTIVVHGKRSADQKGADDVYYKNVSNAYVGKEYLERYRVQSAGDVLKGLNGVYNMNTRTAGGAITPNIRGITGKGRIPVTIDGTEQTIDVWMNNYGVGDRNYLDPALFRSIAVEKSPALTRGVKSGVGGAMSIRTIEPSDIIPEGRNWGIEVKTEFSGNTVAQKNDLRQFLGRDYRTLSPIGATADGVSGMPDVLTGYTGKPSPTALLLDEGIADTKFSGGKSHTNFKDDRQLMLSAAFKTDITDGLAAYSHRQKGNYYAGKRGYQSYLNNPIYGADACYDQYPDKSWREKDILCKSSASLVPNMAVLFRPGEEIMNSHTDTKILLLKNNWYLPDNQKISLQYMDNKIGFGEINPLITAWILGFAEQSLNEPVQQAPGIGTKIDSKTYKIGYEWKPQNNKWIDLQADMWRVKTDSNRHQSGGPVVGVITSDFDYDLWYWCNIRKKPSPNLRGESCESAMTWNAYGSARTHEEVLRMIEDTPDKIARKLAEYDENNRAITDRWMGHTGGYYTITPADKNVLTDQTNQIGKMMNLAELKQKLNQERYYIEHPDRIIVPGARQRTDVVRNGFNLSNRLRLSDKLSLTLAADYQRETLEERTDTADSNDLMNTFGVLTRMAALGGPQSAKKREWGANLVFDWKPTSRLNIQAGVRYQNYKGNNIELARQRAARNPWYQYGLGSDSYVTGLMMPYYELADEEDIANQKRMLQLYDPDRADGQVAEYQDLNRRFKEKNGYDFDPHDTLVGQDTRFYAKSDGNFVQYADGNKNTDVLYVLRRKQIIPMNAGKFDPGKVQITPEMYRERVNNPQGKSGSYRRYIPGSHIYITPGSVREEMERMANENQIPSKEDNNQALEFNSDLNRTAWIRHQFGEADRWRMPQEQRAHSWSPMLAVSYDLADNHRLFARYARMSRFPSLYELTAATGSGGLYGSETVAEYSLKPEKSTNWEVGYNFNFAPHFAKLRQGDLRLTYYSNKIKNQIDTSNEDGGMIQYDKAVSKGVELQSRLDSGRFFASFGGTYRLKHMVCDKGIAFKFDYYLQRVPECLEGGFGLSRFFQSLQPKYSLTLDVGTRFFNEKLELGMRAIHHSKAERRNYDKLIADGAGQVYARNGKPYGWHAATLLDAYARYRIGKHIDLNFSVTNLANRYYLDPMSSTPVPGPGRTITFGIKGRF

SEQ ID NO: 73 - DNA, 948 bp, Neisseria gonorrhoeae
atgaaagcatcacaattaaccctcgccgtccttctggccgctgctttcggctctgcttatgcagtagaagttaaaggcggggattcaagtaaagggcaattaattcaagctgccgaatccgatttcctaccctttggttcgggtgctgccgacatcaaggtcagcacaggcaacggcttgtccaaatccatcaacctcgaagccggccccgcgcagcgcatccgcaacaaatacggcaatgcgcctatcaacggcggcaatcagaacaccaatgtaaacggtgcggccaattcgagatatctgcaacccggcgacatcaacccgattgcgggctggttctcgaaaactagactcgcccaagtgtggtatgaaaaacgtgccaacaacaccgaagtgttcagcgtacgccaaatggccgacccgctgctgccgattgcgccgaaattcggcggcatgacttttgccaaagtgccgacggcggcaaccaatgtcttcttcggcgaatgggcgccgcgcaaaggcaacagcaatcagattaccaacagcactgatttaaatatgaacgacggcaaccgcacggtttggtttgtgggtgagaatccgactaaaaacaccagaaacttgactgcggttacctataacgttgtcgggatcaacaagcacacgccgggcaaaaacgatttctataccggtgaaattacagccacattcggcacgggtgacaaaggttttatgagtggagaactggaacacacggatgatggggaattgagctttaacggtgttgaaattaccaatgctgacggctcgttcaacagcatcccaggccgcaataacgaaggcatcaaaggccaattctacggcaatggcgcggcagccatggcgggctatgccactcgcggaaccgacaacaaaggcgatgatgtggccttcggcggcgcgaaaaaa

SEQ ID NO: 74 - protein, 316 aa, Neisseria gonorrhoeae
MKASQLTLAVLLAAAFGSAYAVEVKGGDSSKGQLIQAAESDFLPFGSGAADIKVSTGNGLSKSINLEAGPAQRIRNKYGNAPINGGNQNTNVNGAANSRYLQPGDINPIAGWFSKTRLAQVWYEKRANNTEVFSVRQMADPLLPIAPKFGGMTFAKVPTAATNVFFGEWAPRKGNSNQITNSTDLNMNDGNRTVWFVGENPTKNTRNLTAVTYNVVGINKHTPGKNDFYTGEITATFGTGDKGFMSGELEHTDDGELSFNGVEITNADGSFNSIPGRNNEGIKGQFYGNGAAAMAGYATRGTDNKGDDVAFGGAKK

SEQ ID NO: 75 - DNA, 1491 bp, Neisseria gonorrhoeae
atgacccaccgcctctgcctgcttttcctgccgctctgtacggtctgccttgccgctccgtccaacgatgccgccgacgaacgccgccgcctgctggacgagggcagccgccaaacgcagcaataccgcgaaagcggttggctggacacggaacaggcacgcggggaagtagaggaaaacgacggctatatttcgataggcggcgaaatctaccaagtcggcgatacggcggaagaactggaaagcgcaatttaccacgccctcaatgcgcggcagtggcacaaggtgcggcagttcgccgcccgctacgccaaactgccccggcacaagcccgcgctgattcatttggccgatgcgctgcaaaaacgggacgaaggggatttccgcgcggcggggaacagttttcagacggccttggaagccgaacccgacaacccgcgcctgctgctcgaagcggggcggttttatgccgaagacaaccaaaacaaagagtctgccgccgcgtttgagaaagttctgaaaacggacattcccgcagaaacccgccccatcgtggaaaactacctgtccgaactgggcaaacgccgccgctggcacggccaaatcagcctcggctacggctataacagcaatgtaaaccaaggcaacggcatcaaccaatgcgtgtgggaaattgcgggcatgtgcctgatggagcgcaccctgcccgcgccaacggattcgaccttctcatcctatagcgcgaccgccgaaaaaaccgtcccgctcaaagggaatcacggcgtacaggtgcgcggtgtactgtacggcaaccgctacacggaaaaagacaaagattcggcggctatgccggattacggctatcgcaacggttcgctgtacgcgggatacgcctatgccgacgcacgctcctccttttccctgctgccttatttcgaatacgatttccgcaaccgccacacccactaccgagcatggggtgcggatgccgactggtcgcgcacactctccccgcactggcgcattaactcacatgccggagcaaaaaagaccggatacggcggacaaagcaaaacttattttgccgatttcaaacaatacgaactcggcgcgggggcggaattttccatcacgctgaaaagcggcctgcttgtaaatttcgatgccgcacgcaaagcctatcccgaaaaatcctcttccagcaaagaatatacggctcggctgggcgcgtataggcttttttcgggcggtacttatttaaacgccgtcctgctctaccgccgcagcctgtatgacgcggcaagtttcgtcagcgataacaaacggcggcgcgacaagcaatacatcatgatggctgcggcgggttttccgcaatggaatatcaaaggcgtatatcccgaactgcgtttcaggcgaacaatcgcacacagcaacgcggtgtattaccgctaccgccaaaacgaatggctgttgggttttaaatatcggttt

SEQ ID NO: 76 - protein, 497 aa, Neisseria gonorrhoeae
MTHRLCLLFLPLCTVCLAAPSNDAADERRRLLDEGSRQTQQYRESGWLDTEQARGEVEENDGYISIGGEIYQVGDTAEELESAIYHALNARQWHKVRQFAARYAKLPRHKPALIHLADALQKRDEGDFRAAGNSFQTALEAEPDNPRLLLEAGRFYAEDNQNKESAAAFEKVLKTDIPAETRPIVENYLSELGKRRRWHGQISLGYGYNSNVNQGNGINQCVWEIAGMCLMERTLPAPTDSTFSSYSATAEKTVPLKGNHGVQVRGVLYGNRYTEKDKDSAAMPDYGYRNGSLYAGYAYADARSSFSLLPYFEYDFRNRHTHYRAWGADADWSRTLSPHWRINSHAGAKKTGYGGQSKTYFADFKQYELGAGAEFSITLKSGLLVNFDAARKAYPEKSSSSKEYTARLGAYRLFSGGTYLNAVLLYRRSLYDAASFVSDNKRRRDKQYIMMAAAGFPQWNIKGVYPELRFRRTIAHSNAVYYRYRQNEWLLGFKYRF

SEQ ID NO: 77 - DNA, 2616 bp, Neisseria gonorrhoeae
atgaaccaagaagggattaccgctcacggaaatgccacgattaccctcaaggcgaaagaaaacaataaaattaccgtggaaaacgccgcatacagcagcgacggcatttcgactctgattaacagaacgggggcaagacccggaacaagggatgatggaaataaaatcatactggaagccggcggcgataatattgttaccatgaaatccggcgatgcggatgcggattatgtaaacaattccaaagtattaacggagacaccatattataaaagcaaacgaggttccaacggcatttttgcctatggcgacaaatcgctggtcaaactgattggcgagaataatatcgttaagagtgaaatcagtgaaaaatctaaggcattaaatgggggatttcgccatatcggcatttattcatggcaaaacgcgaaagtcgaattgtctgcgaagagcgacaatatcgtacaaggcggaatttggggcttatactccaacaactcctcaatttccctcaaggggaaaaataatgtgatttcaaacccgaaatataatgttttcgcctacaaaaaggcaaaggtggatttgactgtcgaaaataaaaacacattatctgatgcggaatttggcgtatatgccttaaacacaagtatggttaatttgtcttcaaaagataataacgaggtaaaaagcacccaagtgggtctgtattcgcaagacggcggttcaatcaatgtagataggaaggataatattattgaaggcgacgcggttgccttggtgggaaaaggtggaagtcaaaacattcgggcaagccgtacaaacctgattagttcaaaaagcttaggaattcatgctgaacaagctgcaaaaatagccataaccggcgcaagcaatacaattcatgcaagcaatgccgctattcgttcattagacaaaagcgaagttaagattgacggtcaaattaccattgactccaacgttgccaatcttgcaaggcaagatggttcaattcatttgaattataaagacgatacccgtatcacaggggcaaccgtatctgataagggtttggtagccatcaaacctttgaataacacgaatattgttgccgacactattcactataaaggcgatgtcttggcggtaaataagggtaaagtggaattagatttcacgccgaacatccttttagcgggacgtttggataattttagcggcttaaccgattccaaacataaaaatttattcgaaaactatgttgcaaatttagacagcaaaagtgcgggcgaaattaactttaatttagccaaagacgcattatggacgatgacaggtcaaagctggctggataaattggaaggacaaggcactatcgattttaataatgatgctaaaacaagtggacgcgccttacatatcggcgaattggcgggtgccaataaattcttgatgcatctgaataaagacggcattcacagcgatatgctctatgtgaaaaaaggcacttcgacaccgcaagaagtcgtcgtcaaaaatctgtccgaagtgctcgacagtatgaattacggcgaacgtttgcgtttcgctacagtaacaaactcaaaaaatgaatttgtgaacggtaaaaaatatattgacgatacgcaccttatggaggatgccctgactgtcgaatactccgcacataacggcgataaaaacaacaaggatgactataataaatcctttaacggctctgaaatgacggcggaaaaagctggagacgattatgtcaataaaacctataccgacaacaggcaaaatgtctatttggtcaaacaggctaccggcaatccgagccgaaatgtcaaaaatatcaatgatatgttcgattcaaccgcacattatgcgttcactttggatacttatgccaaacgcgaaggggagcgggctttttcaacgttggataaaaaagaaggcgattggataaggctgacgcatacccgtgtgattcaatccaatgcgtttaggtttcataacaacgattttgaaatcggatatgaccgattcagcctcaacgagcaggagaaaaaacgcaaatggggcataagtctcgactacggccacggcaggacatcattatggaatacgtttggcaaggacaaaatcaggaaatatgaattggctctgtacaatactacccaatacatagataaagaaggagacgaaacagggtatatcgacaatgtattaaaaataggaaaactgcgtaaccgtgtgattgcacgaaatcatatggggcaattatggggcaagggaaaatatagcaacaccctattctctatcagcaccgaatacggccgccgtaaatttttggatgacgataaattgtggcggattacaccgcaagtacagttgcaatattcctatttgagaggtaccggctatcggatcgataacggcataaacgtcaatttaagccacgcaaacagcctgataggccgcttgggtttggatgtcgtgagaaaatttgacggaggcaaaaaacttttctatatcaaaggcaatatctttcatgaatttttgggcagtcgttcctttaaggcatttgagggcaaaagtcattatgctcaaaaa

SEQ ID NO: 78 - protein, 872 aa, Neisseria gonorrhoeae
MNQEGITAHGNATITLKAKENNKITVENAAYSSDGISTLINRTGARPGTRDDGNKIILEAGGDNIVTMKSGDADADYVNNSKVLTETPYYKSKRGSNGIFAYGDKSLVKLIGENNIVKSEISEKSKALNGGFRHIGIYSWQNAKVELSAKSDNIVQGGIWGLYSNNSSISLKGKNNVISNPKYNVFAYKKAKVDLTVENKNTLSDAEFGVYALNTSMVNLSSKDNNEVKSTQVGLYSQDGGSINVDRKDNIIEGDAVALVGKGGSQNIRASRTNLISSKSLGIHAEQAAKIAITGASNTIHASNAAIRSLDKSEVKIDGQITIDSNVANLARQDGSIHLNYKDDTRITGATVSDKGLVAIKPLNNTNIVADTIHYKGDVLAVNKGKVELDFTPNILLAGRLDNFSGLTDSKHKNLFENYVANLDSKSAGEINFNLAKDALWTMTGQSWLDKLEGQGTIDFNNDAKTSGRALHIGELAGANKFLMHLNKDGIHSDMLYVKKGTSTPQEVVVKNLSEVLDSMNYGERLRFATVTNSKNEFVNGKKYIDDTHLMEDALTVEYSAHNGDKNNKDDYNKSFNGSEMTAEKAGDDYVNKTYTDNRQNVYLVKQATGNPSRNVKNINDMFDSTAHYAFTLDTYAKREGERAFSTLDKKEGDWIRLTHTRVIQSNAFRFHNNDFEIGYDRFSLNEQEKKRKWGISLDYGHGRTSLWNTFGKDKIRKYELALYNTTQYIDKEGDETGYIDNVLKIGKLRNRVIARNHMGQLWGKGKYSNTLFSISTEYGRRKFLDDDKLWRITPQVQLQYSYLRGTGYRIDNGINVNLSHANSLIGRLGLDVVRKFDGGKKLFYIKGNIFHEFLGSRSFKAFEGKSHYAQK

SEQ ID NO: 79 - DNA, 906 bp, Neisseria gonorrhoeae
atgcgcttccccctccctattaccaatgctgtgctaaaaattacaaatggcgcaatggaattcaaatcagaagatattggaaccataaaactaacaaaagctacttttcacctaaaaaaagacacatcattaacaacacccgaagggactacattattatcaggcggcacgctaaccctatctaatacaggtatttctttatcgggtacaacttctgtatttgaaaaaggaacattcaccaacggcggcatcattacgcttgccaatcaatcctatgcagacaaactcaccattgaaggaaattatgtcggtaaagacggtgtgttaaaagtcaatacagaatggaactcgccgggtgatgatcaaggaggaaattctcaatctgatttactggaaatcacaggcgatgcttcaggaaaaacaacggtcatttcagtgggtaaagatggcaaagaaaatattatcgacggttcgatcggcgaactttccgaccgctacaaacgcagtgccgccgttgttaaggttttgggacaagacaagggggcggaaaccggtaaattaaatatcgaagacgctaaacatacctacacaatgcgcgatacttttagcggaactgccaaaaccacaggggcgggggaattgcaattggtttcacacaaagatgaggcgggcgcgacagaatacttctggactttaaccacgccgaatcaagataaaaccatcatcacgccaagcgcaccggcctacgcactcgttccacgtcaaaacttggaatcaggctatgcgatgctggatacgctccaccaacgccgtggcgaaaatcaaaccctttctcgggacaggcaaggcaattatcggcaggatgcggaagcaacagacataaaggctaccaaggcaccgtgggtg

SEQ ID NO: 80 - protein, 302 aa, Neisseria gonorrhoeae
MRFPLPITNAVLKITNGAMEFKSEDIGTIKLTKATFHLKKDTSLTTPEGTTLLSGGTLTLSNTGISLSGTTSVFEKGTFTNGGIITLANQSYADKLTIEGNYVGKDGVLKVNTEWNSPGDDQGGNSQSDLLEITGDASGKTTVISVGKDGKENIIDGSIGELSDRYKRSAAVVKVLGQDKGAETGKLNIEDAKHTYTMRDTFSGTAKTTGAGELQLVSHKDEAGATEYFWTLTTPNQDKTIITPSAPAYALVPRQNLESGYAMLDTLHQRRGENQTLSRDRQGNYRQDAEATDIKATKAPWV

SEQ ID NO: 81 - DNA, 864 bp, Neisseria gonorrhoeae
atgattcttgcgtcccttgtccgctattaccgccgtttggcaacggaaaccgatgaaacgggcaacccgaaagtgccgtcttatggttttagcgaggagaaaatcggctggattttggtgttggataaagaaggtcgtctgaaaaccgttgtgccgaatctgactgccgataaaaagccgcagccgaagctgatgagtgtgccgcgccctgaaaaacgcacgtcgggtatcaaaccgaattttttgtgggataaaaccgcctacgcgcttggcgtggaagccaataaaaacaaagccgaagccaaagaaaaaccgtttacgccgtctgaaaaaacctttgaagccttcaagcaataccatctcgatttactgcaaaacagcgaagacgaaggtttacaagccttatgccgttttctgcaaaactggcagcctgcacatttcgctgccgaaaacctgcctgccgaaatgcttgattccaacaccgcattttctcttgaaaaaccgaccgctcttatccataaacgcgaagccgcgcaaaccttgtgggcaggctgcctgaaaagtgatgaagcactcgaaagcttatgcctgattagcggcgacaccgcgccgattgcacggctgcatccggcgattaaaggcgtgtttggcgggcaaagctccggcggttcgattatttcgtttaataaagaagccttttcctctttcggaaaagagcaaggcgcaaatgcgcctgtttccgaacaatccgcctttgcctacaccaccgcgctgaactatctcttgcgccgcgaaaataatcactgcctgaccataggcgatgccagcacggtcttttgggcggaagcggatgatatagtggat

SEQ ID NO: 82 - protein, 288 aa, Neisseria gonorrhoeae
MILASLVRYYRRLATETDETGNPKVPSYGFSEEKIGWILVLDKEGRLKTVVPNLTADKKPQPKLMSVPRPEKRTSGIKPNFLWDKTAYALGVEANKNKAEAKEKPFTPSEKTFEAFKQYHLDLLQNSEDEGLQALCRFLQNWQPAHFAAENLPAEMLDSNTAFSLEKPTALIHKREAAQTLWAGCLKSDEALESLCLISGDTAPIARLHPAIKGVFGGQSSGGSIISFNKEAFSSFGKEQGANAPVSEQSAFAYTTALNYLLRRENNHCLTIGDASTVFWAEADDIVD

SEQ ID NO: 83 - DNA, 6012 bp, Neisseria gonorrhoeae
ttggcgcgcgggacggaaaaacagccggatgtttcgggtatcccgtcggaggacggggcggaatttttggatacgggcgtgatgccggacggtttggcgcgtcagtatgcggacatggcggctaaataccgggccaagccgtcggaggcggtggggattgatccggatgacggtgcggtttctgcggccgctgctttggcggcggattcgggcgcggctgtgccgtctgcggtgtctgacgatatggaagcccggtcggttgcggatgatgcgccgtccggacggtcggcggatgcggacaggggcggtgttccgtccgcttacggcaatgtgcgccccggcggtgcgccgcgcggtgcggcttcggttgcgccgggcggttctgccgccgctgcttcgggcgggattgcgcgtgtcgcgccgctgcctgcgggccaatacttcgacggtttggatacgcgcgggcgcaaggctttggcgaaggaggcgggccttgatattaagggcgttgcggatttcgggcaaatcgccgcgcctgtgcgccgaaaaatcgagcaggcgtatcacgcgcggattgaggcggattatcaggcggcttccgaagccaaacagggttacctgccgccgcccgtgcgtatggcggatgccgtgcctgttcctaaaaaagggttttccgtccctgccgatgcgttggataaggaatcgcgcaggcggtttgacgcgctgcctgaatgggtgcgccgtcatgcgcagacggtggcggactatacggcggacgggattatgcgccgggaggcgggtatggcggatatgcgcggacattatcctgagggtttggcggaatcggccggggctgtacgcgcttaccgtgcgcaacatccggaatcggcggatgtgttggacaggcttaaccgtgcggtttacggttaccgccgcaacaacggttggagcgtgccgctgttgagccgcgagggggagcgtttgcagggggttcggacggcgttgccggatgacggcgcgtctgaggccgttgtcggcggcggcaggggtttgacccgggctttacccacggaagataagggtttggcgcaggatgtgcggcaggatgtgcggcagggtttgacccaaggcggcaggggtttgacccctgatgcgggggcggatgcaaatgcggctgccttgcagggtttgccagggtccgccgttgcgtccggcaatgcgccggcccgtcggcaaaacttacaggttcgggcgcgcgcggaaggtgccgcgcccggcctgtccgcgtctgaaaaccttgccgggacggacggcgggaaacgtgcgcctgttgcgggcaaacgccccgatacggtgttgccggtattgaatccgcaggttgcggaatcggcgggcagggtatcgcctaagaaacggatggcggatgcggcggcggatttcacgcgccgtttggcggcggacaggcgcaggccggaaaaggcgggtgtgcctttggggggcggcgaataccgtttcgagcatacggaccgcaggcatattgatgcgcttgcgggcgtgccgggcaggccgggcaaaggcggcatgccggaggagtttgccgatatggccggtccttccaactctgacggccttgtctccgacggtcgccgttatttgaaggggcgggaggcggaaaccttgcgggcgggcggtttgtcggaagccgtgccgtccgagccgggtcgggattatcgtccgacgcaggaagcaagggcgccggccaaggtgatggcgcggccgcgcgatgccgccgccgacggcaaaccggcgggcagggcgcagcctgcccgggcaaaagatacgcctgttgcgggcaaggcggctgctgcaaaaaatgcggcaaccgaaaagccgtcttcggataaggtgcgaaatatcgaagcgggaaaatcccgcttcgatggcggaaagggcaagtcggccgccgcacaaggcgcggcaaccgaaaagccgtctgaaaagacgggcaaagccaagcctgaaacgtttgcgaaaacggcttcggacaatccggaagaggcacggcgcaaggcgcgtgtgttgcagggagggcctgtttatacggtgaaagagcgtcaggcgccgcaaggttttaaggcattgcgcgagcacgccgaaagcatcaaaaaacgcctcgccgaaagcataggcggactggcggaacgggtggatgtcgccgccgtgtccgaaacggcgccggacaaggcgcagatgctgttgtcgcagcgtgtggagggctggtttgacggcaggacgggcaaaatcacgctggtggcggaaaaccttacgcccgaacgtgcggtatgggcggcgtggcacgagctggggcacaggggctttgcggcggatggtttcgccaagtaccgtgaagaattggaacgtgcggacggcaacggcctgattcggcgcattgcggacgcggtgcaggaagggcgcgaaggcacgggcgatgcggcggcctcggtgcgccccgccgcggtggaagaggcggtcgcggagctttatgcggcgcagcgtaccggcggttgggcgggcattgaaaaccgttacggcgtgaaggtcggcaacggtttgaaacgcggcattgcgggcgtgttggcgcgtatcggcgccctgttgcgccgtgtgctgcaacgcctggcgggcaaggccggcggtgcgatgtcggacgcggatgtgtttgcgatgctggcggatttgcacgggaatgtggaaggggcgcgggatgcgccttggggcggcaatcatcgtgcagtgatgttcgcgcgggccgaagacggtgcggcggaacgttccaagtcggaaagccttgagaagctgcgccgtgcggaaaccatccgtatctcgggcagggaggttccggaaggcggcaatttgcgcgaatataagcgcaatgcgctggaatacggcaaatctttgcgcgggccttatgtgaataaggacacggggcgtgaaatcagtttgggacgttcgggcatcactgaaatattgcgtcacgactataaggacgcggaacatttgcagagtatcgcggcaattccgcagattattgagaatgcggtgtatatcgatacgctgccgaacgaggatttggctaagaacggcgatattcagggttatgaatattatgtttcgggactgaatgtcggcggtgcggattacacggtaagggctgccgtcgcggttagcaggaacggtaaccgctattacgaccataagctgacgaaaatagaaaaaggcaacttgctttcattacttgaccgcgtatcaactacgggagcctctgaaagcaaatcgcctttatcgggcattgatgataaacgcctgttgcagattttgcaagacaaagatgcgggcaagggcggcattgccgattttgacacggaggcggtgcgtttttcccgtgcggcgaacatcgaggccgcaatcggccgtataacgggtaaaaaatccgatttgagaaacgcgctgaaagaccgctgggatgcttccaaggggattcagctccagtttttgggcaggcggcagatcgaggacatttacggcggcgttttggacggcctgaaggaatacgggcgtttgtcggaactcttcggcgcggatgcgaacaaggcggttacggaggcggacaaggttgtcagggaatggggcaggttgaaggaggaggatgcgaaagcgcttgcggatctgatgcacgatgcgacgctggcgaaggtggatgccgacccgctgatgcgaaaggatgctcagaagcgtttggacggcatccggacggctttggatattgcggacggtaaaatcgagaaggcggaggcggccgttgcttccgccggtgcgcgtattgcgcgtgcggatgccgcttacaataaggcgcaacgggcggcggataaggcggcttatgcgctggagaaggcgcaggaaaaacacggtcgggaaattttggcggatgaggcggatatgcgcctgcgccgtctgttttatgcggattcggaggcgaagcgggcgttgaggcgcgccggggcggatgtggcggcggaaagccgggctaaaacggatgcggtacggatgttggagcaggcgcgcgcggatgtgaagcgtttggaaaaggatgaggttggggcgcaaaaggctttggaggggcttgctttgctgaaccgccgttttgccgggctgcctgatgcggcgcagagggtgtaccgcaaggcgcgggatgattatagggcgcatttcgggcaggtgcgcgatgcgcttgccgaacggttggcgcgtgcggggcaggatgcggaaacggtgcgccgcctgaaggagcgttttgacaacgagctgggcggtgtgtatttccccttggcgcgtttcggcgattatctggtggtggtcaaggatgcggacgggaatagtgcgaatgtgtcccgcgcggaaactttgagcgaggcggagaagctgcgcgatgcgctgaaggctgatttcggggcggggtttaaggtttcgcccgtgatgaagtcccgggattatatccgaagccgcgatgcggtcggcagcggttttatgagggagctgggcgaggctgtcggtatgttggatttggatccggcgcaacgggcccgattgaacgatacgctgacgcagctttatttgaactcgctgcccgatacgtcttgggcgaaacacggcatccaccgcaagggcgtgccgggcttcagcgatgatgcgaggcgcgcatatgcgcagaatatgggcagcggtgcgaattatctggcgaagttgcgctatgcggaccgtatggcggaacagttggatgtgatgcaggattttgtggacgggcgcaaatatgaggagggtttcgaccagcgtcagttgcagcgtgtggcggatgagatgaggaaacgccacgaggcggtgatgaatccgaatccttccaagctggcgcaggctttgacgggcttcggctttttgtggatgatggggatgtcgcccgcttctgcggttgtgaacctgtcgcagacggcaatggtggcttatccggtgatggcggcgaagtggggttatgccggtgcggcgcgggaattgctgcgggcttcaaaacagattgggctgaggttcggggagaagttcaatacgattgaggacagtttgaacggggatgagaaggcggcgttccgaaaggcggcggattacggtgtgatcgatttgtcgcaggcgcatgatttggcgggggtggccaacggcgacccggggttggcggggtcggcttggcagaaggtgatggataaggcggcctggctgttccatcatgcggagaagtttaaccgccaggttacgtttgtcgcggcctaccgtttggcgaaacgggcgggggcggacagcgaggcggctttcgaacaggcgaaaaaggcgacgtatgacgggcattttgactatgcggcgcaaaaccgtccgcgctttatgatgggcaatgcggcgaaggtggtctttctgttcaagcagtattcgcagaatatcctgtatgcgctggggcgcaatgcgtaccttgcgtttaagggggataaggaggcgcgtaagacgctggcggggctgttggtctcgcatgcgatggcttcgggcatcttggggctgccgtttgtgtcgacgctgcttgcggtggcttcgatgttgggcagtgacgacgatgacccgtgggatgcggaagcggcgttgcgcaatatgttggcggatgctttcggggataaggcgggcgaggtgttggccaagggcttcagccgcctgacgccgctggacgtgtcggggcgtttgggcttgaaccagttggttttccccgatatccaagacggtttggagggtaagaagtgggcggaatcgctggtggtcggcagtacgggcgcggtggtcggcgcgggtatcggtgcggcggacggcgtgcggacaaggtcatccgtgccaaggacggcaaacacactatcccttatgaaaagctgg

SEQ ID NO: 84 - protein, 2004 aa, Neisseria gonorrhoeae
LARGTEKQPDVSGIPSEDGAEFLDTGVMPDGLARQYADMAAKYRAKPSEAVGIDPDDGAVSAAAALAADSGAAVPSAVSDDMEARSVADDAPSGRSADADRGGVPSAYGNVRPGGAPRGAASVAPGGSAAAASGGIARVAPLPAGQYFDGLDTRGRKALAKEAGLDIKGVADFGQIAAPVRRKIEQAYHARIEADYQAASEAKQGYLPPPVRMADAVPVPKKGFSVPADALDKESRRRFDALPEWVRRHAQTVADYTADGIMRREAGMADMRGHYPEGLAESAGAVRAYRAQHPESADVLDRLNRAVYGYRRNNGWSVPLLSREGERLQGVRTALPDDGASEAVVGGGRGLTRALPTEDKGLAQDVRQDVRQGLTQGGRGLTPDAGADANAAALQGLPGSAVASGNAPARRQNLQVRARAEGAAPGLSASENLAGTDGGKRAPVAGKRPDTVLPVLNPQVAESAGRVSPKKRMADAAADFTRRLAADRRRPEKAGVPLGGGEYRFEHTDRRHIDALAGVPGRPGKGGMPEEFADMAGPSNSDGLVSDGRRYLKGREAETLRAGGLSEAVPSEPGRDYRPTQEARAPAKVMARPRDAAADGKPAGRAQPARAKDTPVAGKAAAAKNAATEKPSSDKVRNIEAGKSRFDGGKGKSAAAQGAATEKPSEKTGKAKPETFAKTASDNPEEARRKARVLQGGPVYTVKERQAPQGFKALREHAESIKKRLAESIGGLAERVDVAAVSETAPDKAQMLLSQRVEGWFDGRTGKITLVAENLTPERAVWAAWHELGHRGFAADGFAKYREELERADGNGLIRRIADAVQEGREGTGDAAASVRPAAVEEAVAELYAAQRTGGWAGIENRYGVKVGNGLKRGIAGVLARIGALLRRVLQRLAGKAGGAMSDADVFAMLADLHGNVEGARDAPWGGNHRAVMFARAEDGAAERSKSESLEKLRRAETIRISGREVPEGGNLREYKRNALEYGKSLRGPYVNKDTGREISLGRSGITEILRHDYKDAEHLQSIAAIPQIIENAVYIDTLPNEDLAKNGDIQGYEYYVSGLNVGGADYTVRAAVAVSRNGNRYYDHKLTKIEKGNLLSLLDRVSTTGASESKSPLSGIDDKRLLQILQDKDAGKGGIADFDTEAVRFSRAANIEAAIGRITGKKSDLRNALKDRWDASKGIQLQFLGRRQIEDIYGGVLDGLKEYGRLSELFGADANKAVTEADKVVREWGRLKEEDAKALADLMHDATLAKVDADPLMRKDAQKRLDGIRTALDIADGKIEKAEAAVASAGARIARADAAYNKAQRAADKAAYALEKAQEKHGREILADEADMRLRRLFYADSEAKRALRRAGADVAAESRAKTDAVRMLEQARADVKRLEKDEVGAQKALEGLALLNRRFAGLPDAAQRVYRKARDDYRAHFGQVRDALAERLARAGQDAETVRRLKERFDNELGGVYFPLARFGDYLVVVKDADGNSANVSRAETLSEAEKLRDALKADFGAGFKVSPVMKSRDYIRSRDAVGSGFMRELGEAVGMLDLDPAQRARLNDTLTQLYLNSLPDTSWAKHGIHRKGVPGFSDDARRAYAQNMGSGANYLAKLRYADRMAEQLDVMQDFVDGRKYEEGFDQRQLQRVADEMRKRHEAVMNPNPSKLAQALTGFGFLWMMGMSPASAVVNLSQTAMVAYPVMAAKWGYAGAARELLRASKQIGLRFGEKFNTIEDSLNGDEKAAFRKAADYGVIDLSQAHDLAGVANGDPGLAGSAWQKVMDKAAWLFHHAEKFNRQVTFVAAYRLAKRAGADSEAAFEQAKKATYDGHFDYAAQNRPRFMMGNAAKVVFLFKQYSQNILYALGRNAYLAFKGDKEARKTLAGLLVSHAMASGILGLPFVSTLLAVASMLGSDDDDPWDAEAALRNMLADAFGDKAGEVLAKGFSRLTPLDVSGRLGLNQLVFPDIQDGLEGKKWAESLVVGSTGAVVGAGIGAADGVRTRSSVPRTANTLSLMKSW

SEQ ID NO: 85 - DNA, 1416 bp, Neisseria gonorrhoeae
atgagtgatttggtcagatacgatccgttggaacacgggcggcttgtcgggggtttgaaggagtaccgcggctttacgcaaaaggatgcgcgggcggccgccgacgatacggcgttgacgcgcgggtttaaaaattctatgcgttcggcgcgtatggggtggaatgcccttacgggcgacaaagaggaactgggccggctcaaggccgaggatatggattatcggaagattcaggaggggcgcaaatcccaagcgcgcagggagttgggcgaggcttgggaaaagggcgggggtgtcggcggcggcctgtcgaatgtgtggggggagcttaagaaggactggcgcgagaagggtttggacggcgccttggaagatgtgggcgagatggcgggtgcggtgctggagcaggcgcccaatgcgcttgtccctattgctacggcaaccgccggcggcatattgggcgctttggcgggcggtaacgcggctgtcggcgcttatgcgggcgcgaccttgggcaatacgctgatggaatacggcgggcagctggacagggcggcagaggcggcgggcgtcgaccctgcggacaaggatgcggtgatggcgtttatcggccgaggtgcgccgggtgcgttgaaaaatgcggcggtcaagggcgcggtggtcggcgcggcggatatggcggcgatgaaacttggcggcagtattttgaatatgggcaagaaggccgccgggaaagccgcattggagaaaatgggtgttgcggcggcggataaggcggcggttgcggcggctaagggaacgcctgaatttgcggcgctggcgaaggagtctgccaagggcggtttgggcggtgcggcacggcacgcggcggcttatgcgacggaatcggccggtgagtttgcgggcgagtatttgggtacggggctggcaaacggggaatgggacgagaagggggcggctttggaggctttctcttctttggggcattctgcggtggggtttgccggaacgaaggcttatgcggcggtaactgacccgctcaggccgcccggccggacggaaggcgggtgcgcaggggggtatcgggggcaacaggaaggcgggcaggccggccccggaaggggcgcaggcgttgcgtgcggcggcacaggcggctgcggacggcggcacaggcggctgcggacggaggcgcggaacagggcggcgcgggtttcgatacggcgcatcacgatcagtcgcatccggctttgcggcagtttgcggaccgtacgaagcaggaggaggcggggcggtttttcagcggccctgccgacggcaatacgccgcacgcggaggaattggcgcgcgggacggaaaaacagccggatgtttcgggtatcccgtcggaggacggggcggaatttttggatacgggcg

SEQ ID NO: 86 - protein, 472 aa, Neisseria gonorrhoeae
MSDLVRYDPLEHGRLVGGLKEYRGFTQKDARAAADDTALTRGFKNSMRSARMGWNALTGDKEELGRLKAEDMDYRKIQEGRKSQARRELGEAWEKGGGVGGGLSNVWGELKKDWREKGLDGALEDVGEMAGAVLEQAPNALVPIATATAGGILGALAGGNAAVGAYAGATLGNTLMEYGGQLDRAAEAAGVDPADKDAVMAFIGRGAPGALKNAAVKGAVVGAADMAAMKLGGSILNMGKKAAGKAALEKMGVAAADKAAVAAAKGTPEFAALAKESAKGGLGGAARHAAAYATESAGEFAGEYLGTGLANGEWDEKGAALEAFSSLGHSAVGFAGTKAYAAVTDPLRPPGRTEGGCAGGYRGQQEGGQAGPGRGAGVACGGTGGCGRRHRRLRTEARNRAARVSIRRITISRIRLCGSLRTVRSRRRRGGFSAALPTAIRRTRRNWRAGRKNSRMFRVSRRRTGRNFWIRA

SEQ ID NO: 87 - DNA, 2250 bp, Neisseria gonorrhoeae
atggggacggacgtaccggaaacaggcgtattgcccgataaaaacggcgaaccgctgactatcggggaataccggctgtttgtcggtgaaatgatgaaccaacctgcatggcgtgccgttgccgacaaggaaatggactacgccgacggcaggcagcttgacaacgagcttttacagaaacagcgcgagttgggcctgccccccgccgttgaaaacctgattaccccgaccctgctgtcggtacagggatatgaggcgacgatacggacggactggcgcgtgacggcggacggcgaaaccggcgggcgggacgtggcggacgcattgaacttcaaactcaaccgcgcggaacggcaaagccgtgccgacaaggcttgttcggacgcgttcagggggcagatagcctgcggcatcggctgggtggaggttacacgcaaccccaaccctttcgagtttccttatgagtgcggcgtcatccaccgcaacgccatccattgggatatgaaatcttacaaatacgacctgtccgatgcccgctggctgatacgccgccgctggctgctgccggaacgcctggcgcaattcttccctgaatatgccggacacttcaaagcgatggggcgcggcggttcggactggcgcatcagcggggaaatgcttgacggcggcggcaataccggactggcggacgcttggggtatttcggggcgcaacaccgtcagcgaagagttttggttcaatgaaaccacgcgcgaactggcggtggcggaagtatggtacaggcggtgggtaacggcagactgcctgcgcgacaaaaaaacagggcgcacggtggagtttgacggcgcaaacccaaaccatcgggagatggcggcaaacggcgcggtattgtttgccgcttccgtcccgcgtatgcgccgcgcctttgtcgtgggggatttggtcgtccgcgacgagccgaccccgtatccgcatcaaaagttcccttacgtcccgtttttcggattccgcgaggacaacaccggcatcccctacggatatgtccgcaatatgaaatacgcgcaggacaacctcaacagcaccaacagcaaattacgatggggtttgtcggcaatacgcacggtacgcaccaaaggcatagtcgatatgtcggacgaacagttccgccgcaatatcgcacgggtggacgcggacatcgtgctgaacaaaatagaggccgcccagccgggcgcgcgtttcgacgtcagccgcgatttcgaattgtcggcacagcattggcagatgcttcaagacagccgcgcgacaatacggcagatcagcgggattaccccgtcatttatgggcaaccggggcaacgccaccagcggcaggcaggaaagcatccaagtcgagcagtccaaccagtcgctggggctggttatggacaacttccgccagagccgctcattggtcggcgagttgctgcttgcgatgattatcgaggatttgggctcggacgagcaaaccgtcgtcatagaaggggacgccgtcacgcaagggcggacggtcgtcatcaacaggcctgaaaccgaccccgtaaccggcaaggcttatttgtccaacgacctgcaaaacatacggctgaaagtggctttggaagacgtgcccagcaccaactcctaccgcagccagcagctgggtgcgatgagcgaggcggtcaaatccctgccgcccgaatatcaggcggcggtgctgccgtttatggtgtccctgatggacatcccgtttaaagacaaagtgattgaaaaaatcaaagaagtccgagtgcaggaaacgcccgaacaaatcgaggcgcgtatcgcgcaggcggtgcaggacgcattggcaaaatccggcaacgacatcaaacggcgggaattggcgctcaaagaacaacgtaccgcgagcgaaatcaaggaaatcgaagcgcgggcggtacaaatcggcgtgcaggcggcttacgcggccatgcaggcgggcgggcagatagccgccatgccgcaaatcgcacccgttgccgacgcggtcatgcagggcgcgggatatatccggccggcgcggggcgacgatcccggcttccccgtccccgccatgccgcctgaaacgcaaataccgcccgaaggcatccctgaagcctacggcgcggataccggcccgatgacggccgtgccgccaaagagtgcgaatcacgcccaaacaggcatggaaacgccgacggtgtcggacaacctc

SEQ ID NO: 88 - protein, 750 aa, Neisseria gonorrhoeae
MGTDVPETGVLPDKNGEPLTIGEYRLFVGEMMNQPAWRAVADKEMDYADGRQLDNELLQKQRELGLPPAVENLITPTLLSVQGYEATIRTDWRVTADGETGGRDVADALNFKLNRAERQSRADKACSDAFRGQIACGIGWVEVTRNPNPFEFPYECGVIHRNAIHWDMKSYKYDLSDARWLIRRRWLLPERLAQFFPEYAGHFKAMGRGGSDWRISGEMLDGGGNTGLADAWGISGRNTVSEEFWFNETTRELAVAEVWYRRWVTADCLRDKKTGRTVEFDGANPNHREMAANGAVLFAASVPRMRRAFVVGDLVVRDEPTPYPHQKFPYVPFFGFREDNTGIPYGYVRNMKYAQDNLNSTNSKLRWGLSAIRTVRTKGIVDMSDEQFRRNIARVDADIVLNKIEAAQPGARFDVSRDFELSAQHWQMLQDSRATIRQISGITPSFMGNRGNATSGRQESIQVEQSNQSLGLVMDNFRQSRSLVGELLLAMIIEDLGSDEQTVVIEGDAVTQGRTVVINRPETDPVTGKAYLSNDLQNIRLKVALEDVPSTNSYRSQQLGAMSEAVKSLPPEYQAAVLPFMVSLMDIPFKDKVIEKIKEVRVQETPEQIEARIAQAVQDALAKSGNDIKRRELALKEQRTASEIKEIEARAVQIGVQAAYAAMQAGGQIAAMPQIAPVADAVMQGAGYIRPARGDDPGFPVPAMPPETQIPPEGIPEAYGADTGPMTAVPPKSANHAQTGMETPTVSDNL

SEQ ID NO: 89 - DNA, 1272 bp, Neisseria gonorrhoeae
atgacgggaaagacggttgatttgaaattgcccgcaaaactggacgggctgttcaagccttgccggtacaaggttatgtacggcgggcgcggcggcggcaaatcgcacggcgcggcatccgcactgctggcgctgggggcgcaacgccctttgcgtattttatgcgcgcgcgaaattcaaaaatcgatgcgcgattccgtacaccgcctgttgaaagacaaagtggcgcagttgggtttggggcatttctacgaaataaccgacttcgagatacgaggcgcaaacggcacgctgtttgtattttcgggcctgcagtcgcataccgtggacagcatcaaatcgtttgaaggtatcgacatcgtatgggttgaggaagggcacggcgtcagtaaaaaaagctgggacgtgctcacgccgaccatacgcaaagaaggttcggaaatttggattaccctcaatcccgatatggagacggacgaaacctaccggcgttttatcgctatgccgtccgaagacacttggctttgcgaaatcaactggcgcgacaatccgtggtttcccgaagcattgaaccgggagcggctcaaagcacagcgttcgatgaataaagaggactacgggaatatttgggaaggcaggccgcgcatggtatcggagggggcggtttaccggcatgaaatacaggacgcttttcattccggacgcgttacgctcgtcccttatgattcttctttgcccgtgcatacggtttgggatttgggctggaacgatgccatgaccatcgggctggtgcagcgcgatttgacgagcgtgcgcatcataggctacatcgaagacacgcaccggacgttggactggtatgttgccgaattggaaaagctgccctaccggtgggggacggacttcctgccgcacgacggcaggacgcgcaacttccaaacaggcaaaagtacgatggagattttgaccggactggggcgcaagtcggttttcgtgcaaaacgcgaccggtatcgaagaaggcatcagggcggcgcggatgctgtttcccaaagtgtacttcgataaagacaaaacagcgcggcttttggaatgcctgaaacggtacggccgccaaatacatgcgaaaacaggcgtggcaatggggccgctgcacgacgaatattcgcacggcgcggatatgttccgctacctggcgcaggcggttgatttaatggatacaggcagcaatacgggatacacggaaacgcccgtatcggattggaggctttat

SEQ ID NO: 90 - protein, 424 aa, Neisseria gonorrhoeae
MTGKTVDLKLPAKLDGLFKPCRYKVMYGGRGGGKSHGAASALLALGAQRPLRILCAREIQKSMRDSVHRLLKDKVAQLGLGHFYEITDFEIRGANGTLFVFSGLQSHTVDSIKSFEGIDIVWVEEGHGVSKKSWDVLTPTIRKEGSEIWITLNPDMETDETYRRFIAMPSEDTWLCEINWRDNPWFPEALNRERLKAQRSMNKEDYGNIWEGRPRMVSEGAVYRHEIQDAFHSGRVTLVPYDSSLPVHTVWDLGWNDAMTIGLVQRDLTSVRIIGYIEDTHRTLDWYVAELEKLPYRWGTDFLPHDGRTRNFQTGKSTMEILTGLGRKSVFVQNATGIEEGIRAARMLFPKVYFDKDKTARLLECLKRYGRQIHAKTGVAMGPLHDEYSHGADMFRYLAQAVDLMDTGSNTGYTETPVSDWRLY

SEQ ID NO: 91 - DNA, 1128 bp, Neisseria gonorrhoeae
atgatgaagccgtctgaaagtttgagagcggcaggcaggccaatcgcgtattacccgaaattggcaaagcctttgggcggtgtaaatgcggcaatattattcgggcatttcttctactggaacgataagacgcagtatgaatcaggcatttaccgaacagcggaagaaattgaaattgaaaccgggctgtccgttcaggaacaaagaacggcacgggcaaagctgagggaacgcggcgtattgattgagactgaaaaacgaattgaacaccgcatttactacaaactgaatttagacgcttttgatgatttgatgttgcaacattcggggggtggggaaccaacagccccgaaatgcaatatcaacagccccgaacttcaaaatcaacattcggggggtggggaaccaacagccccgaaatgcaatatcaacagccccgaacttcaaaaccaacattcggggagtggggaatcaacagccccgaaatgcaatatcaacagccccgaacttcaaaatcaacattcggggagtgaggaatcaacagccgttataagaacagaagatttaacagaagatttagcagtatatacccccttacccccaaacgccgaaaacggcaaaggcggtttgaacgctgacgcgtttgtttccgctgacgcggaaacgtgcgggcgggaaaccggcgaaccgacttcgccgaaggccgaaagcgacagtaacggcaacggcggcctttcgggaaaaccgaaaaatgcgaatgttccgcgccgccgcaaaacccacggcgtaccgcttcaggaaatcgccgatttgtacaacgaagttttgggcggccggttgccaagcgtccaagtgctgaacgacacgcgcaaacgggcgattgcaaaccgctggtgcgagatgctgggaacggcggcgccaaacggcaaggtgaggttcggggacaaggaaaccggtttggcctggtttgccggtttcttccggaaagtggcgatgaacccgttttggatgggcgaaaaccaaacagggtttgcggtcggcttcgattggattttcaaggcgggcaatttcgtcaaaatccttgaatggcatccgcctaaaacgaaccaggcggcaaggggaagggca

SEQ ID NO: 92 - protein, 376 aa, Neisseria gonorrhoeae
MMKPSESLRAAGRPIAYYPKLAKPLGGVNAAILFGHFFYWNDKTQYESGIYRTAEEIEIETGLSVQEQRTARAKLRERGVLIETEKRIEHRIYYKLNLDAFDDLMLQHSGGGEPTAPKCNINSPELQNQHSGGGEPTAPKCNINSPELQNQHSGSGESTAPKCNINSPELQNQHSGSEESTAVIRTEDLTEDLAVYTPLPPNAENGKGGLNADAFVSADAETCGRETGEPTSPKAESDSNGNGGLSGKPKNANVPRRRKTHGVPLQEIADLYNEVLGGRLPSVQVLNDTRKRAIANRWCEMLGTAAPNGKVRFGDKETGLAWFAGFFRKVAMNPFWMGENQTGFAVGFDWIFKAGNFVKILEWHPPKTNQAARGRA

SEQ ID NO: 93 - DNA, 852 bp, Neisseria gonorrhoeae
atgagcaacggcgcgcgttggacggttaccaatgattcaatgctgaaagagttggatttgtcggaagacgcgcaggtcgaatttagcgacaacaataaattcgtcaaagtgtccgtgagcaagctcaagggcgatggcggcgtgttcaaaatgtatggcgacatcgtcaaaggagaatcggacaagctgattacccgaaaaggcagcgaagggacgcacatcatcgaatatatggacgatgccaaggcaaaaacgacgggaagggaatatctgaaactggtcgaaaacaagggcaatcaagaagacaataaagcatcaaataaagcatcatacaaattgaatgtccgctgtacggaacagggagggtggtgttttgccttgggtgagtcgggtgcttccaaaaaggtcaatatttccacagacggtaagcgggacttctacctctacccggataccctgacgccgggcgcatcgagcagcgtccttttcggcgaggcgttgtatcagttgaacgcggtttccgatgaaacgctggtgcagcgtatgggcgaaatccacgccgacggaatgccgcaggaagacaacaacgtttggatcaaacgcgtcggcggaaaattctccggcagccgcagcgattaccgcgtgggcggttacggcaaccgctattggggctttgccggcggcttcaacaggacggggttcggcgataaatggattcattacaaagggctgatgctccgccacctccaatcgtcctacgcttccgaagactacgtcggcagcggcaaaatcttacggcagggcggcaggtgtttattccgcctggctcaaccgggaaagcagggcttatta

SEQ ID NO: 94 - protein, 284 aa, Neisseria gonorrhoeae
MSNGARWTVTNDSMLKELDLSEDAQVEFSDNNKFVKVSVSKLKGDGGVFKMYGDIVKGESDKLITRKGSEGTHIIEYMDDAKAKTTGREYLKLVENKGNQEDNKASNKASYKLNVRCTEQGGWCFALGESGASKKVNISTDGKRDFYLYPDTLTPGASSSVLFGEALYQLNAVSDETLVQRMGEIHADGMPQEDNNVWIKRVGGKFSGSRSDYRVGGYGNRYWGFAGGFNRTGFGDKWIHYKGLMLRHLQSSYASEDYVGSGKILRQGGRCLFRLAQPGKQGLL

SEQ ID NO: 95 - DNA, 420 bp, Neisseria gonorrhoeae
atgaccgatattttcactccatccaaacgttccttcgtgatgtcaaaaatccatagcaaagaaaccaaaccggaagtattggtaaggaaatttcttttttcccaaggtttccgttatcggaaaaacgataagcgctatgcaggcaaaccggatatcgttttgcctaaatataaaacagtcgtgtttatacacggctgtttttggcacgggcattcttgtaataaaggacatatcccgaaaagcaatatggatttttggttggaaaaaatcacaaaaaatcgcgaacgtgatattaaaaatgaaaccgagctggaaaagattggtttcaaagtgattgtcgtttgggagtgcgaattaaaaaataaagctatttgtagggagcgattaaatcggttggtcgaggaaataaaagatgccgtc

SEQ ID NO: 96 - protein, 140 aa, Neisseria gonorrhoeae
MTDIFTPSKRSFVMSKIHSKETKPEVLVRKFLFSQGFRYRKNDKRYAGKPDIVLPKYKTVVFIHGCFWHGHSCNKGHIPKSNMDFWLEKITKNRERDIKNETELEKIGFKVIVVWECELKNKAICRERLNRLVEEIKDAV

SEQ ID NO: 97 - DNA, 594 bp, Neisseria gonorrhoeae
gtgaaaggtgaaagcggagttgatatcgaaaattggaaaaacaaattgccagaaaaggaaagagaaccggtagaagttattttgaatcgtttggaagattcggagcttacaaataaagaacaagcggaagtaatctctgccttacatagtattattccagaatatccttactatcattggcggcatttgcatcaggatttgcatactgcctgtaacgatttttacaatgaaaagaaggattatttaagtgctgcaatcgaggcagttaaagttttcgaagataaggttcagaagcagacaggtcttcatagcatagacggaagagaattgattgaaaaagccttcgggagtaaaaaatctatgcttctattaacgaataacaaaacgcaggcggaacaaaatttagaagatggtcttgaacagcttgcatgcggaacatggactggatttagaaatcctgtgcaacatgagttaagagcaaatttatctcctagtatttttaatgacaaggatgctttggatttaatcagcttagtttcatatttattgagaaaagtggaacaaacaaaaaaacgagctaaacctacatcgcct

SEQ ID NO: 98 - protein, 198 aa, Neisseria gonorrhoeae
VKGESGVDIENWKNKLPEKEREPVEVILNRLEDSELTNKEQAEVISALHSIIPEYPYYHWRHLHQDLHTACNDFYNEKKDYLSAAIEAVKVFEDKVQKQTGLHSIDGRELIEKAFGSKKSMLLLTNNKTQAEQNLEDGLEQLACGTWTGFRNPVQHELRANLSPSIFNDKDALDLISLVSYLLRKVEQTKKRAKPTSP

SEQ ID NO: 99 - DNA, 855 bp, Neisseria gonorrhoeae
atgtctgaagaaaaattgaaaatgagtttcgagccaaccgtaatcgaacatttgggtgtaaagatgtattcgcacactgttcctgcgattgccgagttgatagcgaatgcctacgatgcatgtgctacggaagtggaagttaggttattcgataaaccggagcataaaatcgttattaaagataatggcataggaatgagcttcgatgaaatcaatgatttttatttgagaatcggtcggaacagaagggaagaaaaacaagcctccccgtgcggaagaattccaacgggtaaaaaaggtcttggtaaattggcattattcaggcttggcaacaaaatcgaaatctctactatccaaggaaacgaacgggttacttttactttggattatgcagagattaaaaaaagtgagcgtatttatcaaccggagtttcagaaagagtctgttaaacccaataccgaaaacggaacaactataactttaaccgagctgacgaaaaaacaaggatacccgttagataattatgtggggcatctttcccgtttatttgattttccggctcaggattttaaaatcaaagtaagcttgaacggctcggaaccaagaatcattgacggaaacctaaaatataatcttgttaccccacaattcgaatgggaataccaggatctagcaaccaatatttcatcgttatcttcaaaattcgaacagtatgaatacagcggattaatacaaggtaagttcattacaacggaaaaacctttaaagaataatatgaaaggtattaccttgtttgccaacggcagaatggtaaatatgcccgagtttttcactgatagcgaatccagccatttc

SEQ ID NO: 100 - protein, 285 aa, Neisseria gonorrhoeae
MSEEKLKMSFEPTVIEHLGVKMYSHTVPAIAELIANAYDACATEVEVRLFDKPEHKIVIKDNGIGMSFDEINDFYLRIGRNRREEKQASPCGRIPTGKKGLGKLALFRLGNKIEISTIQGNERVTFTLDYAEIKKSERIYQPEFQKESVKPNTENGTTITLTELTKKQGYPLDNYVGHLSRLFDFPAQDFKIKVSLNGSEPRIIDGNLKYNLVTPQFEWEYQDLATNISSLSSKFEQYEYSGLIQGKFITTEKPLKNNMKGITLFANGRMVNMPEFFTDSESSHF

SEQ ID NO: 101 - DNA, 462 bp, Neisseria gonorrhoeae
ttgggaatggaaaacggctttcccaaaattatggcaggacatcaagacgagacggattttatgcatagttgtgcgggattatccgatatcaatttgaaacgattggctttgatacctaaaaacggaggaaaccgtttggcttttgcgcatattcccgaattacagctggaatgttttatcggaaaagacaatagttttaaagacacgttcggtaggctatggtgggataagcccgcacctaccataacgaccaaattctttagcatttccaacgggcggtttgcccatcctgaagaagatagggcgttatccctgcgagaaggtgcaacattgcaatcgttccctcgtaactatgtctttaaagcgggcagtagggacaagatagcccgtttgattggtaatgccgttcctccgatgtatacggaaaaaataggcagggcaattgttgataatatcgaatgt

SEQ ID NO: 102 - protein, 154 aa, Neisseria gonorrhoeae
LGMENGFPKIMAGHQDETDFMHSCAGLSDINLKRLALIPKNGGNRLAFAHIPELQLECFIGKDNSFKDTFGRLWWDKPAPTITTKFFSISNGRFAHPEEDRALSLREGATLQSFPRNYVFKAGSRDKIARLIGNAVPPMYTEKIGRAIVDNIEC

SEQ ID NO: 103 - DNA, 510 bp, Neisseria gonorrhoeae
ttgcagcctgaaaccttggaaaaagaactcggcttaaaaaagaatgatgatgatttgattcttataggttgtagtccttgtcaatattggagtgttattcaaacagacaaaagaaaatcggaaaaatccaagagtttgcttttggagtttcagcggtttgtagaatatttcaatcccggatatgttgttgtagagaacgtaccgggaattctgagcagaatgaaagaaagcgggcttgataatttcataaagttattggaagaaaaaggatttaccgtccatttcggtattcacaatacggctgattacggaattccccaaagccgtaaaagatttacgttaattgcaaacagaataaccaaaaaaagctggaaccagtcaagtattcgggcaaacggcttacggtacgcgatgttttgggaatggaaaacggctttcccaaaattatggcaggacatcaagacgagacggattttatgcatagttgtgcgggattatccgatatcaatt

SEQ ID NO: 104 - protein, 170 aa, Neisseria gonorrhoeae
LQPETLEKELGLKKNDDDLILIGCSPCQYWSVIQTDKRKSEKSKSLLLEFQRFVEYFNPGYVVVENVPGILSRMKESGLDNFIKLLEEKGFTVHFGIHNTADYGIPQSRKRFTLIANRITKKSWNQSSIRANGLRYAMFWEWKTAFPKLWQDIKTRRILCIVVRDYPISI

SEQ ID NO: 105 - DNA, 342 bp, Neisseria gonorrhoeae
atgaatttaccttttcgggcaatggtgtctgatttaggtggcacacttttaacacctgaacatttagtgggtgatcttaccattgatactctgagagtattagagcaaaaaggcgtagatattattttggcaacaggacgcaatcataccgatatgtcatccattcttggaaaaatcggtgcggaacgtgcggttatgattacatcaaacggtgctcgtgtacgggatttacagggtaatttgctttatagcaatagtttgcctgaagaattagttctcgagctttacaaaacatcatatgtgggaaatcttattcagacaccaagattttgtcgccatcaa

SEQ ID NO: 106 - protein, 114 aa, Neisseria gonorrhoeae
MNLPFRAMVSDLGGTLLTPEHLVGDLTIDTLRVLEQKGVDIILATGRNHTDMSSILGKIGAERAVMITSNGARVRDLQGNLLYSNSLPEELVLELYKTSYVGNLIQTPRFCRHQ

SEQ ID NO: 107 - DNA, 1116 bp, Neisseria gonorrhoeae
atggaagagcaacttgcccaaaacgaccagccgtctgaaaaacttgtccgcctgtacggcgcttgggcagaaggcggcgcaggcgttttggtgacgggcaatgtgatggtggctgaaagcggcaaaggttcgataaacgatgtgttgatttcagacgaccgcgcccttgaaatgctgaagaaatgggcgaaagcccgcacgcaaaacgacacgctgctcatcatgcaaatcaatcatgcgggcaaacagtcgcctgcggtggtcaataaaacaccgcttgcaccgagcgccgtgccgctggtgggcatgaatggctttatcaatccgccgcgcgaattgagtgccgatgaaatcaacgggctgattcagcaattcgtacaaactgccaaaattgccgaacaggcaggcttttcaggcgtacaaatttacgccgtacacggttatctcatcagccaattcctctcgccgcaccacaaccgccgccaagaccaatggggcggcagtttggaaaaccgtatgcgcttccttttggaaacctacaccgctattcgcgctgccgcgggcaaagatttcttggtgggcgtaaaactcaattcggcagatttccaaaaaggcggatttgacgaaagcgaatcggtgcaggtggtgcaaaaactgtcggaaatgggcattgattttattgaagtttccggtggcaactacgaaagcccgcaaatgctcgccgccaaagacagcacccgcaaacgcgaagccttcttcatcgattacgccgaaaaagcccgtgcagccagccaagccccgctgattatcaccggcggattccgttcgcaaaccgccatggaagatgccttatccagcggtcatttggatttggtcggcatagcccgcccgtttgccttagtccctgatttggcgaacaaaatgcaaaacagaacttaccaaaccgtacaagcagaccgcatccaaactggcgtagcatttgttgataaaaaagcgggtgcaatgttagaaatgaactggtatatgacgcaaatggatttgatcggacaaggaaaacagtccaaccctaaaattgtcggcgtggaaagtattgctgaaaactttgcgggaaaacgg

SEQ ID NO: 108 - protein, 372 aa, Neisseria gonorrhoeae
MEEQLAQNDQPSEKLVRLYGAWAEGGAGVLVTGNVMVAESGKGSINDVLISDDRALEMLKKWAKARTQNDTLLIMQINHAGKQSPAVVNKTPLAPSAVPLVGMNGFINPPRELSADEINGLIQQFVQTAKIAEQAGFSGVQIYAVHGYLISQFLSPHHNRRQDQWGGSLENRMRFLLETYTAIRAAAGKDFLVGVKLNSADFQKGGFDESESVQVVQKLSEMGIDFIEVSGGNYESPQMLAAKDSTRKREAFFIDYAEKARAASQAPLIITGGFRSQTAMEDALSSGHLDLVGIARPFALVPDLANKMQNRTYQTVQADRIQTGVAFVDKKAGAMLEMNWYMTQMDLIGQGKQSNPKIVGVESIAENFAGKR

SEQ ID NO: 109 - DNA, 309 bp, Neisseria gonorrhoeae
atgccgcaacaaaccatgaatttaatgcgcgagtgcatacccatttttaccgtattgagcgatgaaaaccgccatcagatcctgcatgtattgtggaaacacggtaggatgaatgtgaatgagctgaccgagcatctgcatctgtcgcgccctgctgtgtcgcaccatttaaaaatcatgctgcaagccggagcggtggcggtggagcaggtcggcaaagagcggttttacagtattgccatggcggatgcggtggcgagattgaaacagcttgccgatttgatggctcaaaattgcccgctttcaaaa

SEQ ID NO: 110 - protein, 103 aa, Neisseria gonorrhoeae
MPQQTMNLMRECIPIFTVLSDENRHQILHVLWKHGRMNVNELTEHLHLSRPAVSHHLKIMLQAGAVAVEQVGKERFYSIAMADAVARLKQLADLMAQNCPLSK

SEQ ID NO: 111 - DNA, 468 bp, Neisseria gonorrhoeae
ttgtacaaacaatatgcggactggaacagattatcctacaatgcgccaatttatgttggcaaggccgtccccaaaggctggcggcaagcaagaaattctgataatgcgctaaaccaatcaaccgaactgttccaccggttgaaagaacacagcaggagtattgccgctgtttctgatttagatccttccgatttcatgtgcagattcgttatctttgaaggtgccggttctgacatgataggcacaatcgaagctgccctgattaaattacacaaacctctatggaactcttgtgtcgatggtttcggaaaccacgaccccggaaaaggccgttacgaacaagccaaatcggattgggatgtccttcatagcgggcgggtttgggcagataggctaaacggcataccgaatagctatgagtccatacttgaaaatatcaacacacatttagagataataaagagaaaa

SEQ ID NO: 112 - protein, 156 aa, Neisseria gonorrhoeae
LYKQYADWNRLSYNAPIYVGKAVPKGWRQARNSDNALNQSTELFHRLKEHSRSIAAVSDLDPSDFMCRFVIFEGAGSDMIGTIEAALIKLHKPLWNSCVDGFGNHDPGKGRYEQAKSDWDVLHSGRVWADRLNGIPNSYESILENINTHLEIIKRK

SEQ ID NO: 113 - DNA, 1131 bp, Neisseria gonorrhoeae
atgaagtctttggaaattttttccggcgcgggcgggttggcaaaaggccttgaacttgcaggattccaacatgcatcttttattgaactcaataaagatgcatgcaattctttaagaagcaactttaaccccaagcttgtttatcagggagatgtggcagattttgatctttccagtcaagaaggcatagaagtcattgcaggcggtcctccttgccagcccttttcattgggcgggaaacaccttgcccatgaagacagaagggatatgtttcctcatgcggtcagatatgtggagtattaccgccccaaagcttttatctttgagaatgtaaaaggacttttaagaaaatcattcgctgattattttgaatatatcctacttcggcttacttatccgaatcttggtattttgcagaatgaagattggaaaggccatctgacacggctgaaagaaattgaattcaatttatataaaggaatcaaatataaggtttcatatcaattgttgaatgcagctgattacggagtgccgcaaaaacgcgaacgcgtggttatcgtaggtatccgggccgatttggatattgattggaaattcccaaaaagaacacattccgaagacaggttgaattgggaaaagtatgtaacgggggaatactgggaaaaacacaacgaacccaaaagattcaataaagatattgctgaaaagttacaaaaaaaatacggtatattcgaaccagaaaaaaaaccttggcaaacggtaagggataccttgtccgacatcccgcatcctttggggaatcataaaattacaggacatgaatatagggatggcgcaagaatttatcccggacacacaggaagcgggatagacgaaccgtccaaaaccattaaagcaggtgggcatggcgttcccggcggagaaaatatgattcgttatgatgatggaacagtcagatactttaccagctatgaagcaaaacttcttcaaacattccctgaagaatttgtcatttctggagcttggggagaagcaatgcgacaaattggcaatgcggttcctgtcaaattgtcggaaattttaggcaaacatctgatgggggtgttgtcggagaaaagcagcctgcacaac

SEQ ID NO: 114 - protein, 377 aa, Neisseria gonorrhoeae
MKSLEIFSGAGGLAKGLELAGFQHASFIELNKDACNSLRSNFNPKLVYQGDVADFDLSSQEGIEVIAGGPPCQPFSLGGKHLAHEDRRDMFPHAVRYVEYYRPKAFIFENVKGLLRKSFADYFEYILLRLTYPNLGILQNEDWKGHLTRLKEIEFNLYKGIKYKVSYQLLNAADYGVPQKRERVVIVGIRADLDIDWKFPKRTHSEDRLNWEKYVTGEYWEKHNEPKRFNKDIAEKLQKKYGIFEPEKKPWQTVRDTLSDIPHPLGNHKITGHEYRDGARIYPGHTGSGIDEPSKTIKAGGHGVPGGENMIRYDDGTVRYFTSYEAKLLQTFPEEFVISGAWGEAMRQIGNAVPVKLSEILGKHLMGVLSEKSSLHN

SEQ ID NO: 115 - DNA, 219 bp, Neisseria gonorrhoeae
ttgtcggacatatcggcttcgcgggctgcctatatggatgtgcaaaaacaatatccctttgaaaccgtcgccgtatgcgtgctgccgaaccatattcacgccatttggacgctgccgcccgacgatgcggattattccctactccggcggctgattaaaaccaaattctccgcatattcccctcatactaaaaacttaggggctgtactagattatccc

SEQ ID NO: 116 - protein, 73 aa, Neisseria gonorrhoeae
LSDISASRAAYMDVQKQYPFETVAVCVLPNHIHAIWTLPPDDADYSLLRRLIKTKFSAYSPHTKNLGAVLDYP

SEQ ID NO: 117 - DNA, 372 bp, Neisseria gonorrhoeae
ttgttcaaatggcttatattttggattgttagaatgaatactaaaacagagttacaaaaacttttagaagaggatatatcaactttaaaagaaacactaattcgtgtagatgctcttcctccaagatatgtacgtagcattgcaactcctattgtccgtcgatggttaattgacaaacaattaaatattctcgcaaaagaaataggtttaactatagaattgcccatccttgatacaagtttggtatttgaaaaattgtcaaccttagagaataaagttaatttttatagtagattaacaaaaatcaggacaaggcggcgagccgcagacagtacaaatagtacggcaaggcgaggcaacgccgtaccggtt

SEQ ID NO: 118 - protein, 124 aa, Neisseria gonorrhoeae
LFKWLIFWIVRMNTKTELQKLLEEDISTLKETLIRVDALPPRYVRSIATPIVRRWLIDKQLNILAKEIGLTIELPILDTSLVFEKLSTLENKVNFYSRLTKIRTRRRAADSTNSTARRGNAVPV

SEQ ID NO: 119 - DNA, 303 bp, Neisseria gonorrhoeae
atggctggtggagtttatttaggcggaaaaattattagccctatatatcattcatcacaagaattttctggtgaaccaataatctatgctgaaacaaatataattttatgtcctgctgaaaaatttttaactttaaaacgagttttccataatggaaatatttttaatatgaatcagataattacttttttatccaataaacaagggggagtacgttttgataaaaattacgataaatataaaacttggcaagttgctatagaaaaagcagcaaattttttaaaactcggtaatccatataat

SEQ ID NO: 120 - protein, 101 aa, Neisseria gonorrhoeae
MAGGVYLGGKIISPIYHSSQEFSGEPIIYAETNIILCPAEKFLTLKRVFHNGNIFNMNQIITFLSNKQGGVRFDKNYDKYKTWQVAIEKAANFLKLGNPYN

SEQ ID NO: 121 - DNA, 537 bp, Neisseria gonorrhoeae
atgacagaattaccgtggatagccgaagcgagaaggcacatcggtttgaaagaaattcccggcgcgaaacacaatccgacgattgtgcaatggctcaaagagacgggcggcttccccggcgcggcaaagtcttggtactttgaagacgaaacgccgtggtgcggcctgtttgtcggatactgcctgggcaaaagcggacgcgcggtcatcagggactggtatcgcgccaaagcctggtcaatgtcgggtttgacgaaactcgaagcccccgcatacggctgcatcgcggtcaaaccgcgccggggcggcggacacgtgttcttcgttgtcggcaaagacgcggaaggcagaatcttgggcttgggcggcaatcagggcaatatggtatccatcatcccgtttgaccctgcggacattgacggctacttctggccgtccaagctgattggcggcaaagccgtgccttcgtcccccgccgaagggcgttaccggttgtcggacgttgccgccacggcgaaacagggcgcgggcgaggcg

SEQ ID NO: 122 - protein, 179 aa, Neisseria gonorrhoeae
MTELPWIAEARRHIGLKEIPGAKHNPTIVQWLKETGGFPGAAKSWYFEDETPWCGLFVGYCLGKSGRAVIRDWYRAKAWSMSGLTKLEAPAYGCIAVKPRRGGGHVFFVVGKDAEGRILGLGGNQGNMVSIIPFDPADIDGYFWPSKLIGGKAVPSSPAEGRYRLSDVAATAKQGAGEA

SEQ ID NO: 123 - DNA, 342 bp, Neisseria gonorrhoeae
atgattggggctttgctgaaaaattggaagccgctgcttattttgtccgcaatcgcgttcttcgccgtttcttggcagctggacagggcggcgcaataccgtcgcggatacggtgcggcggtgtcggaggtttcggaacgcctcaaagccgccgcggtcgaacacgccgaacacgcccgcaaatcgtccgccgcgtatcaggcgcaaaaggcggcgcgcgaggaaaaagaaagggtgcgctatgtgcaaacgcttaaaatcattgaaaaacctgtgtaccgcaatgcctgttttgatgctgacggcgtgcgcgaactcaacgccgccgttgacgacggcggt

SEQ ID NO: 124 - protein, 114 aa, Neisseria gonorrhoeae
MIGALLKNWKPLLILSAIAFFAVSWQLDRAAQYRRGYGAAVSEVSERLKAAAVEHAEHARKSSAAYQAQKAAREEKERVRYVQTLKIIEKPVYRNACFDADGVRELNAAVDDGG

SEQ ID NO: 125 - DNA, 1023 bp, Neisseria gonorrhoeae
gtgcggcatcggttgttgtccggatcggtacggcattttcatttccgcccattattggtgcgcctgataattttgtataacgcccccttcgcgcaaacaaaacggcaaaaatttgccgcgtccgcccgatatgtaaaaaatcggggggaatgccgacacttcccccgatgcggccgccaacccggaaccgacggttcggttgcaaacttccggttgacaactcaatccgcgcccaacgcccgtaccagcgcgccgtgccgcgccctgcagtcgttatacataccggccgccttcagggcccacggcagcacgtccgcgcccgtgttcccttcaaggtgcggcagtttcgggcagggccgcaccaaatcggcgggcggcttaaccgccgtcgtcaacggcggcgttgagttcgcgcacgccgtcagcatcaaaacaggcattgcggtacacaggtttttcaatgattttaagcgtttgcacatagcgcaccctttctttttcctcgcgcgccgccttttgcgcctgatacgcggcggacgatttgcgggcgtgttcggcgtgttcgaccgcggcggctttgaggcgttccgaaacctccgacaccgccgcaccgtatccgcgacggtattgcgccgccctgtccagctgccaagaaacggcgaagaacgcgattgcggacaaaataagcagcggcttccaatttttcagcaaagccccaatcatttacgcctcgcccgcgccctgtttcgccgtggcggcaacgtccgacaaccggtaacgcccttcggcgggggacgaaggcacggctttgccgccaatcagcttggacggccagaagtagccgtcaatgtccgcagggtcaaacgggatgatggataccatattgccctgattgccgcccaagcccaagattctgccttccgcgtctttgccgacaacgaagaacacgtgtccgccgccccggcgcggtttgaccgcgatgcagccgtatgcgggggcttcgagtttcgtcaaacccgacat

SEQ ID NO: 126 - protein, 341 aa, Neisseria gonorrhoeae
VRHRLLSGSVRHFHFRPLLVRLIILYNAPFAQTKRQKFAASARYVKNRGECRHFPRCGRQPGTDGSVANFRLTTQSAPNARTSAPCRALQSLYIPAAFRAHGSTSAPVFPSRCGSFGQGRTKSAGGLTAVVNGGVEFAHAVSIKTGIAVHRFFNDFKRLHIAHPFFFLARRLLRLIRGGRFAGVFGVFDRGGFEAFRNLRHRRTVSATVLRRPVQLPRNGEERDCGQNKQRLPIFQQSPNHLRLARALFRRGGNVRQPVTPFGGGRRHGFAANQLGRPEVAVNVRRVKRDDGYHIALIAAQAQDSAFRVFADNEEHVSAAPARFDRDAAVCGGFEFRQTRH

SEQ ID NO: 127 - DNA, 996 bp, Neisseria gonorrhoeae
gtgtatgttaaacatacacccttgctgaaaaagccaacgggcggactttcgggacatctccggatgtgctgtttccacgagcagtcgaccaacctgaaacgtccgcctacctcttcttggtcgaagagaggctttcaaactttcgtggagcttaaaatgcaaaacaccatttctgtattttctttcaaatctcaaaatgtccgtactcaaatcttgggggctgaaccttggttttgccttggcgatgttgcggaaattcttcaaattcaaaatgcccgtcagttgccattaaaagaccagggcattcaaaaatccagcgttgcaacaaaaaaaggcaaccaagaattacttttcatcaacgagccgaatctctaccgagtcatcttccgttcacgcaaagccgaagccgtcaaattccaagactggatatttgaagaggttatccctcaaatccgcaaaacaggcggctaccaaattactcccaaaaccaccgccgacgaccgtaccggattgcgccgggcggttgccgcgcttgtcgggcgcaaacgcataggctactcctccgcgtacagtatgatacaccaacgcttcaacgtcgaagccgtcgaaggcatccccgccgacaaactgcccgaagccgtcgcctacgtccacgcattgacactgcacacgggtttggccggcgaagtccccgaccgcgaaccgttgcccgcgccgcaacccgccctgcccataagcggcaacgctttggccgacattgccgctatggtttattacggcacacggatgatcgaattgggcaaagacgtttccgcgccgctgaagcagctcggctgcaaacaggcggttacgatgtggacggtttggcacgaaacccgttcaatcctgaaaagatccgtcgcagccctcgaagtgttgcggggatatgcggacaaagacgcctccggccgcatagccgcatgtcttgaaggcatttacggcaaggctgcggcaagg

SEQ ID NO: 128 - protein, 332 aa, Neisseria gonorrhoeae
VYVKHTPLLKKPTGGLSGHLRMCCFHEQSTNLKRPPTSSWSKRGFQTFVELKMQNTISVFSFKSQNVRTQILGAEPWFCLGDVAEILQIQNARQLPLKDQGIQKSSVATKKGNQELLFINEPNLYRVIFRSRKAEAVKFQDWIFEEVIPQIRKTGGYQITPKTTADDRTGLRRAVAALVGRKRIGYSSAYSMIHQRFNVEAVEGIPADKLPEAVAYVHALTLHTGLAGEVPDREPLPAPQPALPISGNALADIAAMVYYGTRMIELGKDVSAPLKQLGCKQAVTMWTVWHETRSILKRSVAALEVLRGYADKDASGRIAACLEGIYGKAAAR

SEQ ID NO: 129 - DNA, 414 bp, Neisseria gonorrhoeae
gtgtgtaccttatgccggacctgcatgttgaaacataaaggaaaaaatcatgaaccgtcgtcaatttttgggcagcgccgctgccgtctctttggcttccgccgcctctttcgcgcgtgcgcacggacacgccgactaccaccatcatcacgatatgcagcctgccgccgcatccgcctacaccgccgtccgccaaactgccgcacactgtctggatgccggacaggtttgcctgacccactgcctgtccctgctcactcagggcgacacgtctatgtccgactgtgcggttgccgtgcgccagatgcttgccttatgcggcgcggtgcacgaccttgccgcacaaaattcccctctgacacgcgacgcggcaaaagtgtgcctcgaagcgtgcaaacagtgtgccaaagcctg

SEQ ID NO: 130 - protein, 138 aa, Neisseria gonorrhoeae
VCTLCRTCMLKHKGKNHEPSSIFGQRRCRLFGFRRLFRACARTRRLPPSSRYAACRRIRLHRRPPNCRTLSGCRTGLPDPLPVPAHSGRHVYVRLCGCRAPDACLMRRGARPCRTKFPSDTRRGKSVPRSVQTVCQSL

SEQ ID NO: 131 - DNA, 453 bp, Neisseria gonorrhoeae
atgaaccgtcgtcaatttttgggcagcgccgctgccgtctctttggcttccgccgcctctttcgcgcgtgcgcacggacacgccgactaccaccatcatcacgatatgcagcctgccgccgcatccgcctacaccgccgtccgccaaactgccgcacactgtctggatgccggacaggtttgcctgacccactgcctgtccctgctcactcagggcgacacgtctatgtccgactgtgcggttgccgtgcgccagatgcttgccttatgcggcgcggtgcacgaccttgccgcacaaaattcccctctgacacgcgacgcggcaaaagtgtgcctcgaagcgtgcaaacagtgtgccaaagcctgtaaagaacactccgcccaccatgcggaatgcaaagcctgttacgagtcctgcctcgactgtatcaaagaatgcgaaaaactcgccgcc

SEQ ID NO: 132 - protein, 151 aa, Neisseria gonorrhoeae
MNRRQFLGSAAAVSLASAASFARAHGHADYHHHHDMQPAAASAYTAVRQTAAHCLDAGQVCLTHCLSLLTQGDTSMSDCAVAVRQMLALCGAVHDLAAQNSPLTRDAAKVCLEACKQCAKACKEHSAHHAECKACYESCLDCIKECEKLAA

SEQ ID NO: 133 - DNA, 1371 bp, Neisseria gonorrhoeae
ttggactggcggggcaacaaaccgcttggggcggcggagctggcggatttgaaaccgctttacaaagactttatgtattgggaacgcggtctgcacatgtataaggcaagtgccgtcgtgccgacgggatatgtacgggttgggaataccgcgccgctgtgcggcgaagacacgcagcggtatgcctctttttggggcgacggctacgacgtgtaccgtcagttgagatggcggcagatacccgaaaaacagagaaaggcattcaaaaaagccgccaaaagcaaaaataccgtgatgtttgccggacgggaatacggcatatccaaacagaatttgagcgatgtttgggatgattttgaagacgcgatggaactgaaggcgtttccctgcctgtcttcgctgtttctgaccaagtggcataaaaatctatatgaatatctggaggaatatccgtttatcacccgattgtgtctggaaaaccacggtcagaccgtgctggatttcagcaatacgcgcataaccgacctttctgtcgatatgaccggcgtggaatcgctttatttgaacgaaggcttggacagcctgaacctgaaaggcgaaatcaaggaaaactgcaaggtctgtaccgccggaaagggcgcgggtctgattttggaagtgggcaaaagcgttcccaaagtgcggggtttggaaaacctgaccgccgtcaacgtcatgggcattgccgatttcgatatgcaaaacctgtcggaaacgtatcccaagctcaaaaccatacggctgtggggcaaaccgggcaatatcgccaatttttccgccgtatcgggatttgaggatttggaagtgttcactgccgtagatttgttcggtttcggcgcggacgacatccctcatcccgaccggctgccgaagctgcacaggctgtggatgagcagcctgcccgaagaggcggcgaaggcagtgaagaaactttataagaaacggaaggaagacgggctggacccgtggatagaaaaagcccgaaaacccgaatggctggcgcaaaatttcgacaaccccttccgcgattgggacggcgcggagcatatcccgaaaagccatgccaaaaaagcggcggagctgtaccggaaaacccgtgccggcgtggtcaaactgctcggcaatccgcctgaaaacataggggaggggctggcagaggcggtcaaagcctataccggaggtttcaacaaaatggacaaaaaacactttatcgacacggtagagcgggaagatattgccgaggcgttggaaacgatattggacctgataccggatgggtcttgtgccgacaaggaaaaactgtttgaaatatttgataaaaacaggaatttt

SEQ ID NO: 134 - protein, 457 aa, Neisseria gonorrhoeae
LDWRGNKPLGAAELADLKPLYKDFMYWERGLHMYKASAVVPTGYVRVGNTAPLCGEDTQRYASFWGDGYDVYRQLRWRQIPEKQRKAFKKAAKSKNTVMFAGREYGISKQNLSDVWDDFEDAMELKAFPCLSSLFLTKWHKNLYEYLEEYPFITRLCLENHGQTVLDFSNTRITDLSVDMTGVESLYLNEGLDSLNLKGEIKENCKVCTAGKGAGLILEVGKSVPKVRGLENLTAVNVMGIADFDMQNLSETYPKLKTIRLWGKPGNIANFSAVSGFEDLEVFTAVDLFGFGADDIPHPDRLPKLHRLWMSSLPEEAAKAVKKLYKKRKEDGLDPWIEKARKPEWLAQNFDNPFRDWDGAEHIPKSHAKKAAELYRKTRAGVVKLLGNPPENIGEGLAEAVKAYTGGFNKMDKKHFIDTVEREDIAEALETILDLIPDGSCADKEKLFEIFDKNRNF

SEQ ID NO: 135 - DNA, 1014 bp, Neisseria gonorrhoeae
ttgcaagagtttaaatttatttttggacaagatttcggattgtctaaaaaagaggctattcggaaagtgttgaaatggcttccgtcccatttgaaattcacactgatggtagctcaaggcattcagggttttcatcctaaagctgtattttggaagaatgataagaatgaatattatgctttaatcggttcttcaaatttgactcatgctgcgtttaatagcaattatgaagcaaatattttgactaaaatttccgagcaggattttataaaagtcaaatcttgggctgatgaaattgcgatgaaatctatcccggtatcggaagattggcttgaggagtatcaggaagctgaaattaactataagaaatcaactgttagacaatcagtgatggataagttatttatggagatgccaaattataatcaagaactgattgcggcacggagaaagcagatgagaaaccatcaaactgtgtgtaatcaattaaaaaatcttattaagcaatgtgcagcaggaaaaatagacaataatgatttttatggggaatttaataaattatggtcttggaaaagcgaaaataaaggagaaggggtaggcaatcgttttcaagataaaacgtggaaaaggacgggtaagtcttcagattttagaaaattatgcattgccatccaatcagtttttgatgctccacttactgagagagataatgtggttgccaagcaaattgattggctaaaagaatgtggggtttccactcgtggttcagttttttctgaaatgctttgtcaagaatatccagatagatatcctgttttaaatgctcccattaaaaaatttttagaagaaaataaatttaagtctgcaaaaggagcaagcgaaggctccaaatatattgatttaagtatgaagttaagagctttactagctatgcagtcagaaataaaagatttggctgaattagatgttttagtacaggcagaatatcgcaatcgtacagatattgattgggaa

SEQ ID NO: 136 - protein, 338 aa, Neisseria gonorrhoeae
LQEFKFIFGQDFGLSKKEAIRKVLKWLPSHLKFTLMVAQGIQGFHPKAVFWKNDKNEYYALIGSSNLTHAAFNSNYEANILTKISEQDFIKVKSWADEIAMKSIPVSEDWLEEYQEAEINYKKSTVRQSVMDKLFMEMPNYNQELIAARRKQMRNHQTVCNQLKNLIKQCAAGKIDNNDFYGEFNKLWSWKSENKGEGVGNRFQDKTWKRTGKSSDFRKLCIAIQSVFDAPLTERDNVVAKQIDWLKECGVSTRGSVFSEMLCQEYPDRYPVLNAPIKKFLEENKFKSAKGASEGSKYIDLSMKLRALLAMQSEIKDLAELDVLVQAEYRNRTDIDWE

SEQ ID NO: 137 - DNA, 312 bp, Neisseria gonorrhoeae
ttgtctgaaaacgggaagggcaattttgccgcagccgccgccgtcattcccgcgaacctacattccgtcattcccacgaaagtgggaatccggaacgcaaaatctaaagaaaccgttttatccgataagtttccgcaccgacaggtctggattcccgcttatgcgggaatgacggcggcgggaatcggcggattcggcggagttggtggatttggcgggctgaagcccgcccttgtatatcggaacttccgtatcatagcgacaaaccgcccggccgccacccgcgcccgcccaaggcagacaaccgttgcg

SEQ ID NO: 138 - protein, 104 aa, Neisseria gonorrhoeae
LSENGKGNFAAAAAVIPANLHSVIPTKVGIRNAKSKETVLSDKFPHRQVWIPAYAGMTAAGIGGFGGVGGFGGLKPALVYRNFRIIATNRPAATRARPRQTTVA

SEQ ID NO: 139 - DNA, 417 bp, Neisseria gonorrhoeae
atgaaaaaacttctaatgataaccctcaccggtatgcttgcagcttgttcaacaggtgtcaatgtcggccggttgatggttgaaatgccgcagggagaacgccctgttgtcgtgcaggttcccgcgacgaataacccgctttccgatgcggtggctgtcggaatgattaaaacatccggatcgccttcggcatcaaatatgattgaaatgctcggcgcggacaatatcaacgtcggcgtggcgggaggcagccaaatgtttaataaggcgaccgcactttattccttaaaccatgcaaagaaagtcggaaataatgtcagtgtctatatgacgggcgatagcgaaagcgacaaggccgatttggaaaacgcggcaaatgccaaaaatattaaattacattatttctttaaccaaaaa

SEQ ID NO: 140 - protein, 139 aa, Neisseria gonorrhoeae
MKKLLMITLTGMLAACSTGVNVGRLMVEMPQGERPVVVQVPATNNPLSDAVAVGMIKTSGSPSASNMIEMLGADNINVGVAGGSQMFNKATALYSLNHAKKVGNNVSVYMTGDSESDKADLENAANAKNIKLHYFFNQK

SEQ ID NO: 141 - DNA, 447 bp, Neisseria gonorrhoeae
atgcgctattttaatagaaacggaaggatgcctgacaacttgattttgatttcggttttggcaaagccctcgccgacacacgcacgcaaaaccttgataggcggatatcacattgcggcgttccaaaccgatttggacggacgcatcgacaggatgcgggctgatttgccgagcctgaccatggtcaagctcggaaagccccttccccgtaaaggcggtattcgaataggctttgatatcgccctatcggttggggaaaatatttcggtttgccgcctgaacataggaataaccgcctttcaatttgcaaacaaccgaaatcgtaccgattgttcagacacagccaaaaacaaatgccgtctgaaacccggattgtcaggcttcagacggcattttttgttcaggcggttgccgcttcctccccgaacacttcccgccacaatttcc

SEQ ID NO: 142 - protein, 149 aa, Neisseria gonorrhoeae
MRYFNRNGRMPDNLILISVLAKPSPTHARKTLIGGYHIAAFQTDLDGRIDRMRADLPSLTMVKLGKPLPRKGGIRIGFDIALSVGENISVCRLNIGITAFQFANNRNRTDCSDTAKNKCRLKPGLSGFRRHFLFRRLPLPPRTLPATIS

SEQ ID NO: 143 - DNA, 555 bp, Neisseria gonorrhoeae
atgacgcacaccgcatcgaaaacacccaaactctgggcggtcattgccgccgccgcattcatcctgctgattaccatcggcatgaggatgacgctcggactgttcgtccaacccgtcgtcaacaccaccgaattgaacattgcccagttcagcctcatcatcaccgttttccaactgatgtggggcgtattgcaaccattgtccggcgcgcttgccgaccgtttcggcgcgttcagggtattaagcggcggtgccctcctgctcgtctgcgcctgcctgattgcctccaacatcccgacttattgggggctgatgattgccgtcgggctgctgctcgcattcggcaccggttccggcgggttttccatcattatgggacaggtcgccgcccaagtccccacacacaaacgcggcttggcatccggactggtcaacgcaggcggttcggcaggacaattcctgttcgcaccgctggttcaaggactcaaggactcgtcgtcctgcccgaagtcggctggacgggtacattttacgtttggggcgcaatcgccctgc

SEQ ID NO: 144 - protein, 185 aa, Neisseria gonorrhoeae
MTHTASKTPKLWAVIAAAAFILLITIGMRMTLGLFVQPVVNTTELNIAQFSLIITVFQLMWGVLQPLSGALADRFGAFRVLSGGALLLVCACLIASNIPTYWGLMIAVGLLLAFGTGSGGFSIIMGQVAAQVPTHKRGLASGLVNAGGSAGQFLFAPLVQGLKDSSSCPKSAGRVHFTFGAQSPC

SEQ ID NO: 145 - DNA, 675 bp, Neisseria gonorrhoeae
gtggggcgtattgcaaccattgtccggcgcgcttgccgaccgtttcggcgcgttcagggtattaagcggcggtgccctcctgctcgtctgcgcctgcctgattgcctccaacatcccgacttattgggggctgatgattgccgtcgggctgctgctcgcattcggcaccggttccggcgggttttccatcattatgggacaggtcgccgcccaagtccccacacacaaacgcggcttggcatccggactggtcaacgcaggcggttcggcaggacaattcctgttcgcaccgctggttcaaggactcaaggactcgtcgtcctgcccgaagtcggctggacgggtacattttacgtttggggcgcaatcgccctgctgattctgcccgtctcatggtggcttgccggcggcaacaacggcggcaacaacgccgcccacacccaacacacccaagccacacacggacaaagcctcggagaagcagtcaaaaccgccttcaaaaccccaagctacatcctgctgcacctgagctttttcgcctgcggcttccacatcgcctttctcgtaacccacctacccacggaagtcgccctgtgcggactgcccgccaccgtcgcctcgacatccatcgccatcatcggactggcaaacatcgccggttgcgtgttctcaggc

SEQ ID NO: 146 - protein, 225 aa, Neisseria gonorrhoeae
VGRIATIVRRACRPFRRVQGIKRRCPPARLRLPDCLQHPDLLGADDCRRAAARIRHRFRRVFHHYGTGRRPSPHTQTRLGIRTGQRRRFGRTIPVRTAGSRTQGLVVLPEVGWTGTFYVWGAIALLILPVSWWLAGGNNGGNNAAHTQHTQATHGQSLGEAVKTAFKTPSYILLHLSFFACGFHIAFLVTHLPTEVALCGLPATVASTSIAIIGLANIAGCVFSG

SEQ ID NO: 147 - DNA, 318 bp, Neisseria gonorrhoeae
atggtgctgatttacatcttctcacccaaaaccgacctcaacttttacattttcgccgccgcactcggattcacatggctcgccaccgtcgccccgaccgccgccgttaccggcaaactcttcggcacgcgctacctcgccaccctgttcggactggtgatgctcacccaccaaatcggcggattcctcggctcgtacatcggcggcatcgtgattacacaattcggtgactacggctggatgtggtacgccgatgccgtactcgccggcacggcagccctgcttgtcctgcccgtccgcgaaccccgaaccgccgca

SEQ ID NO: 148 - protein, 106 aa, Neisseria gonorrhoeae
MVLIYIFSPKTDLNFYIFAAALGFTWLATVAPTAAVTGKLFGTRYLATLFGLVMLTHQIGGFLGSYIGGIVITQFGDYGWMWYADAVLAGTAALLVLPVREPRTAA

SEQ ID NO: 149 - DNA, 402 bp, Neisseria gonorrhoeae
atgaacattatcgatgccatcatcaatttggctaacaaccctgttgtcggggtcaactcccattctcaaagcaacaatcgtgccaatcaggcaggtgatgctttggaagaatatgtaaaagacttgttttccggcagtttcaacctaaatgaaacccaacgcatagcccgacacgcaaaagtattctcatatttgggcaacaactccaaccctcctgatgccatgttgcgaaacggggatgccatcgaagttaagaaaattgaaagtaaagattccgcactggcgctgaatagcagccacccaaaatcaaagctctctgttgatgacagcatgcttacaaaagcctgcaaagatgcggaaaaatgggaagagaaagacattatctataattgtcggcgtcgt

SEQ ID NO: 150 - protein, 134 aa, Neisseria gonorrhoeae
MNIIDAIINLANNPVVGVNSHSQSNNRANQAGDALEEYVKDLFSGSFNLNETQRIARHAKVFSYLGNNSNPPDAMLRNGDAIEVKKIESKDSALALNSSHPKSKLSVDDSMLTKACKDAEKWEEKDIIYNCRRR

SEQ ID NO: 151 - DNA, 408 bp, Neisseria gonorrhoeae
ttggcaatggtttacggaatcgactactgcgccgatgccgaatgctatttgaagataaaaaatcaaattaaggaaggaatcggcaacatcggcggcatacagtttgcagaaaccaaagagctgggcagggtcaaccgcattgatccgctcaacataacttatctgagagtacggggtatgtggggaatcgaaaatccatggtttgtcttcaactatatttaccaacggaatatggaaaaaagtttcaatttcatggccattatcaacgaagacaaatggaacagttttaacaatacagacaagctgcttgccatacaggattccaaactggccatttccgacattaaaattaaaaatcccaacaacccggcgcgattaagaaatgcaaaactcatcacctaccactta

SEQ ID NO: 152 - protein, 136 aa, Neisseria gonorrhoeae
LAMVYGIDYCADAECYLKIKNQIKEGIGNIGGIQFAETKELGRVNRIDPLNITYLRVRGMWGIENPWFVFNYIYQRNMEKSFNFMAIINEDKWNSFNNTDKLLAIQDSKLAISDIKIKNPNNPARLRNAKLITYHL

SEQ ID NO: 153 - DNA, 1023 bp, Neisseria gonorrhoeae
atgcaaaactcatcacctaccacttataatcctatgaaaatcattagtttgtttagcggttgcggcggtttggatttgggtttcgaaaaagcgggatttgaaatccccgccgccaacgaatacgataaaaccatttgggcaaccttcaaggcaaaccatccaaagacccatttgatagaaggcgatatacgcaagattaaagaagaagatttccctgaagaaatcgacgggattatcggcggcccaccctgccagtcttggtctgaagcgggagctttgcgcggcatcgacgatgcgcgcggacagttgtttttcgactacatccgtattttgaaaagcaaacagccaaaattctttttagcggaaaacgtcagcggaatgctggcaaaccgccacaacggagccgtacaaaacctgctgaaaatgtttgacggatgcggatacgacgtaaccttgactatggccaacgccaaagactacggtgtagcacaggaacgcaaaagggtcttctacatcggtttccgtaaagacttggaaataaaattttcttttccaaaaggttcgacggtcgaagacaaagacaagattacattgaaagacgttatttgggatttgcaggacacagccgtaccttccgccccgcaaaacaagaccaaccccgacgcagtcaacaacaacgaatattttaccggcagtttttcccctatttttatgagccggaaccgagttaaagcgtgggatgaacagggttttaccgtccaagcttcaggcaggcagtgccaactgcacccgcaagccccaaagatggaaaagcacggggcaaacgactaccgttttgctgccggcaaagaaacactatatcggaggatgacggtacgcgaagttgcaagaatccaaggctttcccgacaacttcaaattcatctatcaaaatgtcaacgacgcatacaaaatgattggcaacgccgtccccgtcaaccttgcctacgaaattgcagcggcaattaaaaaaaccctagaaagg

SEQ ID NO: 154 - protein, 341 aa, Neisseria gonorrhoeae
MQNSSPTTYNPMKIISLFSGCGGLDLGFEKAGFEIPAANEYDKTIWATFKANHPKTHLIEGDIRKIKEEDFPEEIDGIIGGPPCQSWSEAGALRGIDDARGQLFFDYIRILKSKQPKFFLAENVSGMLANRHNGAVQNLLKMFDGCGYDVTLTMANAKDYGVAQERKRVFYIGFRKDLEIKFSFPKGSTVEDKDKITLKDVIWDLQDTAVPSAPQNKTNPDAVNNNEYFTGSFSPIFMSRNRVKAWDEQGFTVQASGRQCQLHPQAPKMEKHGANDYRFAAGKETLYRRMTVREVARIQGFPDNFKFIYQNVNDAYKMIGNAVPVNLAYEIAAAIKKTLER

SEQ ID NO: 155 - DNA, 765 bp, Neisseria gonorrhoeae
ttgaaacgtcaatttaaaaataaagaatcaagggttagcgtgaattataaggaatgctgtagtattttttctgatttcagaatggaacggtataaaaatgccgttaggaaagacaaagcagctgaattgtatttattgaatttatctttatcaagagaactttttcatgttgtttctatatttgagatcgttttaagaaacaaaattgatatttgctttcggcaggagtttaaagacagaaaccggttatatgatagcatacaaccacaaacgaatcctgcattgaaatatcaaggttgctttttaagaaatggtacgaaagaatctgccgaattaatcaaggttgcattatctaaaatacaaaataatagcggaggaaagtttgaccacaaccaattggttgcaggactaggattcggtttttggcggtatctgtttgcgggagggaaagatgctcaatttgatgctgcaggaaaagtattgatgaaagtttttccaaaaaagcccaaatctacaccaagtgtgcaatataaccaaaaatggatttttcgagaactttccaatattaacaatttccgtaatcgtttggcacatcacgaaccgatttgttttagttttaaaggtgcaataaaagataccggctacgctagaaatattcaccaatctatttttgaactgcttaattacatggatgtagatactgcttcagtatttagccattttagcgatcaagtgattgcggtctgcgatgaaatcgacaaactg

SEQ ID NO: 156 - protein, 228 aa, Neisseria gonorrhoeae
MERYKNAVRKDKAAELYLLNLSLSRELFHVVSIFEIVLRNKIDICFRQEFKDRNRLYDSIQPQTNPALKYQGCFLRNGTKESAELIKVALSKIQNNSGGKFDHNQLVAGLGFGFWRYLFAGGKDAQFDAAGKVLMKVFPKKPKSTPSVQYNQKWIFRELSNINNFRNRLAHHEPICFSFKGAIKDTGYARNIHQSIFELLNYMDVDTASVFSHFSDQVIAVCDEIDKL

SEQ ID NO: 157 - DNA, 462 bp, Neisseria gonorrhoeae
atgaaacgctttattctgccggtgcttttatccgcaacaaccgccccggcttctccgattgtcggtacatggcattgcatcggcactgatgaaaacattcacagtgatacaaaagtcaaatatcttcaggacggcagcttccgtggcgatgctatactcaaaatcgatgatgacggcaatatcttggcataccgtgttgtcggtgcaggtaaatggcgttttgcgaacaatgccttaactcaaagccaaatcaagtacggtgaagtttcacgacagcacagccccgaaacgctggcgtggttagaaaagtcggaggatgcacgactcttggaaagcatgatgtacaccggattggtcgcgcagatggacaaacccggaaaagatgatgtgtatcaactggataaatcaggcaaattagtgtccgaagacggaacttcccgtgaggcatgtacgaaagtggag

SEQ ID NO: 158 - protein, 154 aa, Neisseria gonorrhoeae
MKRFILPVLLSATTAPASPIVGTWHCIGTDENIHSDTKVKYLQDGSFRGDAILKIDDDGNILAYRVVGAGKWRFANNALTQSQIKYGEVSRQHSPETLAWLEKSEDARLLESMMYTGLVAQMDKPGKDDVYQLDKSGKLVSEDGTSREACTKVE

SEQ ID NO: 159 - DNA, 927 bp, Neisseria gonorrhoeae
atcatcacgccgagtaaaattgtaaattaatgttgcaggggctttaaatatccgtttcgtgtaacccgcacccaacttcagtccaagaccgccgtctaatattttcaccgtacccaaacttacaccataacgccgtgaagcctgctctttctccacagtattatcaaacataccgctaatacccccgtacaactgccaagccgacatagcgtaatagctgaacgtaccgctcaccgaaatcgttttactgttgtaacgttttgccaaatattcgtcatggtattgtttgcggccatactggaaagattgggtgctgcgccatttttcattcagacggcggctgtaatccaacacaatacccgtatttgccgtataacggttattgcccagccggttttgtttgacaaagggccggaatccccactctagacggctattccgataacggtagcctacttcggcatgaaacgcctgttcgctaaaatcccgggcattccaataatgcacaccggaaccgctgatgcctaagcgggcaaagtgattgcctgccatgttaaacatccgatcaacgcccagttcgtaccttatcccgttggcgcgtttgggcaggctgtcttccgattttatccatttccggccgttgatgacgatgtcccgtgaaagggacgcattgtttacattatctgtttgttcatagttcatattgaacgaaggatgccacgcctgcaccgcttccgcctgacggatatattcccgtgcaagctgccgcatatcgggcggcaacacctcctcggcccggtgcaactgaaccaatgcctcacgatattgtttgtcttcaaacagcatcacgcccaaatcaaaacggggataaacaagatcgggtctttccgacaacaactcacggtatagatcggccgcctcgaacat

SEQ ID NO: 160 - protein, 309 aa, Neisseria gonorrhoeae
MFEAADLYRELLSERPDLVYPRFDLGVMLFEDKQYREALVQLHRAEEVLPPDMRQLAREYIRQAEAVQAWHPSFNMNYEQTDNVNNASLSRDIVINGRKWIKSEDSLPKRANGIRYELGVDRMFNMAGNHFARLGISGSGVHYWNARDFSEQAFHAEVGYRYRNSRLEWGFRPFVKQNRLGNNRYTANTGIVLDYSRRLNEKWRSTQSFQYGRKQYHDEYLAKRYNSKTISVSGTFSYYAMSAWQLYGGISGMFDNTVEKEQASRRYGVSLGTVKILDGGLGLKLGAGYTKRIFKAPATLIYNFTRRDD

SEQ ID NO: 161 - DNA, 594 bp, Neisseria gonorrhoeae
ttgtccgatacggataaacaggcttttttgacttctgtcagctcaaaagaacaggttaaaaaagtcattgaaccaagaaaagttacgaagtgcccacattgccaatctacacatttcgtcaaaaatggcaaagattgtggcaaccaacgttttttgtgtcgtgattgtaaaaagtcttttgttgagcagacaggcactattctctacaacacgcaaaaagacattgaagtttgggaaaaatacattcattgtatgattgaaaaatacccacttcgcaaatgtgctgaaatttgcaaaatcaatcttgctactgcgtttacttggcggcacaaaattttggacgcacttcaaaacatgatgaatgaagttgagttagacggcattgtgcaagctgatgaaacttattcgacgatttcttacaaagggcaccacaaaaattttaatctgccacgtcctgctcacaaacgaggaacgagagcaacgaaacgtggcatttccaaagaacaagtttgtgttccttgtggtatcaatttagacggtaaatctgttgctagaattagcaatttgggtaagccatctctaaaaaatatcaac

SEQ ID NO: 162 - protein, 198 aa, Neisseria gonorrhoeae
LSDTDKQAFLTSVSSKEQVKKVIEPRKVTKCPHCQSTHFVKNGKDCGNQRFLCRDCKKSFVEQTGTILYNTQKDIEVWEKYIHCMIEKYPLRKCAEICKINLATAFTWRHKILDALQNMMNEVELDGIVQADETYSTISYKGHHKNFNLPRPAHKRGTRATKRGISKEQVCVPCGINLDGKSVARISNLGKPSLKNIN

SEQ ID NO: 163 - DNA, 822 bp, Neisseria gonorrhoeae
atgtttgctcttgccgccagtaatatgattttacgcggagacggtaaagccaatttacaccaaagcagttgtttcatgactgattttcaggatttaatcaaaaatcccaaacctgaaacaggcttaaaacgcccaaatgttggctttctcaatccaccttacgcccaatccaaaagcgatgccgaattgcatgaactttattttgtcaaagaaatgttggatatgttggcagaaggtggcacaggcattgccattattccagtcagttgcgtgattgcaccaagcaaagccaaaagcgaaattgtgaaatatcatcgcttaaaagccgtgatgtctatgccgagcgaactgttttacccagttggcacggtaacgtgcattgtcgtatttgaagcccataaaccgcattttcagacagtcgtgattgacccggacacacaagaagaaatcagcacgaaaaaagcctgtcgcaaaacgtggtttggctactggcgtgatgacggttttgaaaaaaccaaacacttgggacgcattgatttatacgaccgctggcagggcattaaagcgcgctggttggaacattatttaaacaacgaagttcacacaggagaatcggtaacagcatttgtaactgataacgatgaatgggttgccgaagcctatttggaaactgattattccaaaattacccgagcagattttgagcaagtcgtgcgtgaatttgctttatttcaactactgggagcggaagtagggccgactgaaaatttggataatgaaagctatgaagacgatgacaataacgacttcggagacgatgaa

SEQ ID NO: 164 - protein, 274 aa, Neisseria gonorrhoeae
MFALAASNMILRGDGKANLHQSSCFMTDFQDLIKNPKPETGLKRPNVGFLNPPYAQSKSDAELHELYFVKEMLDMLAEGGTGIAIIPVSCVIAPSKAKSEIVKYHRLKAVMSMPSELFYPVGTVTCIVVFEAHKPHFQTVVIDPDTQEEISTKKACRKTWFGYWRDDGFEKTKHLGRIDLYDRWQGIKARWLEHYLNNEVHTGESVTAFVTDNDEWVAEAYLETDYSKITRADFEQVVREFALFQLLGAEVGPTENLDNESYEDDDNNDFGDDE

SEQ ID NO: 165 - DNA, 966 bp, Neisseria gonorrhoeae
atggttgaattgcaagagatttttgatgtgagttacggttcaaaattagatttgaataaaatgagcagcttcaatccaacaatcaactttgtaggcaggtcaggcaaaaataatggtgtaacagcatctgtggatttattgaaaaatacaaaaccttatccagcaggattattaactgttgcattaggtggttctgttttatctacttttttacaaaacaaaccattttatacagctcaaaatgttgctgttttaaatcccaaaacagaaatgacagaacaacaaaaactcttttattgtgctgctatttttgccaatgcctaccgtttttctgcttgcggtagggaagctaaccgcacgttacgacaactgtttgtgccatctttggatgagatcccaagctgggttgaaagcgtgaatttaaatccatctgcgggtgtaaccgaaccgaaattaaaagaatcgcttgatttgcctgtggttcgacaatcaaaacgacttgatgaaatttttactattcaaaacggcattgccgcaaccaaattaaaagaatttgaacaacggcaaaaagacacggttgtctatatccgtcctgccagtacgcaagcaagaacgctacgaagttatatcgctcgtgatagcgttgatgaaaaacatatttttccatgccatacgcttttcacttctaccaatggcgaaggtagccatacttatagctatgtttcaacttgtgaatttgtagcaaatagtgatgtcgccgtattaacacccatacagtccgatatgccaatagaagtaaaactgtattacgctaaatgtattacagcaaaccgctatctgttttcttatggacgtaaacccaaaggcgaaaaattaaaaagcattatgttaccgtattttgaccaacaagaagattttgattatatctgccgtttcattcacaccttgctatttagtaacaatttg

SEQ ID NO: 166 - protein, 322 aa, Neisseria gonorrhoeae
MVELQEIFDVSYGSKLDLNKMSSFNPTINFVGRSGKNNGVTASVDLLKNTKPYPAGLLTVALGGSVLSTFLQNKPFYTAQNVAVLNPKTEMTEQQKLFYCAAIFANAYRFSACGREANRTLRQLFVPSLDEIPSWVESVNLNPSAGVTEPKLKESLDLPVVRQSKRLDEIFTIQNGIAATKLKEFEQRQKDTVVYIRPASTQARTLRSYIARDSVDEKHIFPCHTLFTSTNGEGSHTYSYVSTCEFVANSDVAVLTPIQSDMPIEVKLYYAKCITANRYLFSYGRKPKGEKLKSIMLPYFDQQEDFDYICRFIHTLLFSNNL

SEQ ID NO: 167 - DNA, 498 bp, Neisseria gonorrhoeae
atgaagaactgtactccaactaacggcacatggttcaaaatgggtgcaacactcactgttgccgtggccgcctgcacagtatcaacacctacatccgccatccccgttacccacataaaatgcctgcggataaacgggcagattaaatgcgtcaaaccgataagccctaacactacccctgccgcagagcatattgagcatgtgcggaaaaatccgcgccgcaaagcagcgatggacagggcggcagcaagaattgccgataaaatagccctcaaagcaggcggggaaacatttgtcagcttaaggatgaaaaaggggtttacccagtccgaattggcaaccgccgcaggattgcctcaaccctatctgtcccgcatcgaaaacagcaaacaatccctgcaagataagactgtacaaaaattggcaaacgcattaggcgtttccccgcttgaagttcgcgcagcgttcgaacggcggtacgaatatatggagcaggca

SEQ ID NO: 168 - protein, 166 aa, Neisseria gonorrhoeae
MKNCTPTNGTWFKMGATLTVAVAACTVSTPTSAIPVTHIKCLRINGQIKCVKPISPNTTPAAEHIEHVRKNPRRKAAMDRAAARIADKIALKAGGETFVSLRMKKGFTQSELATAAGLPQPYLSRIENSKQSLQDKTVQKLANALGVSPLEVRAAFERRYEYMEQA

SEQ ID NO: 169 - DNA, 492 bp, Neisseria gonorrhoeae
atgacggtccgaaacacgcaaaccgaaaccgtccggacggaagccgcgccgcaacaaggcggcaataccaacccgggctattacaaaaaccgcgccttcgagtgcgtcgggtttgcgcaatacctcaacttcaacctcggcaacgccttcaaatacatctggcggcacaaggaaaaaggcgggcgcgaagacttggaaaaagccctgcggtacttggaacgccaacgcgccggcgcgccgaagttcaagaaactcaaacaccgccgctatgaaaaaatgtacgccggtctgaaagattgcgggttcgacggcggcacggaggccgcgctgcttgccgtcatctccgccgcttattacatccgcgacggcgaagacaattttgcgtgggcggccgcctgtgtcgaagatttgttggaaaaaatgccgcctgaagcggggcgggccccgcaccctgaaagcccgatgccgcctgaaacggcgggcggaggcatt

SEQ ID NO: 170 - protein, 164 aa, Neisseria gonorrhoeae
MTVRNTQTETVRTEAAPQQGGNTNPGYYKNRAFECVGFAQYLNFNLGNAFKYIWRHKEKGGREDLEKALRYLERQRAGAPKFKKLKHRRYEKMYAGLKDCGFDGGTEAALLAVISAAYYIRDGEDNFAWAAACVEDLLEKMPPEAGRAPHPESPMPPETAGGGI

SEQ ID NO: 171 - DNA, 1497 bp, Neisseria gonorrhoeae
atgaacgtgaaccaactcacacaagaaacgattgaactgatgaagtcggcacaagcgggcggcgggccgcctgacaaaggttttacccagccggctagttttaccgccggcctgcaaacctatgacctttccgcgccgtctcaaaaactctacccggtattgaccccgttgcgcaaccgtatcccgcgcgtgggcggcggccgcaccatcggctcgaactggaaagccgtcacgaatatcaacgtcggcaaccaacgcgccggtatcggcgaaggcaggcgcggcggcgtcatcaatcacgaaacggtggaacgcaacgcgcaattccgcgccatcggcttggaaaaccaagtaacctttgaagcggattacgccgcgcgcggtttcgaggacgtgaaagcgttggcggtcgcccaaacccttcaggctactatggttgccgaagaaatgattttgctgggcggcaacaccagcctgaaggcaggcgttacacctacaccgaccgccgtcgtttccgccgacgcggcggggaaaatcagcgtcagcaccttgtctgtaatctgtgtggctttgggcttgcaggcgtattgggacgtggcaggcgcgaacaacggtgcaaccggtcaaagcccgaacattaaaactgcccaagtccctgccaaaatcacacgccgaaacgcggatggtacaaccgatacgttcggcggcggttccgcccgaaaatctgcggcggcttccgtttccggtattgaggcaggcaaaaaagtaaccgccgtgattccggctgttcgcggcgcggttgcctatgcttggtactggggtgcggccggttctgaaaaactgggcgcggttaccactgccgccaaagtggaaatttcggctgatgccgaaggtacccagaccgccgcttccctgccgtccgaagacaattccacttctattttggaatttgacggcctgttgacccaaatcgccctgcctgattcgggcgcgttctggtcggacaacaaaggcggcggcctgacttccgacaacgcgggcggcgtgtatgaatttgaagaggcgttcgcgcatttctttacccgataccgcctgtcccccgataccgtctacgtcaacgcccgcgatttggcggcgctgaccaagctgattatcggaaacagcggcgcgccgttgattaagttgaacgttgacgtgaacaatacggcgaacatccgcgccggtgtcgttgtcggttcgtatatgaacaagatcacgggcgacgacctgaacatcgtggtacacccgaacctgcctgccggtacttacctgttctactcaagccgcctgcccgcctacgttcagggcgtcggcaatctgctgcaagtgcgtacgcgccaagagtattaccaaatcgaatggccgctgcgcacccgtatgtacgaatacggcgtctatgcggacgaggtgctgcaaggtatgttcatgcctgccttcggtatgattaccaacgtgggt

SEQ ID NO: 172 - protein, 499 aa, Neisseria gonorrhoeae
MNVNQLTQETIELMKSAQAGGGPPDKGFTQPASFTAGLQTYDLSAPSQKLYPVLTPLRNRIPRVGGGRTIGSNWKAVTNINVGNQRAGIGEGRRGGVINHETVERNAQFRAIGLENQVTFEADYAARGFEDVKALAVAQTLQATMVAEEMILLGGNTSLKAGVTPTPTAVVSADAAGKISVSTLSVICVALGLQAYWDVAGANNGATGQSPNIKTAQVPAKITRRNADGTTDTFGGGSARKSAAASVSGIEAGKKVTAVIPAVRGAVAYAWYWGAAGSEKLGAVTTAAKVEISADAEGTQTAASLPSEDNSTSILEFDGLLTQIALPDSGAFWSDNKGGGLTSDNAGGVYEFEEAFAHFFTRYRLSPDTVYVNARDLAALTKLIIGNSGAPLIKLNVDVNNTANIRAGVVVGSYMNKITGDDLNIVVHPNLPAGTYLFYSSRLPAYVQGVGNLLQVRTRQEYYQIEWPLRTRMYEYGVYADEVLQGMFMPAFGMITNVG

SEQ ID NO: 173 - DNA, 528 bp, Neisseria gonorrhoeae
atggccgccccggtatcgcttgaggagttcaagcagcgtatcggcgttgaacatgaccggcgggacgatttcttcctcagcgtcattgacggcgtgtcggcggcggcggaagcctatatcgggcgcagcctcctggccgccgattatgtcgggcggtacgacggcaacggcaaagaccgcatcgtgttggacaattatcccgtcctgtcggtgtcgtccgtcaaaatcaacggcgcggatgccggcggctgggagtttgacaactggctgctgatgcgccccgaaggtttcgcgcgggggctgaaaaatgtcgaggtatcgtaccgcgccggttatgagcgcatgcccgccgacatacgcgaagcggtgatgattatcgcggtgcagcgcgtgaacgaaatcgagggcaagggcgtacggagcaagacgcttgcaggcgaaaccgtcgctttttctacgttcggtaattccggcggtatgccgccgtcggcgtttgcgatactcaatgagtacaaacgaaagggcgtg

SEQ ID NO: 174 - protein, 176 aa, Neisseria gonorrhoeae
MAAPVSLEEFKQRIGVEHDRRDDFFLSVIDGVSAAAEAYIGRSLLAADYVGRYDGNGKDRIVLDNYPVLSVSSVKINGADAGGWEFDNWLLMRPEGFARGLKNVEVSYRAGYERMPADIREAVMIIAVQRVNEIEGKGVRSKTLAGETVAFSTFGNSGGMPPSAFAILNEYKRKGV

SEQ ID NO: 175 - DNA, 771 bp, Neisseria gonorrhoeae
atgcagttgacgtttggcagcggcgaagtgttcgcccaaatgattacggatgcttacggcaaccgtgtacagaacgcaacgcccgtgcggattatgggcttgcaggaaatgtccgtcgatttgtcggcggaattgaaagagttctacggtcaaaaccgttatcctttggctgtggcgcaaggcaaggtcaaggtgtcgggcaaaatgaaaggcgcgttgattaacggcctgaccctcaataccctgtttttcggtacggaatatgcaaccggcacgatgaaggcgctttgggcggaaactacgggcaaagtcctcgatggcgacaattattcttaccttcaggcagccgcgcccggcggcggcaagttcgctgaggacgcgggcgtgatgggccaggacggcacggcttatatcaaagtagcatcctccccgaaacaaggccaatatacggtttcggaatcgggcgtgtacgcctttaacagctcggataaaggcaaaaccgtttatccgagctttacctatacgcaaacgatgcccccggcgaagaaaatcgagctgaccaatatggcgacgggcaacacgccgacgtttaagatgaggtacctgacgcagttcaaaggcaaaaaagccctgttggaactggaaagcgtaaccagcggcaaattgggcttgttctcgactaaaaacgacgacttctccgtccccgaaatcgactttaccgcctcaaccgacgaggcgggctttaaaatcggtacgctgtggattcaggag

SEQ ID NO: 176 - protein, 257 aa, Neisseria gonorrhoeae
MQLTFGSGEVFAQMITDAYGNRVQNATPVRIMGLQEMSVDLSAELKEFYGQNRYPLAVAQGKVKVSGKMKGALINGLTLNTLFFGTEYATGTMKALWAETTGKVLDGDNYSYLQAAAPGGGKFAEDAGVMGQDGTAYIKVASSPKQGQYTVSESGVYAFNSSDKGKTVYPSFTYTQTMPPAKKIELTNMATGNTPTFKMRYLTQFKGKKALLELESVTSGKLGLFSTKNDDFSVPEIDFTASTDEAGFKIGTLWIQE

SEQ ID NO: 177 - DNA, 4143 bp, Neisseria gonorrhoeae
atgggtggtaaatcgtcaaccgttacatctgccgaagagcggattttatcgttacaggttcagcggtcatcacaggggctgaccctgcccgtcatctacggcaggacgcgcgtggcgggcaatttgatttggtacggcgatttcgtcaccatcgagcataaggccgtgacgcgtcagggcggcaagggcggcggcggtgtgaaacaggtcggtatttcctatacctacgaagccgccgtcatgcttgctttgtgcgagggcgagattcagggcgtggggcgggtttggcgcgacaaggagaaattcgattcgccggcacagttgcgcctgacgcttatgcgcggcggcgacgagcagccgttgtggacgcacctgcaacaggcgaagcaccaaggccaagccttgaattattcgggcacggcttatttgtgcagcccgaactacgaactgacgaaatcggcgcaaatatatcagcacaatttcgaggtcatcgggaaatcgggctattccggcaacatccccgatgcaaacccgcgcgaaatcgtattggatttgctgacgaaccaacgctacggctgcggtttcccgtcccaaaacatcggcgataccgaccggtacagcaattattgccgcgccgtcgggattttcctaagccctgcctacacggaacagggggaggcgcaacggaatatttccgaactgctggagcagaccaacagcgcggcggtattttcgcaaggccgcctgaaaatcatcccctacggggacggcagccattcggggaacggcgcggtgtacgttgccgacaataaggccgcctacgacctgaccgatgacgatttcatcgtttcgggcgcgcaagaccctgtaaaggccgggcgcaaaaccaatgccgatgcgtttaatcagattcaggtcgagtaccttgacagggacaacgactacaacgtcgccatcgccgaagcgaaagaccaggcgaatatcgagcagtacggattgcgcccgaaagacgcggtcaggatgcacggcatttgcgatgcgaaggtggcgcaaaaagtggcgcaacaactgctgcaacgcgccctgtacgtgcgcaacgaatatgagtttaagctgggttggaaatactgcctgcttgagccgatggacatcgtaaccctgaccgacgcggggctcggcctgaataaaacgcccgtccgaatcacggaaatcgaagaagacggagaaggggttttatccgtcaaggccgaagactgcccggccggtgtttataccgtgtcggaatatccgacgcagccgtcttcgggttattcggccgactacaacgtttcgccgggcaacgcccatgtgccggtaattttcgaagcgccgttgcaactgacgggcggcgaaccgcaaatctggctggcaaccgccgggggcggtatgtggggcggcgccgaagtgtgggtatcggcggacggcgacagctacacccgcgtcggcgcggtcaaccgcaaggcgcgtttcggcgcgctgaccgccgatttgcccgacggcgcggttttcgaccgcacaaatacattgggcgtggaaatttcggcggggcagctgacgggcggcacggagcaggacagccgcgatttgctgacattgtgctacgtcgacggcgaatttctggcatacgccgacgccgaactgaagggcgtgggacgctacacattgggcaacctgacgcgcggcgcgtacggctccgccgtcaacgcacacgcggcgggcagccggtttgcgcgcatcgacgaagcattgttcaaatacgccgttccgcgcaactggattggccgcacggtttgggtcaaactggtttcgtacaacgttttcggcggcggcattcaggatttggcggaagtgccggcgtattcctacaccatcgaaggcgcgccgctcggtcaaatccaaaacctgcgcctgacatcatcgtgggcatacggcaaagaagccgtcatcgcttgggataaattggacggcgcggatacctacgacgtggaaatctacgcaggcggcagccgacgccgtctgcgtgcggttgacggcatcgttgacaacagctacacctacactcaggcggatatgaaggcggacggcggccaggtacgcggtattgtcttcaaggttcgcgggcgtgccgttaccggtaaaacgggcaattgggcgcaaatcgcggcgcaaaatccgcaattgcaggcattgcagggcatctctatcgacagcggcctgcgccaggcgttttttacctgccaaaaacctgacgaagaagactttgcagggattatcgtctgggtttgcgaaaacgcagcctgcccggccgcggacgcaaacaaagcctatgacggcgcggaaacgtttataaccatcgccaaatgcggcggcaaaccgctggagaaaggaaagacctattacttgagggcggcgggttacgacagtttcggcaaagataacctgaaaatcagcggcagcatatcgtttaccgtttacgacgtatcggcaaccgacctgtcggaaagcagtctgaacaaggctttgcgcgacaaaatcaacctgattgacggcaacggcgcgggcagcgtcaacgagcgcgtcgaggcagtccgatcgacggcggacggcaatgcggcggcggttcagacacacgcccgaagcatcaacggcttggaggcgcaatacacggtcaaggttgatgcaaacggcaaagtggcgggcttcggcttggcgactacgccgaaaaacggcacgcccgaaagcaagtttatcgtgaatgccgaccgcttcggcatcggtgcggccgggaaggcggatgtgttcccgttcgtggtggacacgcagaaaaaccgcgtgggcatcaacggcgaattggtggtcaacggcaaggcggttgtcgataagttgaacgccggggatatccacggcggcaaaatcgcggcggacacgctggacgcaaaccgcctgaaagccggaagcgttacggcgcgggaaatcggggctgccgccgttaccgccgataaaatcggggcaaacgcggtgactgccgataagattcaggttgccgatttgagcgcggtatcttccaatctcggaagcatcacgggcggcagcctgaatatcggcgggggtaattttacggtgtcttcagacggcatcctgacggccgacaatgcggtaatacgcggacggattgaggccgattcgggttatttcaacggcacggtcagggcttcgtccgtcgagggcgacgtgttgagggcgcacaggctgcgttggacggagggtaacgtttgggtgttggatttggataaagacccgctgccgagggttttgattccgaatttttatgtggtttcggaaacgttcggcaacaacagggtgcaggcaaagctgctgttgaacgggggtgtgcttgcgccgagggaagtcagggaaaccgagaactataccaattatatttggcgcggcagaactttcgggaggtacgaagacctgcccccccgggcaagggggggcggggattataccgaacaatccggctcaaggtacagaacccgcctcgagtaccagattcaagtcatccccgcgggcaaacccgtcagcctgaagttgtcgctcgcttcccacgaatcggtgttttcgccgttcgtgtcggtttcgtatttggcgcaatccgactacgaatacaagcagctgctcgggaggatggtttggcgcacctttgcggaaagtttccggtacgacagtaagaagcagatttatttgggcggcgaccggcgtgtacacgattaccaaaatcagatgtataaacattggaatgcttacggcgggctgctgcagttgccggacgatatctacggcatatcgttcgagtaccggccttttaccaatgccgactggagtacgatgcttgcgtttgaccggtcggataagtttgtagtggttaagaaataccggggtcatgcgccccaacagtattctctgtttcaggaggagtttaatactgccgttccgaaatccaacctgctgttttttgtggaacactggtggcagtatatcgagctgcgcaatatcagggtgctgattccggaatcgcgcgaaaacgaggtttggccctccgtc

SEQ ID NO: 178 - protein, 1381 aa, Neisseria gonorrhoeae
MGGKSSTVTSAEERILSLQVQRSSQGLTLPVIYGRTRVAGNLIWYGDFVTIEHKAVTRQGGKGGGGVKQVGISYTYEAAVMLALCEGEIQGVGRVWRDKEKFDSPAQLRLTLMRGGDEQPLWTHLQQAKHQGQALNYSGTAYLCSPNYELTKSAQIYQHNFEVIGKSGYSGNIPDANPREIVLDLLTNQRYGCGFPSQNIGDTDRYSNYCRAVGIFLSPAYTEQGEAQRNISELLEQTNSAAVFSQGRLKIIPYGDGSHSGNGAVYVADNKAAYDLTDDDFIVSGAQDPVKAGRKTNADAFNQIQVEYLDRDNDYNVAIAEAKDQANIEQYGLRPKDAVRMHGICDAKVAQKVAQQLLQRALYVRNEYEFKLGWKYCLLEPMDIVTLTDAGLGLNKTPVRITEIEEDGEGVLSVKAEDCPAGVYTVSEYPTQPSSGYSADYNVSPGNAHVPVIFEAPLQLTGGEPQIWLATAGGGMWGGAEVWVSADGDSYTRVGAVNRKARFGALTADLPDGAVFDRTNTLGVEISAGQLTGGTEQDSRDLLTLCYVDGEFLAYADAELKGVGRYTLGNLTRGAYGSAVNAHAAGSRFARIDEALFKYAVPRNWIGRTVWVKLVSYNVFGGGIQDLAEVPAYSYTIEGAPLGQIQNLRLTSSWAYGKEAVIAWDKLDGADTYDVEIYAGGSRRRLRAVDGIVDNSYTYTQADMKADGGQVRGIVFKVRGRAVTGKTGNWAQIAAQNPQLQALQGISIDSGLRQAFFTCQKPDEEDFAGIIVWVCENAACPAADANKAYDGAETFITIAKCGGKPLEKGKTYYLRAAGYDSFGKDNLKISGSISFTVYDVSATDLSESSLNKALRDKINLIDGNGAGSVNERVEAVRSTADGNAAAVQTHARSINGLEAQYTVKVDANGKVAGFGLATTPKNGTPESKFIVNADRFGIGAAGKADVFPFVVDTQKNRVGINGELVVNGKAVVDKLNAGDIHGGKIAADTLDANRLKAGSVTAREIGAAAVTADKIGANAVTADKIQVADLSAVSSNLGSITGGSLNIGGGNFTVSSDGILTADNAVIRGRIEADSGYFNGTVRASSVEGDVLRAHRLRWTEGNVWVLDLDKDPLPRVLIPNFYVVSETFGNNRVQAKLLLNGGVLAPREVRETENYTNYIWRGRTFGRYEDLPPRARGGGDYTEQSGSRYRTRLEYQIQVIPAGKPVSLKLSLASHESVFSPFVSVSYLAQSDYEYKQLLGRMVWRTFAESFRYDSKKQIYLGGDRRVHDYQNQMYKHWNAYGGLLQLPDDIYGISFEYRPFTNADWSTMLAFDRSDKFVVVKKYRGHAPQQYSLFQEEFNTAVPKSNLLFFVEHWWQYIELRNIRVLIPESRENEVWPSV

SEQ ID NO: 179 - DNA, 3045 bp, Neisseria gonorrhoeae
atgagcgatttggaagccaaagtcaggataacggtagaaaaccatacgaagcagggttttgattcggccgccgccgatgctgataaggcggcggaaaagatgcgcagcagcggcgataatgccgcaaagggctttaaagctgcaatcgacagtatgcacgagaccatgcgcaatttgcacgccgatgtgaaagcgggatttgaagcggcgggcaatcaggcgcaacaggcgtctgaaaaggttagggccgaagtgggtaaaatcggctcaggcttatcggggctgaccaaactgctggcaggattagcaaccgcagacttcgccaaatcggtgcttgataccgccgatgcgatgcagtcgataaacagccaagtccgacaagtcacgtcgtctgaaacggagtatctggccgtgcagcagcagcttctcgatacggcaaaccgtacccgtgcatcgcttgaatcaacggcaaacctgtacgtttccacaagccgcgcgttgaaagactacggctacacgcagcaggaaattttaaaattcaccgaggcggccaacaacgcgatgaccatcggcggcgttggcgcgcaacaacaggccgccgcgctgatgcagttatcgcaggctttgggcagcggcgtattgcagggcgatgaatttaaatccatttccgaagccgcacctattttgctggataccattgcggaatatatgggcaaatcccgcgacgaaatcaaaaagctgggcagcgaagggaaattgacggcggatgtgattttcaaagccatttccggcgcgtcggagaagttcggggagcaggcggccaaaatgcccgtgacgatggggcaggctttgacggtgttctcgaacaactggcaaagcatggtttcaaaactgctgaacgacagcggcacaatgtcggggattgccgccgttattaaactgattgcggataaccttaatttggttgttccgatcgtcgcaggttttgccgttgccgttgccgccgccgttgcaccgacactggctttgaatcttgcactgctggcaaacccgttcgggattattgccgtcgcaatcggcacggttgtcgggctgattgcgaaattcggcgatgaaatcgatgttttcggcggcggctggtcgaatctttccgatgtgattcgggcggtttggcaaatcatcacggaaaccgtcggggaagcggtgggaaccgtcaaatcgtggtttgacgggctgacaggccggctgaacgagggcgcgggcggctggccgtcgttgttcgggcgcgtgatgagcgtcatctcaagcgcaatcggcgcgtatgtgaacgtttatatcaacatattcgcaaccggctggatgctgattaaagaagccgcaaacgatatgccgcaattcttcgccaatctcggcaaggccataggcaacgtgtttatttccgcgatcgaacggatgataaacaaagcggtaggcatgattaacagcatgattgactttgccaacaaagccgcgtcgatggccgggatatcgggcattggaaagctgaacaaggttcggatggggcggatggacgacggcgggcttggcgagcgtattcatgacagcttgacgaaagaccgcgccggcgcaatggcaaatgccgtccgcgaacgggccgccgatattcacgaagccgatgccctcaagggacgcggcggcggaggacacgccaaaaccgcccggaaaaagccgggcgcaaatcagggcggcggcaaagggggcaaatcccgttcgggcggtccgggcgcggccaaagacccgatgcaggcttgggaaggggaaatcaaagcccgaaaactcgcacaccgcgaaatgcagcgcgaaacgctcgcacaccaagaatgggatttggcgcgtgaggcggaatattggcgggcgaagctggcaacggtggacgccaacggcaaaacgggcgtgaaaatccgcgaaaaaatcctgatgcttgaagaccaattatcgaagcagtcaaccgaagccaaaatgaatcaggcggccgaatgggagaaattggacaagcacaagctggagatggagaaagacgcggcagaccaagccctggcagacggacgtatttcgcaactcgaacgcctggacttggaaatcgagtttgaaaaccgacgttaccggattgcctatgacgcattgcaggaacggatcgcacttgccgaacaagacccggcatacagtcaggcggcaatcggcaagctcaaggcccaaatgggcgaattggggcgggggcacgaacggacgcaggcgaagaacgagggcaaacgcgaaaaccaacgccgcaaagacgcgcccaacgtcatggaaatgctgcaagacggcggcaggaacgtttggcaggaagcacagcagcagatggggcaggcgttcaccgccatgctggcgagggcgcagaatttcaggcaggcgatgaacggctttttcaagagtatggggcaaacctttattcaagaaatggttacgaaacctttgacgggcttgatgcggcgcatggttcaggaatcggccatttacaagatgattttcggaactaaggaaacgctggagacagcggcggcagccaagacggcggcaactaaggcaaccgagacaacggcggttgtcagtagtaatgctgttcaagcggcttcaggcgcggcggcttcccaggcgcatatcccatatgtcggcccgattcttgccgttgcggcaatggcggcaatgatgtcggcagtgatggggttgatgggcggcggcggcggttctcaaacgaccacaaccacgacgcgcattccctcggcggcaggcggctgggacatcccggcaggcatcaacccgctgacccaactgcacgaaaacgagatggtcttacccgcagaacacgcccaaaccatccgtgaaatggcggatcagcagggaggcggcagcaccgtcatcatcaattcgacaggaggcgatttcatccataaaaatgacttggcgaagctcttgaagcagatgaaacgggactttaaatttgtc

SEQ ID NO: 180 - protein, 1015 aa, Neisseria gonorrhoeae
MSDLEAKVRITVENHTKQGFDSAAADADKAAEKMRSSGDNAAKGFKAAIDSMHETMRNLHADVKAGFEAAGNQAQQASEKVRAEVGKIGSGLSGLTKLLAGLATADFAKSVLDTADAMQSINSQVRQVTSSETEYLAVQQQLLDTANRTRASLESTANLYVSTSRALKDYGYTQQEILKFTEAANNAMTIGGVGAQQQAAALMQLSQALGSGVLQGDEFKSISEAAPILLDTIAEYMGKSRDEIKKLGSEGKLTADVIFKAISGASEKFGEQAAKMPVTMGQALTVFSNNWQSMVSKLLNDSGTMSGIAAVIKLIADNLNLVVPIVAGFAVAVAAAVAPTLALNLALLANPFGIIAVAIGTVVGLIAKFGDEIDVFGGGWSNLSDVIRAVWQIITETVGEAVGTVKSWFDGLTGRLNEGAGGWPSLFGRVMSVISSAIGAYVNVYINIFATGWMLIKEAANDMPQFFANLGKAIGNVFISAIERMINKAVGMINSMIDFANKAASMAGISGIGKLNKVRMGRMDDGGLGERIHDSLTKDRAGAMANAVRERAADIHEADALKGRGGGGHAKTARKKPGANQGGGKGGKSRSGGPGAAKDPMQAWEGEIKARKLAHREMQRETLAHQEWDLAREAEYWRAKLATVDANGKTGVKIREKILMLEDQLSKQSTEAKMNQAAEWEKLDKHKLEMEKDAADQALADGRISQLERLDLEIEFENRRYRIAYDALQERIALAEQDPAYSQAAIGKLKAQMGELGRGHERTQAKNEGKRENQRRKDAPNVMEMLQDGGRNVWQEAQQQMGQAFTAMLARAQNFRQAMNGFFKSMGQTFIQEMVTKPLTGLMRRMVQESAIYKMIFGTKETLETAAAAKTAATKATETTAVVSSNAVQAASGAAASQAHIPYVGPILAVAAMAAMMSAVMGLMGGGGGSQTTTTTTRIPSAAGGWDIPAGINPLTQLHENEMVLPAEHAQTIREMADQQGGGSTVIINSTGGDFIHKNDLAKLLKQMKRDFKFV

SEQ ID NO: 181 - DNA, 987 bp, Neisseria gonorrhoeae
atggcaaccatcactcaacgtaacggcaaatggcgcgtacaaatccgtatgaaaggcgtttcccgttccgccacatttgagcgggcatcagacgcgaaggcgtgggcggcgcgaatagagtcgcaaattatggacggcatccaaggcaatgccccgcgaaatactatctttgccgaccttatccggcggtatttatccgaggttacaccatcaaagcggggcgcacgggaagaatcataccgcattggacgcgcactaaaaacacctttggcaaaggtgcggcttgccgacctgcgccctcaagacttcgccgattggcgagatcaacggttgcaggaggtatcccccaccagcgtcggacgcgaattaaccactttatccgccgtctgcgaacacgccatgaaagagtggggacttcttcgcgaaaaccctgtacgcaaaatcagcaagccgaaaaaaagccgggcaaggacaagacggccaaccgagcaggaaattgccgatatttgcgccgccctcctataccggcctaatgagaaaccgaaaatggcggtgcaacgggttgccgttgccgtcctatttgccatcgaaaccgccatgcgggcaggcgaaatctgcggcctaaaatgggcagatgtgaatatgcggcgtcgtattgcccacctcccaataactaaaaacggcgacagccgtgacgtgccattatccttgcgagccgccgaactaatagagcaactgcgcggaattgatgacacatgggtgtttagcctggatgccaaaagccttgatgtattattcaggcgagcgcgggataattgcggcatacaaggcctgcattttcacgacacccgccgcgaagccctcacgcgcctatcaaaaaaagtgcctgtggaggtcttggcaaaaatcagcgggcatcgggatttaaggattttactcaatgtttactaccgccccgacatggcggatattgcaaaaatgttggat

SEQ ID NO: 182 - protein, 329 aa, Neisseria gonorrhoeae
MATITQRNGKWRVQIRMKGVSRSATFERASDAKAWAARIESQIMDGIQGNAPRNTIFADLIRRYLSEVTPSKRGAREESYRIGRALKTPLAKVRLADLRPQDFADWRDQRLQEVSPTSVGRELTTLSAVCEHAMKEWGLLRENPVRKISKPKKSRARTRRPTEQEIADICAALLYRPNEKPKMAVQRVAVAVLFAIETAMRAGEICGLKWADVNMRRRIAHLPITKNGDSRDVPLSLRAAELIEQLRGIDDTWVFSLDAKSLDVLFRRARDNCGIQGLHFHDTRREALTRLSKKVPVEVLAKISGHRDLRILLNVYYRPDMADIAKMLD

SEQ ID NO: 183 - DNA, 345 bp, Neisseria gonorrhoeae
atgacatatttaaaagtaatagcaattagtatagttttatacattttattattgcaaattaatcttaaaatgttagaaaaaaggattgatttcttagtagaaaatatagataaatattaccagcaatatggatcttacccaaataattttgattttatatcaactaaaactgattttaccactgaatcatattgtgatttttgggataaaaatattgcaggatatggtaattgttacttcgtaaagaatgataaagactatactattttagtcatgggtttctcatcgaaaatactattttcatctcacaataaaataaaagaattcaattcaaataaatatgat

SEQ ID NO: 184 - protein, 115 aa, Neisseria gonorrhoeae
MTYLKVIAISIVLYILLLQINLKMLEKRIDFLVENIDKYYQQYGSYPNNFDFISTKTDFTTESYCDFWDKNIAGYGNCYFVKNDKDYTILVMGFSSKILFSSHNKIKEFNSNKYD

SEQ ID NO: 185 - DNA, 3027 bp, Neisseria gonorrhoeae
ttgatgacccattacgttacgtttatgtcccaaacccacaacgaaaattcccgcgtcaaaatccccgccgttttgcacctgatgcgcttgggctatgattatctttcgctaaaaaatgcaaattgggacagacaaaccaatatctttcccgaaatctttgtagacagcctctgccgcatcaatcccgatttgccgccggatgatgcacgccgcctgcttgccgacatacgcttagagctggataacgaagatttggggcaaaaattttacgaacgcctcaccaatcaatccggcggtaagaagctgatcgatttccaaaattttgacaacaacagtttccacgttgtaactgagttgccttgtatcaacggcgacgaagcattccgccccgacattgccctgttggtaaacggcatgcctttggtctttatcgaagtcaaaaagcccaacaataaaggcggcatcggcgaagagcgggagcgcatgggcaaacgtgcgaaaaatcccaaattccgccgttttatcaacatcacccaattcatgattttttccaacaacatggaatacgacgacggcgcaaccgagccggcacaaggcgcgttttacgcctcgtctgcttgcggcaagcccgtattcaactacttccgcgaagagcataaattaaaccttaccgaattattggacacgctttcagacgaccttgaaaacaacgttctacaagacaacaacctgcccgttatcaaacacagccccgaatttatcagcaataaatcgcccgatacgccgaccaaccgcatcctgacttcgctgctttgccgcgaacgtctttcttttcttctgcaacacgggctgacttacgtcaaagcaagtcaaggcttggtgcaaaaacacatcatgcggtatccgcagctatttgccacccttgccattgaaaaacatttggcaaacggcggcaaaaaaggcgtgatttggcacacccaaggctctggcaaaaccgcgcttgcctattacaacacccgctacctgacccactattatgccaaacagggcatcgtgccgaaattctatttcatcgtggacaggcttgatttattgaaacaggcgcagcgcgaatttactgcccgcgatttagtcgtccataccatcgacagccgcgaagcctttgctgccgacatcaaatccgcccaaactttgcacaaccacgcaggcaaagcggaaatcactgttgttaatatccaaaaattccaagacgaccccgatgtcgtcgcccgtaacgactacgacctcgccattcagcgcgtctattttctcgacgaagtacaccgcagctacaaccccaaaggctcatttcttgccaaccttaatcagtccgacgtaaacgccgtcaaaatcgggctgaccggcacgccgcttatcggcgtaaccgcaggcaacgtcaacacccgcgaactcttcggcgactacatccacaaatactattacaacgcctccattgccgacggctacaccctgcgcctgatacgcgaagaaatcggcagccgatacaaggcgcaattacaagaagcactggcgcaacttgaaatcgaaaaaggcagctttgaccgcaaagaaatctacgcccatccgcacttcgtccacccgatgcttgactacatcttggacgacttcgccaaattcagaaaaaccaaccaagacgagagcctcggtgccatggtcgtttgcgacagcgcagaacaggcacgccagctttttgagcattttcagacggcctcagaccacaatttcaccgccgcgttgatattgcacgacgtcggcactaaggaagaacgcgaccaatgggttaaagatttcaaagcgggcaaaatcgacatcttgtttgtgtacaacatgcttttgaccggctttgacgcgccgcgcctgaaaaagctctatttgggcagactgataaaagcccataaccttttacaaaccctgacccgcgtcaaccgcacctacaaatcttaccgctacggctatgtcgtcgattttgccgatatcgaacgcgaatttgacaaaaccaaccgcgcctattgggacgaactttccaacgaattgggcgacgaaatcggcagttacagccagctattcaaaaccgccgaagaaatcgaacaggaaattgcagacattaaaaacgccctgtttgatttcgataccgaaaacgccgaagaattttgcagccaaattagccaaatagaagacaaaaaacagcttctagccttaaaaaaagccctgcaaaccgccaaagagttgtacaacatcctgcgcctgcaaggcagccacgaatttcttgcgcatctggattttgacaagctcaatcttttgtaccgcgaaaccgccgcccgcttggataccttaaaccttgccgaaaaattacagcaaggcgacaccgcccatttgctcaatgaagcgctggaagacgtttactttcaattcgtcaaaatcggcgaggcggaactcaaacttgccgacgatttgaaagacatcatgcgcaaagtccgcgaagggctggcgggcaacttcgaccaagacgaccccgaatacatcagcctgcgcgaagagctggaacgcatcttcaagaaaaagaacctcgccgaagtcgggcaagaagaaatgcaggcaaacatcgccacactccaaaccgtctataccaaaatcaaagagccgaaccgacaaaacgacctcttgcggcacaaatacggcggcgacgccaaatacgcacgtatccacaagcggttgatggaaaacgccgccctctacggagacaaactcaaagtctttaacgcgctaagcggtgtaaaaaccgatgccgaccaaaaagtgctggatatggagcagattttggacaaccaaaattactttgaaaaacaaatgcaaggcatcgtattaaaacgctttagaacggaacagcaatttcctgttcagcctgcagacatccaagccatcaaccgcctgttggtgcgggaatatttaaaagaaagcgggcggatt

SEQ ID NO: 186 - protein, 1009 aa, Neisseria gonorrhoeae
LMTHYVTFMSQTHNENSRVKIPAVLHLMRLGYDYLSLKNANWDRQTNIFPEIFVDSLCRINPDLPPDDARRLLADIRLELDNEDLGQKFYERLTNQSGGKKLIDFQNFDNNSFHVVTELPCINGDEAFRPDIALLVNGMPLVFIEVKKPNNKGGIGEERERMGKRAKNPKFRRFINITQFMIFSNNMEYDDGATEPAQGAFYASSACGKPVFNYFREEHKLNLTELLDTLSDDLENNVLQDNNLPVIKHSPEFISNKSPDTPTNRILTSLLCRERLSFLLQHGLTYVKASQGLVQKHIMRYPQLFATLAIEKHLANGGKKGVIWHTQGSGKTALAYYNTRYLTHYYAKQGIVPKFYFIVDRLDLLKQAQREFTARDLVVHTIDSREAFAADIKSAQTLHNHAGKAEITVVNIQKFQDDPDVVARNDYDLAIQRVYFLDEVHRSYNPKGSFLANLNQSDVNAVKIGLTGTPLIGVTAGNVNTRELFGDYIHKYYYNASIADGYTLRLIREEIGSRYKAQLQEALAQLEIEKGSFDRKEIYAHPHFVHPMLDYILDDFAKFRKTNQDESLGAMVVCDSAEQARQLFEHFQTASDHNFTAALILHDVGTKEERDQWVKDFKAGKIDILFVYNMLLTGFDAPRLKKLYLGRLIKAHNLLQTLTRVNRTYKSYRYGYVVDFADIEREFDKTNRAYWDELSNELGDEIGSYSQLFKTAEEIEQEIADIKNALFDFDTENAEEFCSQISQIEDKKQLLALKKALQTAKELYNILRLQGSHEFLAHLDFDKLNLLYRETAARLDTLNLAEKLQQGDTAHLLNEALEDVYFQFVKIGEAELKLADDLKDIMRKVREGLAGNFDQDDPEYISLREELERIFKKKNLAEVGQEEMQANIATLQTVYTKIKEPNRQNDLLRHKYGGDAKYARIHKRLMENAALYGDKLKVFNALSGVKTDADQKVLDMEQILDNQNYFEKQMQGIVLKRFRTEQQFPVQPADIQAINRLLVREYLKESGRI

SEQ ID NO: 187 - DNA, 1200 bp, Neisseria gonorrhoeae
atgaatcattttaagaaacaacaaattcaaaatattgctgattttaatccgagagagcaactagccaagggagcattggcaaaaagtgttccgatggcaatgttgaaagaatttcaacgacaaattacgggttacgaaatcaaggcatttaacggtggagctaagtttcgcaatggtgataccttattagctaagattaccccgtgtttggaaaatgggaaaaccgcttttgtagatattttagatgatggagaagtggctttcggttctaccgaatttatcgtgttaagagcaaaaaatgaaaccaatcccgaatttctctattattttgcaatcagtcccgattttagaaaacgagcgattgaatgtatggaaggaacttccggcaggcaacgtgtcaatgaaaatgcattaaaaacactggagttgcctattccagaacctcaaatccaacaatccatcgccgccgtcctatccgctttggacaaaaaaatcgccctgaacaaacaaatcaacgcgcgcctggaagagatggcgaaaaccctgtacgactactggtttgtgcagttcgatttccccgacgccaacggcaagccctacaaatcctcaggcggcgacatggtgtttgacgaaaccttgaaacgggaaattccgaaggggtggggaagtatagaattacaatcttgcttagcaaaaatcccaaatactacaaaaatattaaataaagatattaaggattttggaaaatatcctgttgttgaccaaagtcaagattttatttgtggatttaccaatgatgaaaaatctatattaaacccacaagatgctcatattatttttggtgatcatacaagaattgttaagttagttaattttcaatatgcgcggggagcagatggtacacaagtaatattaagcaataatgaacgaatgccaaactatttgttttaccaaatcataaatcaaatagatttatcaagttatggttatgctagacattttaaattcttaaaagaatttaaaataattttgcctagtaaagatatttctcaaaaatataatgaaatagcaaatactttctttgttaaagttcgaaataatctaaaacaaaaccaccacctgacccaactacgcgatttcctactacccatgctgatgaacgggcaggtatccgtaagatgtagcggagcaagagatgga

SEQ ID NO: 188 - protein, 400 aa, Neisseria gonorrhoeae
MNHFKKQQIQNIADFNPREQLAKGALAKSVPMAMLKEFQRQITGYEIKAFNGGAKFRNGDTLLAKITPCLENGKTAFVDILDDGEVAFGSTEFIVLRAKNETNPEFLYYFAISPDFRKRAIECMEGTSGRQRVNENALKTLELPIPEPQIQQSIAAVLSALDKKIALNKQINARLEEMAKTLYDYWFVQFDFPDANGKPYKSSGGDMVFDETLKREIPKGWGSIELQSCLAKIPNTTKILNKDIKDFGKYPVVDQSQDFICGFTNDEKSILNPQDAHIIFGDHTRIVKLVNFQYARGADGTQVILSNNERMPNYLFYQIINQIDLSSYGYARHFKFLKEFKIILPSKDISQKYNEIANTFFVKVRNNLKQNHHLTQLRDFLLPMLMNGQVSVRCSGARDG

SEQ ID NO: 189 - DNA, 558 bp, Neisseria gonorrhoeae
atggataaactatttaaaatattattaaatataagtagtacatctttgctgttatcaatatattttattaaatcgcaatattatatattagaccttacttggttttatcgtgtaatttcaaatcattggatagaacctatttctaagttaagtctacttttttattttctaataccatttatcgcaaccgctactgtcttatggctaagcaaatacttggggaaggatgaattcaagcaaggagaggtgaaagaattagaatatgttaacgataatttcttacctagctatcttggttatttttttgttgctctaagcatacccgataataatctttttttgctatttgttatgtatggaattattttcttactagtttcatgctctaagtcattttattttaaccctgtttttttcttatttggctatcgattttatcaagcaaaaactgaatcagggttattattagtgctgattagtaaacaggaatttagaacgccacaaagtgtaagttcgattgctgtatatcgaattaataattttactttcttagaaaaa

SEQ ID NO: 190 - protein, 186 aa, Neisseria gonorrhoeae
MDKLFKILLNISSTSLLLSIYFIKSQYYILDLTWFYRVISNHWIEPISKLSLLFYFLIPFIATATVLWLSKYLGKDEFKQGEVKELEYVNDNFLPSYLGYFFVALSIPDNNLFLLFVMYGIIFLLVSCSKSFYFNPVFFLFGYRFYQAKTESGLLLVLISKQEFRTPQSVSSIAVYRINNFTFLEK

SEQ ID NO: 191 - DNA, 840 bp, Neisseria gonorrhoeae
atgaattttgttttagctaaaattacttgcaagaaagatttagtaaaaatattatctgatgatcatattttccctgacttttcttacgagaatttaaattttataacatataactatgattacaatcttgatgatgatacttggtttcaaattgaaaatttaaagaatcaagatttttgtcctaagtttttggataactcaaatttatttgattcaaaaatgtttagtgaaataaaaaaggaagaaataaatatagagaaactaaagtatttagtatcttgtactaatgatgcactattcttccagaaaatcacaagttcattattactcaaaaagaagcacttgctaactatatgcggaaatggtgcgaaactatgcgaaccacaagacttattggttattaaagatattcctgatgctgtttatataataaaggatgataaattaatatttagaaccctttcttctatttcaaatatatttaaagggattgaagatttgtatcgagaagctacaaatactgaagtacagcaattcttagaaagcgattttattgatttaaaagaagattttttaagtgaaaaagtatctattcccaataggaaaagaatagctttagttcaagatagattgaataatatgacgctagatcaaagacaagaactattaaattaccttgctgaatataataataatatcttgaaatttaacgcagatggctctcgtgtagaaatttctactgatgtacagctgaaacatttgttatatggtattgatgaacgttattacacaacagcattaggaaaagagaaaaggttggcaaatagtgttcaacctatt

SEQ ID NO: 192 - protein, 280 aa, Neisseria gonorrhoeae
MNFVLAKITCKKDLVKILSDDHIFPDFSYENLNFITYNYDYNLDDDTWFQIENLKNQDFCPKFLDNSNLFDSKMFSEIKKEEINIEKLKYLVSCTNDALFFQKITSSLLLKKKHLLTICGNGAKLCEPQDLLVIKDIPDAVYIIKDDKLIFRTLSSISNIFKGIEDLYREATNTEVQQFLESDFIDLKEDFLSEKVSIPNRKRIALVQDRLNNMTLDQRQELLNYLAEYNNNILKFNADGSRVEISTDVQLKHLLYGIDERYYTTALGKEKRLANSVQPI

SEQ ID NO: 193 - DNA, 546 bp, Neisseria gonorrhoeae
atgggaaacagccgattaagccaactccccgcgcccgccgccatcgaagaaaccgactttgagggcatcttcgcgcgcaaaaaagccgccctcaccgccctatgtcccgaaagcatccgcgaaaccgtcgcccaaaccctcgaattagaatcagaacccctaaccatcgacctgcaacagcaagcctatcaagagctgctcgtccgcaaccgcatcaacgaagccgtcaaagccaacctcttggcatacgcacaaggcagcgacctcgaccacatcgccgcccaatacggactttcacgcaaaaccatccgcgccgccgaccccgacgcgaacccgccggttgccgccgaatacgaaaccgacgacgcattccgcgcccgcgtccaagcccatcccgaaaaatacgccgccgggccgcgcaccgcatacgaagcccacgccatcgacgcaccccccaaatcacacacgcccgcgccgtgcgccgcgccgccggcacggtggaggtttacatcaaaacccaaagcggcacgcccgacgaaaccattt

SEQ ID NO: 194 - protein, 182 aa, Neisseria gonorrhoeae
MGNSRLSQLPAPAAIEETDFEGIFARKKAALTALCPESIRETVAQTLELESEPLTIDLQQQAYQELLVRNRINEAVKANLLAYAQGSDLDHIAAQYGLSRKTIRAADPDANPPVAAEYETDDAFRARVQAHPEKYAAGPRTAYEAHAIDAPPKSHTPAPCAAPPARWRFTSKPKAARPTKPF

SEQ ID NO: 195 - DNA, 858 bp, Neisseria gonorrhoeae
atgaatccgctttttacccaagaacgcaggattttccataagaaattattggatggcaatattcttgcaaccaacaatagaggcgtagtcagcaatgcggatgggagcaatacccgaagtttcaatatagccaaggggattgccgacttactgcattcggaaacggtttcggaaagattacccggtcagacatcgggaaatgcttttgaagcaatatgcagtgagtttgtccaatctgcttttgaaaaattgcagcatatcagacccggcgactggaatgttaagcaggtcggttctcgcaaccgtctggaaatcgcacgttatcagcaatacgcacatctgacagccttagccaaggctgccgaagaaaaccccgaattggctgccgccttgggcagtgattacaccattactcccgatattatcgttaccagaaatttgattgcagatgcagaaatcaaccgtaatgaatttttagttgatgaaaatattgccacatatgccagtttgcgtgcgggtaatggcaatatgccgctgctccacgccagtatctcttgtaaatggacgattcgcagcgacagggctcaaaatgcccgttctgaaggattgaatttggttagaaacagaaaaggcagactgccgcacattgttgtcgtaacggcagaaccaacgccaagccgcatttcatctattgccttgggtacaggggaaatagattgcgtttaccattttgccttatatgagctggaacaaattttacaatcattgaattatgaagacgctttggatttgttttacatcatggtcaatggtatacgattaaaagatatttccgaccttcccttagatttggcattt

SEQ ID NO: 196 - protein, 286 aa, Neisseria gonorrhoeae
MNPLFTQERRIFHKKLLDGNILATNNRGVVSNADGSNTRSFNIAKGIADLLHSETVSERLPGQTSGNAFEAICSEFVQSAFEKLQHIRPGDWNVKQVGSRNRLEIARYQQYAHLTALAKAAEENPELAAALGSDYTITPDIIVTRNLIADAEINRNEFLVDENIATYASLRAGNGNMPLLHASISCKWTIRSDRAQNARSEGLNLVRNRKGRLPHIVVVTAEPTPSRISSIALGTGEIDCVYHFALYELEQILQSLNYEDALDLFYIMVNGIRLKDISDLPLDLAF

SEQ ID NO: 197 - DNA, 498 bp, Neisseria gonorrhoeae
atgaccaccgaagtcaacagcggacaagtgcgcggcccggtgcaactggcgtttgcccaatccatcgatccgattgtgccgccggaagtttccatcacacgcatggcggtaaccaatgaaaaagacttggaaaaagaacgcaccatggggcgcaaatacatcgtcccttacgtggtctaccgcgtgcatggctttatctccgccaaccttgccgccaaaaccggtttttcagacgacgacttagccaaactctggcaagccctgacgttgatgtttgaacacgaccgctcagccgcccgtggagaaatggcggcacgcaaactggttgttttcaaacacgacagcgcacttggcagccagcctgcacataaactgtttgacgccgtgaaagtcgaacgcgtaaacggcgaatcaggtacgcccgcaagcggttttggcgattacaaaatcagcgtggtttcagacgggctaaatggcgtgagtgtggaagagtatttg

SEQ ID NO: 198 - protein, 166 aa, Neisseria gonorrhoeae
MTTEVNSGQVRGPVQLAFAQSIDPIVPPEVSITRMAVTNEKDLEKERTMGRKYIVPYVVYRVHGFISANLAAKTGFSDDDLAKLWQALTLMFEHDRSAARGEMAARKLVVFKHDSALGSQPAHKLFDAVKVERVNGESGTPASGFGDYKISVVSDGLNGVSVEEYL

SEQ ID NO: 199 - DNA, 843 bp, Neisseria gonorrhoeae
atgaatgctgtccaagttttaaactttcaacaaaactccgtccgtactgttgccgataacaaaggcgagttgtggtttttggcaaacgatgtttgcgagattttaggctacaccaaccctcgccgaacggttgacctgcactgcaaaagcaggggcgtaacaaaacggtacacccccaccaccagcggcgaacaggagatgacctatattaacgagccgaatctctaccgcttgattatcaaatcccgcaagcctgccgcagaagcgtttgaagaatgggtaatggaaaccgtcctgcccgccatccgcaaaacaggcggctgccaagtcggaccaaaaaccaccgccgacgaccgtaccggattgcgccaagctgttgccgcgcttgtcggacgcaaaggtatagactactcctccgcgtacagtatgatacaccaacgcttcaacgtcgaatccatcgaagacctccctgccgggaagctgcccgaagccgtcgcctacgtccacgcattgacactgcacacgggcttgacaggcgaagtgttggacgcaccgcccaaagccgagccgaaactgcccatcgacggcaactctttagccgacattgccgctatggtttattacggcacatggatgattgaatcgggcaaagacatctccgcgccgctgaagcagctcggctgcaggcaggcggttacgatgtggacggtttggcacgaaacccgtccaatcctgaaaagatccgccgcggccctcgaagtgttgcggggatatgcggacaaagacgcctccgaccgcatagccgcatgtcttgaaggcatttacggcaaggctacggtaagg

SEQ ID NO: 200 - protein, 281 aa, Neisseria gonorrhoeae
MNAVQVLNFQQNSVRTVADNKGELWFLANDVCEILGYTNPRRTVDLHCKSRGVTKRYTPTTSGEQEMTYINEPNLYRLIIKSRKPAAEAFEEWVMETVLPAIRKTGGCQVGPKTTADDRTGLRQAVAALVGRKGIDYSSAYSMIHQRFNVESIEDLPAGKLPEAVAYVHALTLHTGLTGEVLDAPPKAEPKLPIDGNSLADIAAMVYYGTWMIESGKDISAPLKQLGCRQAVTMWTVWHETRPILKRSAAALEVLRGYADKDASDRIAACLEGIYGKATVR

SEQ ID NO: 201 - DNA, 1293 bp, Neisseria gonorrhoeae
atggcacaaaagacgaatacggcctacggcgacccgcaggcgatgatgaagcaggcggcggggctgtttgcgatgcatatgcagcgcaacagtacgctgaaccgtttggcgggcaagatgcctgccggtaccgcgggtgcggaggcgactttgcgcaaacagacgacccagcatatgccggtcgtgcgctgtcaggatttgacgcgcggcatgggtgacgaaatccgtttcaatttggtcaaccctgtttccgccctgccgattatgggcgacaacacggcggaaggcaggggcgtggggatgagcctgtcggaggcgggtttgcgtgtgaatcaggcgcgtttccccgttgacggcggcggcacgatgacgaatcagcgcagccctgccgattatcgcgcgctgattcgtccggcggcgcaaagcctgatggaccgttatgccgaccagacgctgttggtgcatatggcgggcgcgcgcggttttcatgacaatatcgaatggggcgtgcctttggcgggcgacccgaaattcaatgattatgcggtcaatccggtcaaagccccgtccaaaaaccgccattttacggcttcgggcgatgcggtaacgggcgttggggacaacggcggcgagttgaagattgcctctaccgatttgtttacgatggatacggtggacagtatgcgtaccgtgctcgaccagattccgctgccgccgccgattgtgaagtttgagggcgacaaggcggcgggtgattcgcctttgcgcgtgtggctgctttccccggcgcagtacaaccgttttgccgccgatccgaaattccgccagcttcaggcttcggcaatcgcgcgcgcctcccaggcaaatcaaaatccgctgtttttgggcgatgcgggtttgtggaacggctttatcctggtgaaaatgccgcgccccatccgtttctatgcgggcgatgagatgaagtattgcgccgataagttcagcgaggcggaatcgggcttgaaaatcccggcttcgtttgcggacaagtttgcggtcgaccgttcggttattttgggcggccaggcggtgttggaggcgtttgcgaataccggcaaacacggcggtatgcctttcttttggtctgagaaggagcttgaccacggcaaccgtgtggaaacgctcgtcggtacgatacgcggtgtggcgaaaacgcgctttgccgtggatgtcggcgggggtgcgaaggaaattaccgactacggcgtaacggttgtggatacggtggttcctttgcacggcggtatccgc

SEQ ID NO: 202 - protein, 431 aa, Neisseria gonorrhoeae
MAQKTNTAYGDPQAMMKQAAGLFAMHMQRNSTLNRLAGKMPAGTAGAEATLRKQTTQHMPVVRCQDLTRGMGDEIRFNLVNPVSALPIMGDNTAEGRGVGMSLSEAGLRVNQARFPVDGGGTMTNQRSPADYRALIRPAAQSLMDRYADQTLLVHMAGARGFHDNIEWGVPLAGDPKFNDYAVNPVKAPSKNRHFTASGDAVTGVGDNGGELKIASTDLFTMDTVDSMRTVLDQIPLPPPIVKFEGDKAAGDSPLRVWLLSPAQYNRFAADPKFRQLQASAIARASQANQNPLFLGDAGLWNGFILVKMPRPIRFYAGDEMKYCADKFSEAESGLKIPASFADKFAVDRSVILGGQAVLEAFANTGKHGGMPFFWSEKELDHGNRVETLVGTIRGVAKTRFAVDVGGGAKEITDYGVTVVDTVVPLHGGIR

SEQ ID NO: 203 - DNA, 492 bp, Neisseria gonorrhoeae
atgacagtccgaaacacgcaaaccgaaaccgtccggacggaagccgcgccgcaacaaggcggcaataccaacccgggctattacaaaaaccgcgccttcgagtgcgtcgggtttgcgcaatacctcaacttcaacctcggcaacgccttcaaatacatctggcggcacaaggaaaaaggcgggcgcgaagacttggaaaaagccctgcggtacttggaacgccaacgcgccggcgcgccgaagttcaagaaactcaaacaccgccgctatgaaaaaatgtacgccggtctgaaagattgcgggttcgacggcggcacggaggccgcgctgcttgccgtcatctccgccgcttattacatccgcgacggcgaagacaattttgcgtgggcggccgcctgtgtcgaagatttgttggaaaaaatgccgcctgaagcggggcgggccccgcaccctgaaagcccgatgccgcctgaaacggcgggcggaggcatt

SEQ ID NO: 204 - protein, 164 aa, Neisseria gonorrhoeae; identical to SEQ ID NO: 170

SEQ ID NO: 205 - DNA, 1359 bp, Neisseria gonorrhoeae
atgaaccgaatcgaggaaacggaagccgtccaatcactggccagcgtaggggcggaacagaacattttgggcggcatcttgattgaaccgacggcgattgcgcggtgcgcaatcctgacccctgaaaagttttaccaggcgcaacacaggattattttccgcgctctgctggatatggcggcggcaaacgagcctatcgacatcatcacgctgaacgacaagctggaagcgcgcggcgaggcggaaaacgcgggtggcctggcttacttgatagacctgaaccaaaacaccccaagcgcgaagaatatcagccggtacgttgggattgtgaacgacaggtttgtcgagcgcggcttgctgaaggcttcggcggcgattgaaaaaatcgcggtttccaaagacggcgggacggtcgcagaaaagctgtctaaggcggccgatgaattggcggcagtcggcaaagacgcggtaaagcgtgaaaccaagacattcggccagaccgttgaggatttgattggcggtttggacaaaaggcttgacggcgtgcgtttcggattgcctaccggcttgatgaagcttgacgggatgaccggcggtttgccggatggaaacctgattgtgattgcggcgcgtccgtctatgggtaaaacggttttggcggaaaacattgcgcgattcgcgctgaagcagggcaaggcagttcatttccaaagctacgaaatgagcgcggtagagctggcaaggcgcggcatggcggctgagtgcaatatccccatgcagaacctgaaaaccggcaatctgacgcaaagcgattacgccaatatgccgatttacgtcagccaagcgaaagagtggaagtttgacgtgaactgcgacctgctcaacgttgacgagctttgctttttggctaaggagaaaaaactcactaccggcttggatttgttggttgtcgatcaccttcacatcatgccaagggcagggagggacgaggtggcggagttggggaatatatcgcgccgtttgaaaaacttggcggcagagctgaatacccccgtcgtcttggttgcccagttgaacaggggaaacacaaagcaggcagacaaacgcccgaacatggcagacattcgcggcagcggcgcgattgagcaagacgcaaacatcatcatcatgccgcaccgcgaaagctactacgacggaaacgagaatccgagcattgccgagctgattatcgccaagaaccgggacggcgaaatgggaacggtggtttgcggctggaaagggcaatttatgaagttcgaggaagagcctgatttggcatggcaagcccccaaacatgatgaatatgacccttacagtgtc

SEQ ID NO: 206 - protein, 453 aa, Neisseria gonorrhoeae
MNRIEETEAVQSLASVGAEQNILGGILIEPTAIARCAILTPEKFYQAQHRIIFRALLDMAAANEPIDIITLNDKLEARGEAENAGGLAYLIDLNQNTPSAKNISRYVGIVNDRFVERGLLKASAAIEKIAVSKDGGTVAEKLSKAADELAAVGKDAVKRETKTFGQTVEDLIGGLDKRLDGVRFGLPTGLMKLDGMTGGLPDGNLIVIAARPSMGKTVLAENIARFALKQGKAVHFQSYEMSAVELARRGMAAECNIPMQNLKTGNLTQSDYANMPIYVSQAKEWKFDVNCDLLNVDELCFLAKEKKLTTGLDLLVVDHLHIMPRAGRDEVAELGNISRRLKNLAAELNTPVVLVAQLNRGNTKQADKRPNMADIRGSGAIEQDANIIIMPHRESYYDGNENPSIAELIIAKNRDGEMGTVVCGWKGQFMKFEEEPDLAWQAPKHDEYDPYSV

SEQ ID NO: 207 - DNA, 489 bp, Neisseria gonorrhoeae
atgaccgccctcacactctaccggtgcgcggcagacgtacaggcggggctggattactactttgacagcgaaaccgagcgcgaagacacgctggaagccgttatcgggcagttcgaggtcaaagcgcaatccgttatcgcttatattaaaaaccaagaaatcacggaaaaaatgcttgaagggcacatcaggcagatgaccgggaagctcaaggcggcaaaagcgcggaatcaaagcctgaaagactacttggcgcgcaatatgcaggcggcgggcattaccgaaatcaaagcggatgacggcacttttaaagcctcgttccgcaaatccgaagccgtcgtgatcttagacgaagcacaaatccccgccgaatttatgcgtgaggccgtcaaaaccgaaccggacaaaaccgccatcagaaaagcgattgaaagcggtcggcaagtagcaggcgcgaagattgaagggcggaagaatttgcagattaga

SEQ ID NO: 208 - protein, 163 aa, Neisseria gonorrhoeae
MTALTLYRCAADVQAGLDYYFDSETEREDTLEAVIGQFEVKAQSVIAYIKNQEITEKMLEGHIRQMTGKLKAAKARNQSLKDYLARNMQAAGITEIKADDGTFKASFRKSEAVVILDEAQIPAEFMREAVKTEPDKTAIRKAIESGRQVAGAKIEGRKNLQIR

SEQ ID NO: 209 - DNA, 810 bp, Neisseria gonorrhoeae
atgttgtctggcgcaaaggtatcggaagacgaagccctgacgtgcggcatcatgatgcggctgtccctgcaggatatgcgctatgcctgcaatcaggaattaatcaacttcgccgaacatatcgtcaaacaggtgcaacgcttgggcctgtactgcaacactgacgaccccgcgaacggggaaagcgtactgtttgcctgccgcgaagcatcgcaggccgtcgctcaatggactaaagattttgacaatttaagcccgaatcagcgccaactcgtgctgcgtccgctgtcaaatctcttcgccgcgtacgaagaatttctgaaagacgcgcctgcacggctgatagccgaagtatcggcatactcattggccgtgcgggttgccaagaaagccatggcgtttttagagcttgacggcggtttgatttcggcggttggcaaagtcgtcaacggcgcggattcgcgcgcggaagcccgccgccttaaaatgccgtacgcggaatttacaggccggatcctacacgccgcgaacctgctttacgatgtgggcattcaggcggacaaggagctttcggcgatgtacggcaagccgctgaatcccgtgcgcccccgacggataagcgacgtgcgccggccgatgatgaaaatgcttgttgcggacaaaggcggcgcgttggtccgggccgtaaaagactcggaagacgtcatccggcattgcgacaacggcgccggcttcagctgcttcaactggaccgaacatttcaaacggacggcaaacctgatcagcctcatgcacagggaagcggcggca

SEQ ID NO: 210 - protein, 270 aa, Neisseria gonorrhoeae
MLSGAKVSEDEALTCGIMMRLSLQDMRYACNQELINFAEHIVKQVQRLGLYCNTDDPANGESVLFACREASQAVAQWTKDFDNLSPNQRQLVLRPLSNLFAAYEEFLKDAPARLIAEVSAYSLAVRVAKKAMAFLELDGGLISAVGKVVNGADSRAEARRLKMPYAEFTGRILHAANLLYDVGIQADKELSAMYGKPLNPVRPRRISDVRRPMMKMLVADKGGALVRAVKDSEDVIRHCDNGAGFSCFNWTEHFKRTANLISLMHREAAA

SEQ ID NO: 211 - DNA, 1266 bp, Neisseria gonorrhoeae
atgaaacaaaagaagacagttcagtgcatcttacttggcttcgcggccgcttctatgcacgcgcaaggggcggccgctgcaaacagcggaacgatagagaagacagacaaatacaccctcgtcctcgcaaaacaagggcaagagaacaactatacccttaatggcggaaccgaagtcaaacccttaaattccctcatcattgccgccaacggcggtacgaacaacattacgataaaaggcaaattggcagacggtcctgccgatgccccgccgacgattgacaataactcgattgaaagaaatataaataaaaacggttacacgtacgcatggcagaattggagcggcgcggtgatgttggtggatcaaagctatgagggagaaaataaggttacttttgaaaacgtaaccatagccgcccataacgcgcctgccggcattttgtctgatgataggcataaatccagtagcttggcgccggcgatgcttgcctttaaagggcgcaataccatcaatatggacgcggactcaaatgccaactctagtaacgaaggtatcctattgcttaataatggtgaaaaaatgggagaatatcgtcttgtttccgaagaaggctcgacgctgaatatcaacatcaaatcaggaaaagataaaggacagggcattaccgccaaccactatggtaactcagacatcaacttcaacaaggcttctccaaacatcaccacaatggagttcaagggcgatgtaaacattaaaatcgataggaacggacaggaagaggcggaaagcaacggttttggcttctattcaagccgcaaattaggcaataagaagcagattccggaaggttctaagatggaagcgattttccgtgggaacgtcgatatcgttgcaacgccggtttatgacgagcaaggcaggcccaaaagcataggcagcgcgtttgcgattgacgggaaatacagcaaagtcgaggttgtcggcggggaaggcaaggttgtcaaaatcaaaggcgatattttcgcctacaacggcggcagcgtgagcgtgaaccttgccaacaaagactcttattttgaaggggaagcccatatcgggaaaaggagctttgccaaagggaaagatatgtttgccttaaccgtggatgcggacggatatgaattaacccccgatacaaagtcgattgaaaagaaaaagaaagagctgaatgttaggggctgtactagattatccctaaattccacaccgatcccgcaggatttt

SEQ ID NO: 212 - protein, 422 aa, Neisseria gonorrhoeae
MKQKKTVQCILLGFAAASMHAQGAAAANSGTIEKTDKYTLVLAKQGQENNYTLNGGTEVKPLNSLIIAANGGTNNITIKGKLADGPADAPPTIDNNSIERNINKNGYTYAWQNWSGAVMLVDQSYEGENKVTFENVTIAAHNAPAGILSDDRHKSSSLAPAMLAFKGRNTINMDADSNANSSNEGILLLNNGEKMGEYRLVSEEGSTLNINIKSGKDKGQGITANHYGNSDINFNKASPNITTMEFKGDVNIKIDRNGQEEAESNGFGFYSSRKLGNKKQIPEGSKMEAIFRGNVDIVATPVYDEQGRPKSIGSAFAIDGKYSKVEVVGGEGKVVKIKGDIFAYNGGSVSVNLANKDSYFEGEAHIGKRSFAKGKDMFALTVDADGYELTPDTKSIEKKKKELNVRGCTRLSLNSTPIPQDF

SEQ ID NO: 213 - DNA, 852 bp, Neisseria gonorrhoeae
atgaaggcggcgacaaaagaactgattggcctgctgcacggcggcgacgagtttcagatggcggatttgtacaccattacgctttcgggcggccgggtgctgcggcataccggcgcggatatgcccgtcgtttgggacggtcaggcctacggggcgcacgagctggttatcaagcgcggcgcaacccgtaccgccgtcggattggaagtggattccaacaccctgcagatttcagccgcgcccgattacaggcttgagggcctgcaatgggcggaggccgccctgggcggcgtattggacggcgcgcgggtcaaaatagaccgtgtgttttttgatgccggactgcgccccgtcggtgcggtgaatattttttcagggcgcgtgtcggacgtatcgggcggcaggtcgtccgtgaaggttgacgtgaaatccgacatcgagcttttgaacgtttccagcccgcgcaacatttatcaggcgggctgcatgaggacgctctatgacgacggctgcaaggtcaaccgtgagaaattcacggtaaacgggcgcgtaaccgaaaacagccggacgggaaccgtgctgaagcacaatctgacgcagcctgacggctggttttcgcagggcgtgattaagtttgcgggcgggcgcaacgcgggtttgagcaggacggtcaaggcacacggcggcaacacgttcgaacttgcccttcgcctgccctacccgccgcaggcgggcgatgcgttcaaggtttatccgggctgcgacaagcggcgcgatacctgcaaggataagtttgacaatatcgtgcattttcgcggcttcccgttcatcccttcggcagatacggtggtg

SEQ ID NO: 214 - protein, 284 aa, Neisseria gonorrhoeae
MKAATKELIGLLHGGDEFQMADLYTITLSGGRVLRHTGADMPVVWDGQAYGAHELVIKRGATRTAVGLEVDSNTLQISAAPDYRLEGLQWAEAALGGVLDGARVKIDRVFFDAGLRPVGAVNIFSGRVSDVSGGRSSVKVDVKSDIELLNVSSPRNIYQAGCMRTLYDDGCKVNREKFTVNGRVTENSRTGTVLKHNLTQPDGWFSQGVIKFAGGRNAGLSRTVKAHGGNTFELALRLPYPPQAGDAFKVYPGCDKRRDTCKDKFDNIVHFRGFPFIPSADTVV

SEQ ID NO: 215 - DNA, 963 bp, Neisseria gonorrhoeae
atgtcggttcaaccaagcgtttcggaacaactgaaagacaatgcaaatgttgatgcgaaagatgaaaaagttattgaatatctgaagaaatcatcattaaaagatgtaccaaaagaattgcaagccaaagtattaaaggttaaaggtgatgaatatacaggagtgcgaaaacaatatgcaggtaagctcggtaagggtgaatctgtcaaggcaatgctatttctagacggcgaagagccgtttagtaaggaacaacttcagaagatggatgtatatgttaatggtaaaaaatacgaaggtagtaaggggggggaactagatgttctccccaaaggtttgagtgagcaaaagattgagttttacggtgcggataaagaacagaattatgcgctattaaaaacttgggtttatgagcaaccgtattctgtggttagaggctattttggctacagtcgaaaagacggtaatcctatagaaggggatggacaaaatcctgaagagattccttttgacttgtatctgggcgacattagaggcgtggcaacagatgaagacaaattacccaaggctgggagctttcaatatgaaggtcgggcatttggcggtaatggggttttatccaaagaatcgttagataaccataatggcgtatttagatacacaattgattttgatcgtagaaaaggctctggctcaattgaaggaatggaacaatatggcaagatcaaattagaagaagctgctattgagagaatcccttatcgagagtccggctccagcttggggttgaaagaccgggtttcttatttcggcgtgaacgaaggggtggctatgttagagaaggataatgagattaaaaagtatcatttgggtattttcggcgaagcggctaatgaagtagcaggtgctgtaagccaagagcataaacatcaagctgttatcggtttcggcggcgagaagaaa

SEQ ID NO: 216 - protein, 321 aa, Neisseria gonorrhoeae
MSVQPSVSEQLKDNANVDAKDEKVIEYLKKSSLKDVPKELQAKVLKVKGDEYTGVRKQYAGKLGKGESVKAMLFLDGEEPFSKEQLQKMDVYVNGKKYEGSKGGELDVLPKGLSEQKIEFYGADKEQNYALLKTWVYEQPYSVVRGYFGYSRKDGNPIEGDGQNPEEIPFDLYLGDIRGVATDEDKLPKAGSFQYEGRAFGGNGVLSKESLDNHNGVFRYTIDFDRRKGSGSIEGMEQYGKIKLEEAAIERIPYRESGSSLGLKDRVSYFGVNEGVAMLEKDNEIKKYHLGIFGEAANEVAGAVSQEHKHQAVIGFGGEKK

SEQ ID NO: 217 - DNA, 420 bp, Neisseria gonorrhoeae
atggccggctgcctgaccgacttggaaaactgtctggaaaaatacctcgaacagttcgggccggtatcggaaagtatcgaagcctgtaccgccaaactgcaggagcaaccgtcgttcttcaacaggctgatgaaagccaacgacaagctcaacaggcagattgacgtgttgcagaaacagtcggcagccatccacaacgaagcctatatcgaaatgaacacgctgctttaccgccatcgcgaagtagtttccatccacaaccgcaaagcagattatgcggaaaagggcaaagagcggattgcgctgttcccgcgcggtttgaacggcatcaccaagctgcctgccgccgtcctgttgcccgagcgtccctaccattttgatatgaaggaggttctgtatatattctcccgaataccgaga

SEQ ID NO: 218 - protein, 140 aa, Neisseria gonorrhoeae
MAGCLTDLENCLEKYLEQFGPVSESIEACTAKLQEQPSFFNRLMKANDKLNRQIDVLQKQSAAIHNEAYIEMNTLLYRHREVVSIHNRKADYAEKGKERIALFPRGLNGITKLPAAVLLPERPYHFDMKEVLYIFSRIPR

SEQ ID NO: 219 - DNA, 315 bp, Neisseria gonorrhoeae
atgggaatacacatatttgaaataacagaaaaagcgggggcaaaacccgccgctgcatctgtcgctgtacatccctgctgtcggacttaccgcttcaacttcgcaaacgcatccgccatcgccgaattggttgggacacgctcgttgcgttgtggtttgcggccggctgtccgttcgcggctgcggtttttccagctcggacagaatgtccagaatggtcggcagtccgaagtgttcgtcggtgaagtcggacgctttgatttgcttcacgcgctcgcggttaactgcctaaatatgaaattcttggtcttcttg

SEQ ID NO: 220 - protein, 105 aa, Neisseria gonorrhoeae
MGIHIFEITEKAGAKPAAASVAVHPCCRTYRFNFANASAIAELVGTRSLRCGLRPAVRSRLRFFQLGQNVQNGRQSEVFVGEVGRFDLLHALAVNCLNMKFLVFL

SEQ ID NO: 221 - DNA, 855 bp, Neisseria gonorrhoeae
atgggatttatagaaccgtttttatcaagctatacacctttatcacgagattatgtacaagctcgtactaaccgaaaacgacaaaccctactttccaaaatcgtatatacgcactctggctttcagcgttcagtaactgaaaactctaatattcgacaaataaatttcctgattaaaacgctggtcgagcatccacaaggcaagctaaataaaaaagaaattgccgccatgatgttagtagacttaaaaacctttcaacaagattatctaaccgaaacagaattgaatgattattttcaacagggaatagaatcaggatttattgaacgaaaatacaatcaaataagttatttatggaacctattagacaaattagacgacttaaaacgagtaggtgatgacttatattttgctgaggatgcccaacgtatttttggtaatttggatgaaattactgtaaggaaacgcgacccttatttacatcgcctatacaaaaaccaacttcaagaagaaagtgaagaacattacggtaatgtgaaatgtatgctggaaaaacttgcctatcctgtattgattgccagtcatattaagcctttcatcctgtcggatgataccgaagcatacgacccaaataacggcttgctattaagtcgtaccttggatagcctatttgatttgaaatatatttcgtttgatgatgaaggaaatatggtgaaatctaagcggttatcagatgatgtttggcgacgttggtgtgatgtgaagctagataacaatctgctcaacgacaaacgtaaatcttacttggcatatcatcgagaacttatgctacaagaagaccaagaatttcatatt

SEQ ID NO: 222 - protein, 285 aa, Neisseria gonorrhoeae
MGFIEPFLSSYTPLSRDYVQARTNRKRQTLLSKIVYTHSGFQRSVTENSNIRQINFLIKTLVEHPQGKLNKKEIAAMMLVDLKTFQQDYLTETELNDYFQQGIESGFIERKYNQISYLWNLLDKLDDLKRVGDDLYFAEDAQRIFGNLDEITVRKRDPYLHRLYKNQLQEESEEHYGNVKCMLEKLAYPVLIASHIKPFILSDDTEAYDPNNGLLLSRTLDSLFDLKYISFDDEGNMVKSKRLSDDVWRRWCDVKLDNNLLNDKRKSYLAYHRELMLQEDQEFHI

SEQ ID NO: 223 - DNA, 1050 bp, Neisseria gonorrhoeae
atgacgcttgaagaacaacaagccaaagaagcattggacggcattatcaaaaaatcccgtgtccacctttataaacccattcaaattgcagaaattttatatcatgaccgttgtataaaacagttggattttttaaatttagatacttaccgcaaccaatctaaacgctggagggatgaaatctgccgtcggtttttagggcggatttctacttcatctgcaaaattccaagataatctgtttgaaaaaaatgcaataccgcctgaaaaactagcggtattgggaacattaaacagacagtcggacggcggggtagaatcgtacatttataaacagtttttcaatcgtttttcccaaatgagcgaagcattggcttatgtcggcaatacagacagatactccttccaactgtctgaatttctaaatttattttggctcgagccgggattgaaaagaagtatagacaagatatatgaaatcgttgtttatgcgttgtttgatgcattggtttcagaattaggcataacggtttcaattgattttcctaaggaaaacctgtttttatgggaggaatatcaagattttgccgaaaaaatcatcactatgccgaaaaatgagcatttaaaacttcctgcaaaaatccatcgtgtaggcgtaaccaatgctgccgatagagggttggatatgtggtctaacttcggattggccatacaggtcaaacatctctctttagacgaagagttggcagaagatattgtatcctccattagcgcagatagaattgtcattgtctgcaaaaaggcagaacaatcggtgattgtttcattactgacgcaaataggctggaaaagccgaattcaaaacatcgtaactgaggatgatttgataagttggtacgaaaaagcattgagaggccaatatccgattgcagaagcgttgttggaaaatattaaaactgaaattatgcgtgaatttcctgccgttaatgaagccaatgaatttttagatttcgcccaaaatcgcggatatgacattactgttactcatttc

SEQ ID NO: 224 - protein, 350 aa, Neisseria gonorrhoeae
MTLEEQQAKEALDGIIKKSRVHLYKPIQIAEILYHDRCIKQLDFLNLDTYRNQSKRWRDEICRRFLGRISTSSAKFQDNLFEKNAIPPEKLAVLGTLNRQSDGGVESYIYKQFFNRFSQMSEALAYVGNTDRYSFQLSEFLNLFWLEPGLKRSIDKIYEIVVYALFDALVSELGITVSIDFPKENLFLWEEYQDFAEKIITMPKNEHLKLPAKIHRVGVTNAADRGLDMWSNFGLAIQVKHLSLDEELAEDIVSSISADRIVIVCKKAEQSVIVSLLTQIGWKSRIQNIVTEDDLISWYEKALRGQYPIAEALLENIKTEIMREFPAVNEANEFLDFAQNRGYDITVTHF

SEQ ID NO: 225 - DNA, 657 bp, Neisseria gonorrhoeae
atgaactggccttatttaatcgatgccgtacccaaattcgccgatgcggcaaagctgacgctggaattgtccgtttacggcgttgttttgtcgttgctgttcggcctgcccgtcgccgtggtaacggcataccgcatccgccccttctacgcattggcgcgcgcctatatcgagctgtcgcgcaatacgcccctgctgatccaattgtttttcctatattacggtctgccgaaaatgggcatcaaatgggacggtttcacctgcggcgtaatcgcgctggttttcttgggcgcaagctatatggcggaagctgtccgcgccggcatcctcgccgtccccaaagggcaggtcggagcgggcaaggcaatcggtttgagccgctttcaagtgttccgctatgtcgaattgccgcaggtttgggcggtcgccgttcccgccatcggcgcaaatatattgtttttaatgaaagaaacatccgtcgtcagcacggtcggcattgcggaattgttatttgttaccaaagacgtcatcggtatggactacaaaaccaatgaagccttgttcctgctgtttgccgcttatttgattatcctgctgcctgtttctttgttggcgcggcggattgaaaaccgcgtacggagtgcgaaatatggcgtt

SEQ ID NO: 226 - protein, 219 aa, Neisseria gonorrhoeae
MNWPYLIDAVPKFADAAKLTLELSVYGVVLSLLFGLPVAVVTAYRIRPFYALARAYIELSRNTPLLIQLFFLYYGLPKMGIKWDGFTCGVIALVFLGASYMAEAVRAGILAVPKGQVGAGKAIGLSRFQVFRYVELPQVWAVAVPAIGANILFLMKETSVVSTVGIAELLFVTKDVIGMDYKTNEALFLLFAAYLIILLPVSLLARRIENRVRSAKYGV

SEQ ID NO: 227 - DNA, 624 bp, Neisseria gonorrhoeae
ttgggcgaaggcctgctcttaacggcacaaatttctttaatctctgttgcggcttcttgcgtattgggcacgctgttcggcttggttttgcgttcgcgcaaccggcttgtccgctttgtcggacggttttatctcgaaaccatccgaatcgtgccgattttggtgtggctgttcggcctgtatttcggcctatccgtctggacaggcatccacatcggcggattttgggtctgcgtctgggtattttccctgtggggcgttgccgaaatgggcgacttggtgcgcggcgcactggaatcgattgaaaaacaccaggtcgaatcgggtcttgcgcccggcttgagccgggggcaggtattccgctgcatcgagctgccgcaaagcatccgccgcgtattgcccggcgcggtcaacctgttcacgcgcatgatcaaaaccagctcgctcgcctggcttatcggcgtgatcgaagtcgtcaaagtcgggcagcaaattattgaaaactcgttgctgacgcagcccaatgcttcattttgggtttacggcctgatttttatgctgtatttcttctgttgctggccgctatctctactggcggcaaaacttgaacaaaaatgggaacac

SEQ ID NO: 228 - protein, 208 aa, Neisseria gonorrhoeae
LGEGLLLTAQISLISVAASCVLGTLFGLVLRSRNRLVRFVGRFYLETIRIVPILVWLFGLYFGLSVWTGIHIGGFWVCVWVFSLWGVAEMGDLVRGALESIEKHQVESGLAPGLSRGQVFRCIELPQSIRRVLPGAVNLFTRMIKTSSLAWLIGVIEVVKVGQQIIENSLLTQPNASFWVYGLIFMLYFFCCWPLSLLAAKLEQKWEH

SEQ ID NO: 229 - DNA, 852 bp, Neisseria gonorrhoeae
atgaaattgaacgccaaactcaaagcccttttggcttccgccgccatcgccgtcggtctgaccgcctgcgggggcggctccggcgatgcccaatcttcacaaagcagcggtgcggcaaccgttgccgccatcaaagaaaaaggcgttatccgcatcggcgtattcggcgacaaacccccgttcggctatgttgacgcaaacggcaaaaaccaaggctttgacgttgaaatcgccaaagacctggccaaagacctgctcggcagccccgacaaagtcgaattcgtcctgaccgaggccgcaaaccgcgtcgaatacgtccgttccggcaaagtcgacctcatcctcgccaactttacccaaacccccgaacgcgccgaagccgtcgatttcgccgatccttacatgaaagtggcgttgggcgtggtttcccccaaaaacaaaccgattaccgacatggcgcaattgaaagaccaaaccctgctggtcaacaaaggcaccaccgccgacgctttcttcaccaaaagccatcccgaagtcaagctgttgaaattcgaccaaaacactgaaaccttcgacgcgctgaaagacggtcgcggcgtagcactcgcgcacgacaacgccctgctgtgggcgtgggcgaaagaaaacccgaactttgaagtcgccatcggcaatctcggtcctgccgaatttatcgcccccgccgttcaaaaaggcaacgccgacctcctgaactgggtcaacggcgaaatcgccgccatgaaaaaagacggccgtctgaaagccgcctatgaaaaaaccctcttgcccgtgtatggcgagaaagtcaaaccggaagcattgttggccgaa

SEQ ID NO: 230 - protein, 284 aa, Neisseria gonorrhoeae
MKLNAKLKALLASAAIAVGLTACGGGSGDAQSSQSSGAATVAAIKEKGVIRIGVFGDKPPFGYVDANGKNQGFDVEIAKDLAKDLLGSPDKVEFVLTEAANRVEYVRSGKVDLILANFTQTPERAEAVDFADPYMKVALGVVSPKNKPITDMAQLKDQTLLVNKGTTADAFFTKSHPEVKLLKFDQNTETFDALKDGRGVALAHDNALLWAWAKENPNFEVAIGNLGPAEFIAPAVQKGNADLLNWVNGEIAAMKKDGRLKAAYEKTLLPVYGEKVKPEALLAE

SEQ ID NO: 231 - DNA, 492 bp, Neisseria gonorrhoeae
atgagattaacgaaatatccttataactccataagagagttagaagactatttaataaacacctatcaaaaatatattattctacaagagggaggaaaagagatttatcgatgttttattctttctttttataaagaattcaatataggtattggattagctgtttcttgcataagtattcccccaaaagtattaatgcttgatgataaaaatatttttatcggatttgattcagtcgttttttgtatttctatacaaaattcaaaagttaacatactaaatatagatggaatagtttttgatatttatttattggataatcaaaaaatttgtattattcatgagttgggtgcaattattacagataaaaatttaataagagagaattcagtatctaccgatataatatcagactgggaaatagataaagttaataagttaatcatattaaaagagttagactctgaaaaaataatttctctaaattatgat

SEQ ID NO: 232 - protein, 164 aa, Neisseria gonorrhoeae
MRLTKYPYNSIRELEDYLINTYQKYIILQEGGKEIYRCFILSFYKEFNIGIGLAVSCISIPPKVLMLDDKNIFIGFDSVVFCISIQNSKVNILNIDGIVFDIYLLDNQKICIIHELGAIITDKNLIRENSVSTDIISDWEIDKVNKLIILKELDSEKIISLNYD

SEQ ID NO: 233 - DNA, 1650 bp, Neisseria gonorrhoeae
atggttgcctatgctttcctatttttgtttgtaacggcggcggtgctgctgattgtcaggtcgcactaccgctggacgtattttttcgcgtcggcgctgtttgtctttttggcgggcggtatgctgatgttgacggcgcagtggcagcgcgccttgaatttcgcttcggtctggtttgtggtgctgatactgttccacaggctgaaaatccattattacaaacagccgctgttgatttccgactttttgctgattgccgactggcggaattgggaaacgctgtttcattataaggaagcggttatcggtatggcggggctgctggctttggcgggatatgcggttttcggctggagcggtgcggattctttgggtatgccgtggcgttgggcgggcgcggttctgtttgcggcggcgttcgtgtcggtgcggcatttttccaagcaccccggcgcggtaaagacgtggctggattcgctgccggacgacgggcgcgacgtgtttttgaacctgccgatgtcctgtcgggcggtgtttttccaagtacccgtgttcgagggcgacggggaagcgtttgccaggcagatgccgtctgaaacccggccgtacggcatgtcggatgaaaagcccgatattgtcgttaccctgatggaatcgacgctcgatccgcactgtttcgattttgccgccgccaaaattcccgatttgaaaatgttcggacggcaggaagatactgtattttcctcacctttgcgcgtgcatactttcggcggcgcaacgtggaagtccgaatttgcgtttttggcgggtgttccgtccacagatttcggcgcgttggcaagcggcgtgttttattcggtcgtaccgcatttgcagaccggttttgtccgcaacctgcgcgaacacggttatttttgcgtggcgctctcgccgtttaccaagggcaactacaatgccaaggcagcatatgaccatttcggctttaatctgatgttccagccgcaagatttgggctatcccgcgccgatgggcaaaaacctgtggcacatttccagtgaggaaatgatgcagtatgcgcggatgattctcgaaaaacgccatcccgatttggaaaacgtgcggcagccgatgttcgtatatgtgctgaccatgaaggagcacgggccgtatcggacggataccgacaatgtgtttgatttggatgcgcccgatttgaatgcgaaaaccgtatccgcgcttaacgactacatcgggcgcattgccgatttggacaaagcggtggaaagtttcgaccgttatctgcacgaacgcggcaaaccctttgttttcggttatttcggcgatcatcaggtaccgtttgagggcgtgtccgtcaggaagaaatgggattacgctcagccggattatgtaacgcagtttgccgtcaggagcaatattgccggcggattcgtacagcggcaggatttcctcgaccttgcctttgcaggcggcgtactgatggaggcggctggtttggaagccaaagacggcttcatgcgtgcgaatatggcgatgcgcggtttgtgcggcggagggttggaagactgcccgaaccgggagttggtcggaaattaccgcaactatctgtacgacgttttgaaaattgcccgt

SEQ ID NO: 234 - protein, 550 aa, Neisseria gonorrhoeae
MVAYAFLFLFVTAAVLLIVRSHYRWTYFFASALFVFLAGGMLMLTAQWQRALNFASVWFVVLILFHRLKIHYYKQPLLISDFLLIADWRNWETLFHYKEAVIGMAGLLALAGYAVFGWSGADSLGMPWRWAGAVLFAAAFVSVRHFSKHPGAVKTWLDSLPDDGRDVFLNLPMSCRAVFFQVPVFEGDGEAFARQMPSETRPYGMSDEKPDIVVTLMESTLDPHCFDFAAAKIPDLKMFGRQEDTVFSSPLRVHTFGGATWKSEFAFLAGVPSTDFGALASGVFYSVVPHLQTGFVRNLREHGYFCVALSPFTKGNYNAKAAYDHFGFNLMFQPQDLGYPAPMGKNLWHISSEEMMQYARMILEKRHPDLENVRQPMFVYVLTMKEHGPYRTDTDNVFDLDAPDLNAKTVSALNDYIGRIADLDKAVESFDRYLHERGKPFVFGYFGDHQVPFEGVSVRKKWDYAQPDYVTQFAVRSNIAGGFVQRQDFLDLAFAGGVLMEAAGLEAKDGFMRANMAMRGLCGGGLEDCPNRELVGNYRNYLYDVLKIAR

SEQ ID NO: 235 - DNA, 420 bp, Neisseria gonorrhoeae
atgaagcacgctccgattatcctcctgcttaccgcttcgtccgccgccctactttcggcgggctgcaccgcccttccctctgaccggccgccgcttcgcaccctgccgaaaagcgcgcccatccaacccgccaacccatacagccggccgccttcaggcacgccggacggcgcattcagcacccgcgcctcaaacgggcgcgtcttgaaaagcatcgtcaaaaacggcgtgttcgaccgctttgtcgatatttaccatccaaacggcaaactgcattcgcacacgccggttgaaaacggcgtggcgcaaggctataccgaacagggcatattgcggacgcgcatcctgtaccgggacgggcatatcgtccgagcgcaaactttggatgcgtcgggcaaggtggaacgcgaatggcagccg

SEQ ID NO: 236 - protein, 140 aa, Neisseria gonorrhoeae
MKHAPIILLLTASSAALLSAGCTALPSDRPPLRTLPKSAPIQPANPYSRPPSGTPDGAFSTRASNGRVLKSIVKNGVFDRFVDIYHPNGKLHSHTPVENGVAQGYTEQGILRTRILYRDGHIVRAQTLDASGKVEREWQP

SEQ ID NO: 237 - DNA, 993 bp, Neisseria gonorrhoeae
gtgtccatccccaccgccacgccgctgcccgccggcgaggtaacgttatcaagcgataacggcaatatcgaaaacatcaacaccgccggcgccggaagcgcatccgacgcgccgagccgcagcagacgctcgctcgatgccgccccgcaaaacacatccggcatttccattcggcagcgggaagtagaaaaagactatttcggctataaatcaaaagaaacatcattcatcttcaaaacacccggcggcgcgcaatacgccctttcatcctacgccgaccccataaccgtcagctactcctcccccgatttcaaaattcccgaccgccacgcagggcagcggctcgccgacggcagccgcatctttatctgctgcagcgactccggggctacttcgtatgcggaaattaccaaacaagattatatgaaattcggggcgtggataggtcctaacggcgaaatcgacctcttcgccggcggcttccccgtcggcaaaacgccgcctcctgcgttctcctacggcagcagcacgcccgaaaccgcattgtcaaagggtaaaatcacttatcaggtttggggcatccgcgtcagaaacgggcaatttgttacttcctcttatacgccgccgaaaagcggttcttattatgggacacttgccaatacccccgtcctttcctttatcaccgccaatttcaacagcaacacactggcaggcaaaatcctcggcaacagcgattacgggccggatgtggatattcaaaacgcaacgattaccggtccgaccttttccggcgatgccacgtccggcgggaaaagcggcaaattggaaggcaagttttttggcaagttcgccagcacccgcagcagcgaagtcagcataggcggcaaaatcacctttgacggcgaccgctccctcgataccgtattcggcggtgtgagttatgaaaaaaaacttgatgacaccagtcaagataccaaccaccttactaaacaa

SEQ ID NO: 238 - protein, 331 aa, Neisseria gonorrhoeae
VSIPTATPLPAGEVTLSSDNGNIENINTAGAGSASDAPSRSRRSLDAAPQNTSGISIRQREVEKDYFGYKSKETSFIFKTPGGAQYALSSYADPITVSYSSPDFKIPDRHAGQRLADGSRIFICCSDSGATSYAEITKQDYMKFGAWIGPNGEIDLFAGGFPVGKTPPPAFSYGSSTPETALSKGKITYQVWGIRVRNGQFVTSSYTPPKSGSYYGTLANTPVLSFITANFNSNTLAGKILGNSDYGPDVDIQNATITGPTFSGDATSGGKSGKLEGKFFGKFASTRSSEVSIGGKITFDGDRSLDTVFGGVSYEKKLDDTSQDTNHLTKQ

SEQ ID NO: 239 - DNA, 780 bp, Neisseria gonorrhoeae
ttgccgccaatttgcggggggggggggggtaatatccgctttatagacgtaaaccccgaagatttcgccggcttccccttaaacatcaggcacatttccattacgacttatgcccgcctgaaattgggcgaatacattgccgattgcgacaaagtcctgtatctggatacggacgtattggtcagggacggcctgaagcccttatgggataccgatttgggcggtaactgggtcggcgcgtgcatcgatttgtttgtcgaaaggcaggaaggatacaaacaaaaaatcggtatggcggacggagaatattatttcaatgccggcgtattgctgatcaacctgaaaaagtggcggcggcacgatattttcaaaatgtcctgcgaatgggtggaacaatacaaggacgtgatgcaatatcaggatcaggacattttgaacgggctgtttaaaggcggggtgtgttatgcgaacagccgtttcaactttatgccgaccaattatgcctttatggcgaacgggtttgcgtcccgccataccgacccgctttacctcgaccgtaccaatacggcgatgcccgtcgccgtcagccattattgcggctcggcaaagccgtggcacagggactgcaccgtttggggtgcggaacgtttcacagagttggccggcagcctgacgaccgttcccgaagaatggcgcggcaaacttgccgtcccgccgacaaagcgtatgcttcaaagatggcgcaaaaagctgtctgccagattcttacgcaagatttat

SEQ ID NO: 240 - protein, 260 aa, Neisseria gonorrhoeae
LPPICGGGGGNIRFIDVNPEDFAGFPLNIRHISITTYARLKLGEYIADCDKVLYLDTDVLVRDGLKPLWDTDLGGNWVGACIDLFVERQEGYKQKIGMADGEYYFNAGVLLINLKKWRRHDIFKMSCEWVEQYKDVMQYQDQDILNGLFKGGVCYANSRFNFMPTNYAFMANGFASRHTDPLYLDRTNTAMPVAVSHYCGSAKPWHRDCTVWGAERFTELAGSLTTVPEEWRGKLAVPPTKRMLQRWRKKLSARFLRKIY

SEQ ID NO: 241 - DNA, 633 bp, Neisseria gonorrhoeae
atgattttcgcagacccgccttactttctttccaatgacggtttcagttgtcaaaacgggcaaatggtttccgtcaataagggcaactgggataaatccaaaggaatggcggcagatttggaattttacgaagaatggctccgactgtgttacgccttattaaaaccaaacggcacaatttgggtttgcggcacatttcataatatctatttaatcggctacctgatgcaaaccgtcggctaccatattttgaacaatattacttgggaaaaacccaatcctccccctaatttgtcctgccgtttctttacccattcgacagaaacaatcttatgggcaaagaaaaataaaaaagccaaacatacgtttcattatgaaatgatgaaagcacaaaataatggcaaacagatgaaatgtgtttggacattcgcacctccaaataaaaccgaaaaaacattcggcaaacatccgacacaaaaaccactccccttacttgaacgctgcatactatcggcttcaaatatcggagatttaatttttgacccttttatgggcagcggcacaacaggcgttgccgccttaaaacatggtcggagattttgcggttgcgaactggaagaagattttttgaat

SEQ ID NO: 242 - protein, 211 aa, Neisseria gonorrhoeae
MIFADPPYFLSNDGFSCQNGQMVSVNKGNWDKSKGMAADLEFYEEWLRLCYALLKPNGTIWVCGTFHNIYLIGYLMQTVGYHILNNITWEKPNPPPNLSCRFFTHSTETILWAKKNKKAKHTFHYEMMKAQNNGKQMKCVWTFAPPNKTEKTFGKHPTQKPLPLLERCILSASNIGDLIFDPFMGSGTTGVAALKHGRRFCGCELEEDFLN

SEQ ID NO: 243 - DNA, 453 bp, Neisseria gonorrhoeae
atgaaatacacagccgcactcctgacttttcttttaactgcctgcatgaacccgaacgatgcgtttttccaaaaccggcgttatcaaatgccggaggcgcaattgaacggttcaaacgccgttttccattacggttattcccaaaatcccgatcatgatttattggtcgaccaagtccgcgtgccggacgcgtacagggcttcatttgcgcgggattggatagcgaaggagcaaggttaccgcaaaaacgactgcgtactggaaaaagcggaaagcgggggtgtgacgtactacacctgcgatgcggaaaaaggattcaacggcacacgtttcgtcatctatgtcgtgaatatgaaaaacgacaaaggctacgtcaaagtttaccggggcatgaataagccgaatcaggaagagttaaccaaattggttgccgatttgaataagttttaccct

SEQ ID NO: 244 - protein, 151 aa, Neisseria gonorrhoeae
MKYTAALLTFLLTACMNPNDAFFQNRRYQMPEAQLNGSNAVFHYGYSQNPDHDLLVDQVRVPDAYRASFARDWIAKEQGYRKNDCVLEKAESGGVTYYTCDAEKGFNGTRFVIYVVNMKNDKGYVKVYRGMNKPNQEELTKLVADLNKFYP

SEQ ID NO: 245 - DNA, 567 bp, Neisseria gonorrhoeae
atggaaagcaacctgcagaaaaccgagcgtttgatccgcgaaatcaaccgcctgcacgcacaatattcgcaggattattttgaaaccggcaaagtgcggaaaatcaatttgagccacacgctcaaaaacgttccgaccgaacatattttgtcttatcgccttaatttgcacgaagcagttaacgattatttagcctttgccgatacgcgcggcatagactttttctaccgcgtgaaaaccgcagaaagcatacatgataaaatcaaccgctatctggcacgcggcacccaatatccgaccaacaacatcctgaacgatattttcggcgcgcggctgatttggccgtctgaaacagtcgccgggattttagaaaaacttgacggctggaaaacagaatacggcttgaaaaactggtatttgcgcgatgccggcggctatatcggcatacacatttatttcaaaaacagcagcaatttctactatccgtgggaattgcaggtttgggatgaaaaagatgccaaagccaatattgaaaaccatatggcgtacaaacggaatttcgtgcgt

SEQ ID NO: 246 - protein, 189 aa, Neisseria gonorrhoeae
MESNLQKTERLIREINRLHAQYSQDYFETGKVRKINLSHTLKNVPTEHILSYRLNLHEAVNDYLAFADTRGIDFFYRVKTAESIHDKINRYLARGTQYPTNNILNDIFGARLIWPSETVAGILEKLDGWKTEYGLKNWYLRDAGGYIGIHIYFKNSSNFYYPWELQVWDEKDAKANIENHMAYKRNFVR

SEQ ID NO: 247 - DNA, 960 bp, Neisseria gonorrhoeae
atgcgtaacaccgtaggattggacatatccaagctgacatttgacgcaacggccatggtcggcaaaacggagcattcggcaaagtttgacaacgattcaaaaggtttagatcagttttcggaccggttgaaaagcttgggatatcagaatctgcatatctgcatggaggcaaccggcagttattatgaagaagttgccgactacttcgcgcagtattacagcgtttacgtagtgaacccgctgaaaataagcaagtatgcagaaagcaggttcaagcgaaccaaaacagacaaacaggatgcaaaactgatagcgcagtattgccggtcggcgcaggaaagcgagcttgtaaagaggcagaagcctacggacgagcaatacaggctttcacggatgaccgcagcatacgcgcaaatcaaaagcgaatgcgcggcaatgaaaaaccgtcatcacgcggcaaaagatgaagaagcggccaaagcatatgcggaaatcatcaaagccatgaatgaacagcttgaagttttaaaggagaagataaaagagcagacggagaagcctaactgcaaggaaggcgtgaagcgtcttgaaaccataccggcaataggcagaatgaccgcagccgtattgtttcatcatctaacatcttcgaaatttgaaacatcaaacaaatttgcagcattcgcaggcttaagcccgcaacaaaaagaatccgggacaagcgtaaggggaaaaggcaaactgaccaagtttggcaacaggaaattacgcgccgtcttgtttatgccggccatggtcgcataccggataagggcatttcccgacttcatcaaaaggctggaagaaaagaagaagcctaaaaaagtcatcatcgcagcattgatgcgtaaactcgccgttattgcgtatcacgtacataagaaaggcggagattacgatccatcgcgttacaaatcggcg

SEQ ID NO: 248 - protein, 320 aa, Neisseria gonorrhoeae
MRNTVGLDISKLTFDATAMVGKTEHSAKFDNDSKGLDQFSDRLKSLGYQNLHICMEATGSYYEEVADYFAQYYSVYVVNPLKISKYAESRFKRTKTDKQDAKLIAQYCRSAQESELVKRQKPTDEQYRLSRMTAAYAQIKSECAAMKNRHHAAKDEEAAKAYAEIIKAMNEQLEVLKEKIKEQTEKPNCKEGVKRLETIPAIGRMTAAVLFHHLTSSKFETSNKFAAFAGLSPQQKESGTSVRGKGKLTKFGNRKLRAVLFMPAMVAYRIRAFPDFIKRLEEKKKPKKVIIAALMRKLAVIAYHVHKKGGDYDPSRYKSA

SEQ ID NO: 249 - DNA, 1887 bp, Neisseria gonorrhoeae
atgttgcgaacctacttgaaccaattgacccctcccgaattagctgattctgttaaaaataccgttgatggttttatggaaaaattgtcacaaaccgagccgaaaatcgcccaaaatgttttattgctgggcaatgttcaaagtggcaaaacggcacaggttttgggtgtattaagtgcgctggctgatgatggcgaccacaaagtttttttgtatcttactactgacagcgtagatttacaggatcaaacagtcaaacgagccaaagccaatctgaaaaactttatcgtattgtctgaagctgacgaccgaagttttatggaagtaatgaaggcagagaaccccatcttggtcgtgattaaaaagaatgcccgtgtattgaaacgttggcgtaatttgtttgccagtcaaagtagcctgaaaggctatcctttggttattgtggacgatgaagccgatgctgccagcctaaatactaattctgataagccggctaaagatgccagtactatcaataaactgctaaacgacatcaaaaattcctgttgtcaaagcctgtttatccagttgactgccacgcctcaatcgcttttattacaacatgaagaatctgattggcaacctgaatttatccacttctttgaagcaggcgaaaaatacatcggcggcaactttgtcttttctgatccaccaagctatatagttcgttttattgatagcgaattggatgatatgaaagacgagagtggtgaaattgccgaaggagcaaaacaggcattgcttagttttctaataacctgtgcagaattcgcgctatgtgataaggctaactgtaattttgcactacatccaagctataaaattcaagatcatcaagccttttcaaagaagatccaagcctttttaaatgacttagtgcaagcagtcaataatggggaagaccttgcaggtagctttaaagaaagttatttggatttgcaaaagaccaagcccgatattcatcactttgatgaaatatacgaaaaattgacagcacttttagagaataaacaaatctctactcttgtcgttaactcgcagacagaaacagattttgacttagaaaaaggtttcaacatcattattggtggtaatgtgattggtcgtggcttgactattccgaaactacaaacggtttattatagtcgcactgccaaaaaaccgaatgcagatactttctggcaacattcgcgtatttttggatatgaccgcgataaatcattattacggctttatattccgttcgatgtctattacttctttgtacaactcaatcaagcaaataatctgattattgggcaggcaaaaaattcaggcggcaatattcaggttatttatccgaaaaatatcaatccaactcgaaaaaatgtattgaaattcgatagtatcaatcaaattgtgggtggtgtgaattattttccactccacccaaacgaagataatttatcggagattaacaaaattttgccttctattttgaaagatgaaattcaatctgatttatatcaaatagatatagaagatttattcttggttctagataaattgggtcgttatgttccagatgactggaataaggaaaaatttattgctggtgtagaagcattaaaagcacaacgtccaagttttaaaacctatgttttgatcaaaaccggacgtaaactttctcgagcaaccggcacaatgctttcggaagacgaccgtaaattaggagaaaaatatcccaatgatttattccttacgctttatcaagtagtaggaaataaagacaaaggttggcagggaaaagatttttggttacccaatatcaagctaccacacaatggcttggtgtaccaaagtgcaaaa

SEQ ID NO: 250 - protein, 629 aa, Neisseria gonorrhoeae
MLRTYLNQLTPPELADSVKNTVDGFMEKLSQTEPKIAQNVLLLGNVQSGKTAQVLGVLSALADDGDHKVFLYLTTDSVDLQDQTVKRAKANLKNFIVLSEADDRSFMEVMKAENPILVVIKKNARVLKRWRNLFASQSSLKGYPLVIVDDEADAASLNTNSDKPAKDASTINKLLNDIKNSCCQSLFIQLTATPQSLLLQHEESDWQPEFIHFFEAGEKYIGGNFVFSDPPSYIVRFIDSELDDMKDESGEIAEGAKQALLSFLITCAEFALCDKANCNFALHPSYKIQDHQAFSKKIQAFLNDLVQAVNNGEDLAGSFKESYLDLQKTKPDIHHFDEIYEKLTALLENKQISTLVVNSQTETDFDLEKGFNIIIGGNVIGRGLTIPKLQTVYYSRTAKKPNADTFWQHSRIFGYDRDKSLLRLYIPFDVYYFFVQLNQANNLIIGQAKNSGGNIQVIYPKNINPTRKNVLKFDSINQIVGGVNYFPLHPNEDNLSEINKILPSILKDEIQSDLYQIDIEDLFLVLDKLGRYVPDDWNKEKFIAGVEALKAQRPSFKTYVLIKTGRKLSRATGTMLSEDDRKLGEKYPNDLFLTLYQVVGNKDKGWQGKDFWLPNIKLPHNGLVYQSAK

SEQ ID NO: 251 - DNA, 1035 bp, Neisseria gonorrhoeae
atgaatacagttttttccaatatcgccaatgccaaaatcactgaaaaatctcttaatgcggtttggatggatttatttaaatcagcggatgaagtgttgatggcgacaggttatgtatctaatgacgcagtggttgagttacataaaattttggagctaaacgatcatattcaaaaaatagatttattggtcggaatgcattatttggaaggttttagccatttacaatatgacagcttatgtaaactaaatgattttttgcgacatgagaaaagaggagccgtctatgtttccccctttgtgaaatttcacggcaaaatgtattcctttaaaaattatcaaaaaatcaatggattaattggttctgctaacttaacgtgtttttgggatagcacggaacgtacttatgaaactatgttgcatttgaacggtaagcctgcacagattttgcaggcagatattcaaagtactattcataagctaggcaaaaatatccaagaagttgaaagaccaagtaaatttattgaacataatagccatttagaaaattgtttgggtgttcagaaaattgcaccagaacagattcggcaattatttgcccaaacgtcagaatatcatttctcaattccagctaaaaccgaagaaaaaagtaatttgaatgtattttttggagaaggtcgacgagataaacgagggtttgtcaaaccacgaccttggtatgaagtagagttgattgtatccaaagacatcacttcacaagaagggtatccggttctgaagtcttttacagttattaccgatgatggttggcaatttcaatgcaagacatcgggggattactccaaaaacttccgctcagaaaatgatttaaagacacttggtaaatggattaaaggtcgtttggaaagtcatggctgcctgcaaaataacgagaagattacgcatgaaaccctacgcgaatacggtaacgatcattttgagttacgttcaaccgataatcctgatgtttggctgctctcatttaaggggaaaaac

SEQ ID NO: 252 - protein, 345 aa, Neisseria gonorrhoeae
MNTVFSNIANAKITEKSLNAVWMDLFKSADEVLMATGYVSNDAVVELHKILELNDHIQKIDLLVGMHYLEGFSHLQYDSLCKLNDFLRHEKRGAVYVSPFVKFHGKMYSFKNYQKINGLIGSANLTCFWDSTERTYETMLHLNGKPAQILQADIQSTIHKLGKNIQEVERPSKFIEHNSHLENCLGVQKIAPEQIRQLFAQTSEYHFSIPAKTEEKSNLNVFFGEGRRDKRGFVKPRPWYEVELIVSKDITSQEGYPVLKSFTVITDDGWQFQCKTSGDYSKNFRSENDLKTLGKWIKGRLESHGCLQNNEKITHETLREYGNDHFELRSTDNPDVWLLSFKGKN

SEQ ID NO: 253 - DNA, 849 bp, Neisseria gonorrhoeae
atgacaacagaaaataacgcttttgaaaacgccaaacacatcgacgaaacaggcaatgaatattggtcggcgcgcaccttgcagcaaatcttggaatattccgaatggcgcaatttccaacgggccattgataaagccataaccgcttgcgaaacatcaggaaatgacaaaaatcatcattttgttgaaaccaacaaaatgatagcccttgggaaaggcgggcagcgcgaagtggcggattaccgcctttcccgctatgcctgctacctgattgtgcaaaacggcgatccgtccaaaagcgtcattgccgcagggcaaacctactttgccgtgcaagcccgccgccaagagctgcaagacgaggcagcattcaggagtttgggcgaagacaaacaacgcctgctgcttcgcaggcagctgcgcgaacacaataccgaccttgccgccgcagccaaggatgcaggcgtagaaaaacccgttgagtacgccgtcttccaaaaccacggctatcgggggctatacggaggactggacaagcagggcatacacagccgcaaaggcttgaagaaaagccagagaatcctagaccacatgaacgccagcgaaccggctgccaatctgtttcgcgccacgcaaaccgaagaaaaactacgccgcaaaaacatccaaggcaaaacacaggcaaaccgggtgcatttcgaagtcggacaaaaagtgcgccaaaccattgaagaactgggcggcatcatgcctgaaaaccagcccgtacccgagaaaagcatcaaacagcttgagaacgaagaacagaaaaggcttgccgcaaccgaacagcatcaaaacggcaaaaaa

SEQ ID NO: 254 - protein, 283 aa, Neisseria gonorrhoeae
MTTENNAFENAKHIDETGNEYWSARTLQQILEYSEWRNFQRAIDKAITACETSGNDKNHHFVETNKMIALGKGGQREVADYRLSRYACYLIVQNGDPSKSVIAAGQTYFAVQARRQELQDEAAFRSLGEDKQRLLLRRQLREHNTDLAAAAKDAGVEKPVEYAVFQNHGYRGLYGGLDKQGIHSRKGLKKSQRILDHMNASEPAANLFRATQTEEKLRRKNIQGKTQANRVHFEVGQKVRQTIEELGGIMPENQPVPEKSIKQLENEEQKRLAATEQHQNGKK

SEQ ID NO: 255 - DNA, 306 bp, Neisseria gonorrhoeae
atgaaagatttattgtcgtccccatcattcctgctgttttcctgtatgcttgccgttacctgccctacccggttaatcggctttttcgcactgcgtaaccgaaccttaagccgccgcgcccaaaccgttatggaagccgcgccgggctgcgtcctcatttccgtcattgccccctattttgtatccgacaagccgcacgaacttattgccatcgcgttaaccgcctttgcggcctgccgtttttctatgttgtttaccgtattgataggggtcggctcgtcaggcatctcgggatggttgatggca

SEQ ID NO: 256 - protein, 102 aa, Neisseria gonorrhoeae
MKDLLSSPSFLLFSCMLAVTCPTRLIGFFALRNRTLSRRAQTVMEAAPGCVLISVIAPYFVSDKPHELIAIALTAFAACRFSMLFTVLIGVGSSGISGWLMA

SEQ ID NO: 257 - DNA, 681 bp, Neisseria gonorrhoeae
atggataaagagaaagtcttagacaaaatcaagaaatgtttggctttgggtcggtcggtaaatgaacatgaagccgcacaggcgttaaggcaggcgcaggctttaatggaaaagtacaaagtaaatgccgaggatatcgccttatcaaaagtctccgaacagaaagccgatcggaaaatggcttttaaattggcaggctggcaatggggcgttgcaaatatgattgccgatatattcgggtgcaaatcttaccaacgcgggaaaacaatgatgttttacggcattggaaatcgagcggaaacctcagcctatgcctttgatgtagtctatcgtcagatttccgccgaccgccgcaaatttttgaaaacctgccgggcgggaaagccctcgcacagaacttatcttgccgaccgattttgcggcggttggattgcgagcgcttgggaaacagtcaaaaaatttgagatgtcagatgaagaaaaagccattatggacggatacaaaaagaaagaatatccggatatggccgaagcaaggacaagagatgcgaaatcgtcaatcctacaagggtcaaaaatggaatatgaggcattaacccgaggaatggaatcgggtaagcaagtgaagttacactatgccgtgaacggtacgggcttcgtaaaacaaatcggagggcaaaca

SEQ ID NO: 258 - protein, 227 aa, Neisseria gonorrhoeae
MDKEKVLDKIKKCLALGRSVNEHEAAQALRQAQALMEKYKVNAEDIALSKVSEQKADRKMAFKLAGWQWGVANMIADIFGCKSYQRGKTMMFYGIGNRAETSAYAFDVVYRQISADRRKFLKTCRAGKPSHRTYLADRFCGGWIASAWETVKKFEMSDEEKAIMDGYKKKEYPDMAEARTRDAKSSILQGSKMEYEALTRGMESGKQVKLHYAVNGTGFVKQIGGQT

SEQ ID NO: 259 - DNA, 474 bp, Neisseria gonorrhoeae
atggaagcaaataaatttgaagtgaaaagtttgtcagaccttataaaagtctttgcaggcattgctgccgatttcgaagcggcaatgggtgtaaaacgcgccgacatttcaaccgaatttgacgaaccgcaacatgagccgcaaccgccggtaacagttgccgagcaaaaaggtatcaacgactttgccatcggcaaggaagtcatcatccgcacttattcggcaggcgtttggtttggtgtgttgaaacaaaaagcaggcaatgaagtgattctgacaaaagcgcgccgaatgtacagctggtgggcaaaggaatcaatcagcctgtcaggtgtcgcacgacacggcatcaggcaagacggcagccaaatttgcggcgagcttgattccgtatggctcgaggcgattgagattatcccagtaacaggcggcgcggctgaatcaatccgcaccgcgctggaggtcgcccagtca

SEQ ID NO: 260 - protein, 158 aa, Neisseria gonorrhoeae
MEANKFEVKSLSDLIKVFAGIAADFEAAMGVKRADISTEFDEPQHEPQPPVTVAEQKGINDFAIGKEVIIRTYSAGVWFGVLKQKAGNEVILTKARRMYSWWAKESISLSGVARHGIRQDGSQICGELDSVWLEAIEIIPVTGGAAESIRTALEVAQS

SEQ ID NO: 261 - DNA, 411 bp, Neisseria gonorrhoeae
atgattcacttaaatgtccactattgcgatgaaattatccgccatgcggaaaatgacaaatacagcctgataggtatattccccgatatatgccatattccgacaccgcaggccattctaggccgcctgtgcctgtctgtttcattttccgccgaaggcatggatatacagactatgaaaaccggtcaaatttttctggaaatcgtccgcaacgatgatgtaatctctgcacttgagattccatcatatgacggcagtgatacagaagaaaacgtgtcattcatgctacaccaaacaatcagcggactacccgtttcagacaacgaccgcatttatgtaagaatgacaacacacaaccatattctctccgagagccgtcctttgtctttttcttggcttccttaccactca

SEQ ID NO: 262 - protein, 137 aa, Neisseria gonorrhoeae
MIHLNVHYCDEIIRHAENDKYSLIGIFPDICHIPTPQAILGRLCLSVSFSAEGMDIQTMKTGQIFLEIVRNDDVISALEIPSYDGSDTEENVSFMLHQTISGLPVSDNDRIYVRMTTHNHILSESRPLSFSWLPYHS

SEQ ID NO: 263 - DNA, 435 bp, Neisseria gonorrhoeae
atggagctgaccgtccactttaacgccgagcaggatttagaccgcctctttgaaaaagacgaagaagcggtcggttatctcgagaatgtcattgcgatgattcaggcggactctgctatttttgacggcttatacaaaaacagatacttcagggaatatggcgaacccataggcccgattgacttggaagtgaaacccatattgtcattatggggaaaagacatcaaagttttacgcgtccgatttgacagcgaagaagccgccggatacagaataatttacgcaccatgccatgaaaaacagccaaacggcacgtatatccgccgcatagatatattggctgttgtaaacaagaagacagacgaatttgactatcaggcagaacacccaatcacaaaacggattatcaaagactatgaagaactgtactccaac

SEQ ID NO: 264 - protein, 145 aa, Neisseria gonorrhoeae
MELTVHFNAEQDLDRLFEKDEEAVGYLENVIAMIQADSAIFDGLYKNRYFREYGEPIGPIDLEVKPILSLWGKDIKVLRVRFDSEEAAGYRIIYAPCHEKQPNGTYIRRIDILAVVNKKTDEFDYQAEHPITKRIIKDYEELYSN

SEQ ID NO: 265 - DNA, 405 bp, Neisseria gonorrhoeae
atgaatcaacaagaatttgaatttatgaacgacttggcgcgtgcttttgagcgtcgttaccgtgatacgcgcagcctaaatagatgtttcagtatcgaaggccgttatatgggggaggaagcttgcccgcataagcctgaaatcggcttgagatacggcgaagatgccatgtttcttactttacaggcatgggcgaaggtggatgcgccgcaacaagaggccgtccgtatttcgttcggcatcggtgcgaagtcgcaggcagcctacgaggaacgtttgcaggctgaaatcaggcggcgcggcgaggggcccctgcatttgcagacggatttgggcttggccgcgtggtatagggcgatacggcaggcggcagggaatgattttgatttgctgtttgagaaggtt

SEQ ID NO: 266 - protein, 135 aa, Neisseria gonorrhoeae
MNQQEFEFMNDLARAFERRYRDTRSLNRCFSIEGRYMGEEACPHKPEIGLRYGEDAMFLTLQAWAKVDAPQQEAVRISFGIGAKSQAAYEERLQAEIRRRGEGPLHLQTDLGLAAWYRAIRQAAGNDFDLLFEKV

SEQ ID NO: 267 - DNA, 504 bp, Neisseria gonorrhoeae
atgagtaaagctattaacaagttaaatgaaaaggaaaaggaaaaaatacgcctgcttttcgcacaaagagaaaaattttatcgtatcttggaaaatccggaacagggatttactcctcctaccgctcttttaaaaagtggcgaaacttgttttttgattgattatgttaatatgggcgaggtggttactgagagggtcagaacctatacagggacacgtttaaaacttggctccacaccggtttatttagggggcgggaaatccgtagcaaatgaaaaacagaagaatgttgcgtacggagagttggtattgacgaatttcaggttgatttttgtagggaatatgagaagtatagatttgccgctggataaaataaacagcgtggaatgttttcaaagcagcatccgaatcagccaaagcggcaaaaacaaaccgattttctttaataccgtttttaatccgcagttatggaaagaggctatattggtactttccgataagaag

SEQ ID NO: 268 - protein, 168 aa, Neisseria gonorrhoeae
MSKAINKLNEKEKEKIRLLFAQREKFYRILENPEQGFTPPTALLKSGETCFLIDYVNMGEVVTERVRTYTGTRLKLGSTPVYLGGGKSVANEKQKNVAYGELVLTNFRLIFVGNMRSIDLPLDKINSVECFQSSIRISQSGKNKPIFFNTVFNPQLWKEAILVLSDKK

SEQ ID NO: 269 - DNA, 447 bp, Neisseria gonorrhoeae
atgagcggcacgaaacgcaaattaggccgtccgacagattacacgaaagacatggccgataagatatgcgaaaaaatcgcaaatggcagaagcctacgttcaatatgcgccgaagatggtgtgccgccaatgaaaactatttaccgttggttggaagctaatgaagaatttcgccaccaatacgcgcgcgcgagagaaaagcaggcggactatttcgctgaagaaatcatcgagattgccgatagtgcacaagcagagagcgcggcggtttcaaaggcgaaattgcagatagatgcccgaaagtgggcggcttccaagattgcgccgaagaaatacggcgacaaatcggagcttgacgttaaatcgggcgatgggagcatgagggcggctgtacggcttgatgctgaggaatatcgcaagatagcggaagatgtgttgcgtagggtt

SEQ ID NO: 270 - protein, 149 aa, Neisseria gonorrhoeae
MSGTKRKLGRPTDYTKDMADKICEKIANGRSLRSICAEDGVPPMKTIYRWLEANEEFRHQYARAREKQADYFAEEIIEIADSAQAESAAVSKAKLQIDARKWAASKIAPKKYGDKSELDVKSGDGSMRAAVRLDAEEYRKIAEDVLRRV

SEQ ID NO: 271 - DNA, 597 bp, Neisseria gonorrhoeae
atgggcaatgcggttttccccgagttccccggcttgaagtgggggcggaagaaaacggcggtatggagtacggggacgcagaaatcggcaagcggccgtgagttccgaaccgcctactacacctacccgcaatggcggttttcgctgtcgttcgaggtattgcggacaaaagcgtccgtaaacgagttggaaaaactggcgggattcttcaacgcccgcaaaggcagctttgaaagtttcctttacgaagacccggccgacaacgccgtaaccgaccagcctgtcggaaacacggtgcagggcgttgcgcgttatcagcttgtccgttcgatgggcggatttatcgagcctgtgtcggcggtcaaggaacggcccgccgtcaaggtcggcggcacggcgttggcgtacgggcgcgattacaccgttaccgacaagggcgttttggttttcaacacgccgcaaccgccgggccgcccgattacatggacgggcggcttttatttccgcgtgaggtttacgtctgacacggtggattttgaaaacgttttgggcagcttgtgggcggccaaaaagattgagtttacgagtgtgaaacta

SEQ ID NO: 272 - protein, 199 aa, Neisseria gonorrhoeae
MGNAVFPEFPGLKWGRKKTAVWSTGTQKSASGREFRTAYYTYPQWRFSLSFEVLRTKASVNELEKLAGFFNARKGSFESFLYEDPADNAVTDQPVGNTVQGVARYQLVRSMGGFIEPVSAVKERPAVKVGGTALAYGRDYTVTDKGVLVFNTPQPPGRPITWTGGFYFRVRFTSDTVDFENVLGSLWAAKKIEFTSVKL

SEQ ID NO: 273 - DNA, 429 bp, Neisseria gonorrhoeae
atgccgtccgaaacggatttgagggcgcggatcgtcgaagaggcgcggtcgtggcttggcacgccgtaccatcatcatgcaatggtcaagggcgcgggtgttgattgcgcgatgctcctggtcgccgtctacggggcggtcggactgcttcccgaagggttcgacccgcgcccttaccctcaagattggcatctgcaccgcgattgcgagcgttatttggggttcgtcacgcaattttgccgtgaaacggaatcgccgcaggcgggcgacattgcagtatggcgtttcgggcggtcgttttcgcacggcggcatattggcgggcggcggcaaggttattcacagctacatcgggcgcggcgtggtgtcggacgacatcggccaagccgaacttatcgggcgcggggttcggttttttacattttcattt

SEQ ID NO: 274 - protein, 143 aa, Neisseria gonorrhoeae
MPSETDLRARIVEEARSWLGTPYHHHAMVKGAGVDCAMLLVAVYGAVGLLPEGFDPRPYPQDWHLHRDCERYLGFVTQFCRETESPQAGDIAVWRFGRSFSHGGILAGGGKVIHSYIGRGVVSDDIGQAELIGRGVRFFTFSF

SEQ ID NO: 275 - DNA, 756 bp, Neisseria gonorrhoeae
atgcctcgtttcccccgcactttaccccgcctgaccgctgtcctgctgttggcctgtaccgctttctccgccgccgcacacggcaatcacacccattggggctataccggacacgactctcccgaaagctggggcaatctgtcagaagaattccgtttgtgctccaccggcaaaaaccaatctccggtaaacattaccgaaaccgtttccggcaaactgcccgccatcaaagtcaattacaaaccgagtatggttgacgtggaaaacaacggccacaccattcaggtcaattatcccgaaggcggcaataccctgaccgtgaacggccgcacctataccctgaaacagttccacttccacgtgccgagcgaaaaccaaatcaaaggccgcactttcccgatggaagctcacttcgtccacttagacgaaaacaaacagcctttagtattagccgtgctgtatgaagccggcaaaaccaacggccgcctgtcttccatctggaacgtcatgccgatgaccgcaggaaaagtgaaactcaaccaaccgttcgacgcatccaccctactgccgaaacggttgaaatactaccgctttgccggttcgctgaccacgccgccgtgcacagagggcgtatcatggttggtgttgaaaacttatgaccacatcgaccaagcgcaagcggaaaaattcacccgcgccgtcggttcggaaaacaaccgccccgtacagcctctgaatgcacgtgtagttattgaa

SEQ ID NO: 276 - protein, 252 aa, Neisseria gonorrhoeae
MPRFPRTLPRLTAVLLLACTAFSAAAHGNHTHWGYTGHDSPESWGNLSEEFRLCSTGKNQSPVNITETVSGKLPAIKVNYKPSMVDVENNGHTIQVNYPEGGNTLTVNGRTYTLKQFHFHVPSENQIKGRTFPMEAHFVHLDENKQPLVLAVLYEAGKTNGRLSSIWNVMPMTAGKVKLNQPFDASTLLPKRLKYYRFAGSLTTPPCTEGVSWLVLKTYDHIDQAQAEKFTRAVGSENNRPVQPLNARVVIE

SEQ ID NO: 277 - DNA, 543 bp, Neisseria gonorrhoeae
ttgaagactgatactgccagaatgaacaatctgattcccgaacatttagccgcctatgcacatagtgataacctgcaaattgaaggcgggcatcgttgcttttcattatcctgccaaggtagagatactttccacatccgttactatggagagccttttgatggattgattaccgatactgataaggcgccggtaaaaattgtggcggtagaagctgtaagcggcgatgaaatcgtattgtttgatggggcggaacatggctataacgctatgttctgcgacaaatatagccaaaatcaaaagcaaaacagaacgttaactgatttggatgaatatacttaccgagttccgattcatctttattacaatatagactacgaagatgaatatgaagatttcgtcaattctgaaggacaagtccccttaattgatggccgcatcattagttttgactcattaaaacgaaatggctttgatgcaatcagcattgatctaattgatgaaaaacactctgttcgtgaattattgaatgaagaattaagc

SEQ ID NO: 278 - protein, 181 aa, Neisseria gonorrhoeae
LKTDTARMNNLIPEHLAAYAHSDNLQIEGGHRCFSLSCQGRDTFHIRYYGEPFDGLITDTDKAPVKIVAVEAVSGDEIVLFDGAEHGYNAMFCDKYSQNQKQNRTLTDLDEYTYRVPIHLYYNIDYEDEYEDFVNSEGQVPLIDGRIISFDSLKRNGFDAISIDLIDEKHSVRELLNEELS

SEQ ID NO: 279 - DNA, 972 bp, Neisseria gonorrhoeae
atgctcgagaatctgccctatttccagcgacatctgcctgaagaccttgccaaagtcaatgaagtcatcaaccgtgcggtgcaatccgatgtcgcactgatttcgcaaatcggtacatatatcatcagcgcgggcggcaaacgcctgcgtccgattatgacgattttggcgggtaaggcggtcggttatgatgacgagaaactgtattcgctggcagcgatggtcgagtttatccacacttccacactcctgcacgacgatgtcgtcgatgaaagcgatttgcgccgtgggcgggcaacggcaaacaatctgttcggcaatgcggcggcagtgttggttggcgactttttatatacccgtgcatttcaactgatggttgcctcgggcagtatgcgcgttttggaagtgatggcggatgcgaccaacatcattgccgagggagaggtcatgcagctgatgaacatcggcaatacggacattaccgaagaacaatatatccgagtcatccaatataaaacggcaaaattgtttgaagctgccgctcaagtcggcgcaattttgggcaaagcttcccccgggcacgaacaggccttgaaagactacggtatgtacgtcggtacggcattccagattattgacgatgtgctggattattcgggggaaaccgaagaaacaggtaaaaacgtcggcgacgatttggcggaaggaaaaccgaccctgcctttgatttatctgatgcgtcagggttccgaacaggttgcgaacgatgtgcgtactgctttggaaaatgcagatcgcggctattttgaaaaaatccgcgattatgtcgtccgttcggatgctttggcatattcgataggcgaggcgcgcaaagcagtcgattgtgccgttgccgcgttggatgccctgtccgacagcgaagtgaaggatgctatgattcagctggcgaaggaatctttggtcagggtgtcg

SEQ ID NO: 280 - protein, 396 aa, Neisseria gonorrhoeae
LMVQRVLSVNDKAFVTADLDYELPQAYYVDDPKAPPVEISAPVEAVPAAASDTASDGIAEDASAENGVSNQLWKQIWKAKQGQIVVVGIALTILLLVFLFQDWIVRYEKWYDRFRFAFLTFTLFYIGWYAQAQLSVVNTLTLFSAILTEFHWEFFLMDPIVFILWLFTAATMLLWNRGTFCGWLCPFGSLQELTNRIAKKLGVKQITVPHMLHTRLNVIKYLILFGFLAISLYDLGTAEKFAEVEPFKTAIILKFMCDWWFVAFAVALLIAGLFIERFFCRYLCPLGAGIALPGRFRVFDWLRRYKMCGNPCQICTHECPVQAIAPEGDIHPNECIQCLHCQVMYHHDTRCPQVVAENKKKQKQAAAKSGELENVSKQPQEQVVRFVKPETAQSEK

SEQ ID NO: 281 - DNA, 330 bp, Neisseria gonorrhoeae
atgaaaaacttgaaaaatatttccgttgttgctgtgtgtgccgttttgcttgctgcctgcgcttctgaaaattctgtagccaactatgctatcggcgacgattcggccgtaatcaaggctggtcgtaaccgtgccgaagcgcgaattagccgtgcggaactggcgcaacaccgccgtcaacgtaaaaatgtttctgaggagttggctttggaacgtgaaaaacgtgccaataagcatgacgcaatccgtcaaggtatgggtacggctgccggtggtctgatgctgctgaacggtgtggttggtaccgtgggtgtaatgaaaagcgtgttc

SEQ ID NO: 282 - protein, 110 aa, Neisseria gonorrhoeae
MKNLKNISVVAVCAVLLAACASENSVANYAIGDDSAVIKAGRNRAEARISRAELAQHRRQRKNVSEELALEREKRANKHDAIRQGMGTAAGGLMLLNGVVGTVGVMKSVF

SEQ ID NO: 283 - DNA, 789 bp, Neisseria gonorrhoeae
atgaaaaaagcactgcttgcactgactattgccgccatctccggtactgctatggcccagttgcccgactttctgggtaaaggcgaatataccgtccgtacagacatctccaaacaaacgctgaaaaatgccgatttgaaagaaaaacacaaagtacaaaaaaacatcggtttccgtgccgatatgccgtttgacgatattcaccacggcatgcgtttcgaagtatcacacagccgagacaaaaaagacatgtacgttgtgaccgaaagtactactaaaccattcggcaaagacgttgaagaaaaacgcaccgacgtgtatgccggttacacctacactcaaccgatcagtgaagccaccaaactgcgtgccggtttaggtttgggctatgaaaaatacaaagatgcggtagctaatgagaaaggaacagtcagcaccgagcgcgaagccttctataccaaagcgcacgccgacctgacttccgatttgggcggcggctggtatctgaatccttgggcagaggttaaggttgacctggacgccaaattgaaacacaacgcaactgtagccggtgtctcagccgacattaacgcaaaaacacgcggatggggcgtgggcgtaggtgcgaatatcggcaaacaaattaccgataccgtcggcatcgaagccggcccgttctacaaacaccgtcacttcaaagcatccggcagcttcgttttagacggcgggaacatccgagtcgatcctaccaaaatcaacgaatacggtgttcgtgtcggcgtgaaattc

SEQ ID NO: 284 - protein, 263 aa, Neisseria gonorrhoeae
MKKALLALTIAAISGTAMAQLPDFLGKGEYTVRTDISKQTLKNADLKEKHKVQKNIGFRADMPFDDIHHGMRFEVSHSRDKKDMYVVTESTTKPFGKDVEEKRTDVYAGYTYTQPISEATKLRAGLGLGYEKYKDAVANEKGTVSTEREAFYTKAHADLTSDLGGGWYLNPWAEVKVDLDAKLKHNATVAGVSADINAKTRGWGVGVGANIGKQITDTVGIEAGPFYKHRHFKASGSFVLDGGNIRVDPTKINEYGVRVGVKF

SEQ ID NO: 285 - DNA, 327 bp, Neisseria gonorrhoeae
atgttcaaacgacctgaagaaatcatcgtcctgatacttgccgtcctctggattgccggtacgtattttctcgccgccctgtttggagcggatgcttataccgtgttaaaaatcactgcccttaccctgctttggtctgccgcatcattcctcctttggcaaaaaaaacctcagccggcatatctggccgctgctgctcggctgcctgaccacctgttggtggccgtatctgaatcaatcggtcgcacccggttctttaccttggcatgcatcatggacgttcaaaaccatcttagccctgattcccgcaaccgcaggttatctgtt

SEQ ID NO: 286 - protein, 109 aa, Neisseria gonorrhoeae
MFKRPEEIIVLILAVLWIAGTYFLAALFGADAYTVLKITALTLLWSAASFLLWQKKPQPAYLAAAARLPDHLLVAVSESIGRTRFFTLACIMDVQNHLSPDSRNRRLSV

SEQ ID NO: 287 - DNA, 420 bp, Neisseria gonorrhoeae
gtgatgattttgctggacacgaatgtgatttccgaacctttgcgcccacaacccaatgaacgtgtggtggcatggttggatagtttgatattggaagatgtgtatttgtctgccattactgttgcagaattgcgtttgggtgtggcgttgttgctcaatggcaagaaaaagaatgtgctgcacgaacgtttggaacaatccattttgcctttatttgcggggcggattctgccttttgatgaaccggttgccgcaatctatgcgcaaattcgttcctatgccaaaacacatggcaaagagattgctgccgcagacggctatattgccgccactgcaaaacagcacagtttgacagttgctacgcgtgataccggctcattttttgcggccgatgtcgcggtgttcaatccgtggcacgat

SEQ ID NO: 288 - protein, 140 aa, Neisseria gonorrhoeae
VMILLDTNVISEPLRPQPNERVVAWLDSLILEDVYLSAITVAELRLGVALLLNGKKKNVLHERLEQSILPLFAGRILPFDEPVAAIYAQIRSYAKTHGKEIAAADGYIAATAKQHSLTVATRDTGSFFAADVAVFNPWHD

SEQ ID NO: 289 - DNA, 663 bp, Neisseria gonorrhoeae
ttgaaaaagccgtggtgccaagggggcaggggattcattatgaggtgctttatgttttcgactgtgattactgctgctgttttatatattgctacagcagtagatttgttggtaatactattaatattttttgctagagcaaatactagaaaagaatatcgagatatttatatcggacaatatttaggttctgtaattttaatattagttagtttatttctagcttttgttttgaattatgttccggaaaaatgggtgttgggtttattaggtttaataccgatttacttaggtattaaagttgctatttacgacgattgtgagggcgaaaaaagagctaaaaaagaattggatgaaaaagggttgtcaaaattagtcggtattgttgctttggttacagttgctagttgtggtgcagataatattggactttttgttccttactttgtgactttagatcttgtcgacttattagttactcttcttgtatttttaatattgatttttgttttagtatatacagcacaaagattggctaatatttcaggtgttggtgaaattgtagagaagtttagtcgttggataatggctgttatttatattggtttagggttatttattattattgaaaataatacaattcgaacaataatatcaataata

SEQ ID NO: 290 - protein, 221 aa, Neisseria gonorrhoeae
LKKPWCQGGRGFIMRCFMFSTVITAAVLYIATAVDLLVILLIFFARANTRKEYRDIYIGQYLGSVILILVSLFLAFVLNYVPEKWVLGLLGLIPIYLGIKVAIYDDCEGEKRAKKELDEKGLSKLVGIVALVTVASCGADNIGLFVPYFVTLDLVDLLVTLLVFLILIFVLVYTAQRLANISGVGEIVEKFSRWIMAVIYIGLGLFIIIENNTIRTIISII

SEQ ID NO: 291 - DNA, 483 bp, Neisseria gonorrhoeae
atgaccgcacttttaaccgaaacccaaagggaaaatcaggatacgcgcctgattcccctttccgccctgcaacactacgccttctgcccgcgtcaatgtgctttgattcacaacgaacaggcgtgggcggagaactatttgaccgcgcaaggcaaagcgttacatgagcgggtggattcggacgagccggaaacgtgcaagggcgtgcgctttgagtggacagtgcatgttttggcggataagctgggcatcagcggcatattggatttggtggaagtggatacaaaaacaggccgtctgaaacctgtggaatacaaacgaggcaagcccaaacctgacccgggggatgaaatccagctttgcgcccaaggcttgtgcttggaagaaatgacggggcaaaccgtctctgagggcgcgctgtggtatatgcaaacccgccaccgtgtccccgtcgtgttttcagacggcctgagacctttgcaa

SEQ ID NO: 292 - protein, 161 aa, Neisseria gonorrhoeae
MTALLTETQRENQDTRLIPLSALQHYAFCPRQCALIHNEQAWAENYLTAQGKALHERVDSDEPETCKGVRFEWTVHVLADKLGISGILDLVEVDTKTGRLKPVEYKRGKPKPDPGDEIQLCAQGLCLEEMTGQTVSEGALWYMQTRHRVPVVFSDGLRPLQ

SEQ ID NO: 293 - DNA, 372 bp, Neisseria gonorrhoeae
atgagtgatattgatgatttcaaaagctatttagaaagccaccaagcggcattttccgcttggggtagatttgtggctgaagaaattcaaaatcaattatccaatgtcatttctcctgttccggttgccaattttctaaaaattgaagcaaagcctggagtcaaagagatttcttcagctctagccaagattggccgaaaaaattacacttcacctcaaactcaaatgactgacttggtcggcgtacgttttgtggcattgcttgcggaacatattcaaatagtttgtgaaatcattgaatcctcatctcagtggaatgctaaagtttcgaaagattttgcagatgaaattcagcaaaatcccaaagcaatt

SEQ ID NO: 294 - protein, 124 aa, Neisseria gonorrhoeae
MSDIDDFKSYLESHQAAFSAWGRFVAEEIQNQLSNVISPVPVANFLKIEAKPGVKEISSALAKIGRKNYTSPQTQMTDLVGVRFVALLAEHIQIVCEIIESSSQWNAKVSKDFADEIQQNPKAI

SEQ ID NO: 295 - DNA, 318 bp, Neisseria gonorrhoeae
atgaaaactgttccaaccatcctgaccggcatccttttggcaaccgcccttcccgcatccgcacacggtatgcataagagcaaacccctggctatggacgagctgccgccgatttgccaacaatatttcaaacgcgccgaaacctgttacaacaaagccggaaacaaagcagatttcgcacgcaacaacaccaaattcctattccaagccctacctgccgccgatttgggacagcgtaagcaaatgtgccaaatcgctatggattcgtttgcagaaaaaaacccgcaatctgaattgcgaataaagccgcatcagcaa

SEQ ID NO: 296 - protein, 106 aa, Neisseria gonorrhoeae
MKTVPTILTGILLATALPASAHGMHKSKPLAMDELPPICQQYFKRAETCYNKAGNKADFARNNTKFLFQALPAADLGQRKQMCQIAMDSFAEKNPQSELRIKPHQQ

SEQ ID NO: 297 - DNA, 1419 bp, Neisseria gonorrhoeae
ttgctcaaccctcttctcacccttctcattctcataaatgattttaccgccggccgttttctgaccgttcggcttaaagcccaacgccgcataacgcttctcgcgctctcccgcaaactccacatccaaaggcttgcccgtccgcaaatcgacaatcccctcgcgcttcgccgtcaagcccgtatccgggtcggcaacctcataactgacagtcttgaacacattcgggtcaaagcccttctccccttgccgctcaaacttcccgttaagcgcatcaatctgccgcgcaatctccccgcgctgcccgtccgacttcgcaaaaccataagcccgcgtcaaatcggcgatgcgcttcctatcctcaagctccagcgcatccgcctcacgcttcatctcaaacccctgccgcttcatccccagctcggcctgctgcacatcaaacgccctgtccgcattcctctgcgccatctcgcggttcaacgcaccctcgttcgccttaaccgccgcatcaaaccgccccttctgcaacaccgcctcacggttcgccgcattctccgccgcagccgccgccagcctttccctgcccaattccctgaccgccgcatttttattatgttccgccacaatcccgcgcgccgcattaagctgtgccgccgtcaactgaccgttcaaggcccccgcataaggcgtagtcgccctcttataaagctcccgctcctcaggcgacagcgcatccggcccggcagacaccaaaggacgctgcgcgtcaaaatcacgcaccggcttgccgccccgatacacattcccgtcaaatcccaaaggcggcggcgtccgtccgcccgcatccgtcgggcgcgtatcgcgccgcgcgaaatccgccccggcccgcgcatcgggggaaagcgccttatcgccgcccgaaaaccccaaaccggcatccgcaccccgttcgaaagcacccgcccggcgcaaccgccgcgccccatcctcaatattgttacggctcaaatccatcacattccgataacgcgccggcccggcctcataattcgcaacggtacgccgcaccgcatcggcacggtgcgcctgtgccgccgcccgctcccgctcctccgcccccttccgggccttctctttttcctccttttccttcatctcccaaaaatccccggcagacggctcaaacaaacccatcgcaaaccctccgaacaaataaagtccaaaataagcaaaaacccaagcccaatcaaacgcctaaagttaagaacaaacaaaaatcgcaaccccggaccaattaacaaacaacaagttacacaaaaaaaacacaccgacgggccatttccgggggcaaataaaaagccgcctttgtgcaaggcggttgcatttcagaacagtctcggctgtttacggtccggtctt

SEQ ID NO: 298 - protein, 473 aa, Neisseria gonorrhoeae
LLNPLLTLLILINDFTAGRFLTVRLKAQRRITLLALSRKLHIQRLARPQIDNPLALRRQARIRVGNLITDSLEHIRVKALLPLPLKLPVKRINLPRNLPALPVRLRKTISPRQIGDALPILKLQRIRLTLHLKPLPLHPQLGLLHIKRPVRIPLRHLAVQRTLVRLNRRIKPPLLQHRLTVRRILRRSRRQPFPAQFPDRRIFIMFRHNPARRIKLCRRQLTVQGPRIRRSRPLIKLPLLRRQRIRPGRHQRTLRVKITHRLAAPIHIPVKSQRRRRPSARIRRARIAPREIRPGPRIGGKRLIAARKPQTGIRTPFESTRPAQPPRPILNIVTAQIHHIPITRRPGLIIRNGTPHRIGTVRLCRRPLPLLRPLPGLLFFLLFLHLPKIPGRRLKQTHRKPSEQIKSKISKNPSPIKRLKLRTNKNRNPGPINKQQVTQKKHTDGPFPGANKKPPLCKAVAFQNSLGCLRSGL

SEQ ID NO: 299 - DNA, 543 bp, Neisseria gonorrhoeae
ttgggcatctatggagcatggtgttttatgggattaacacaagaggttttaaaagaattattaagatatgatgacaatacgggaaagttatattgggcggagcgtccaagaaagtatttcaatagcggtttgcattacaaatcttggaataccggattttccggcaaggaggttttcttatacaaaggcaggttggggtatttgaagttaaaaatatttaagaaacaatataatgcacatagattaatttggctttttgtttatgggaaacacgcttcttcaataggccatatcaatagggataagacagataatagaatatctaatttgagagatgttacacatgctgaaaatatgaaaaatagagggaagtttaaaaataatactagcgggcatactggggtttatttccataagccgtctaagaaatggcaagctaggattatggttaatagaaaaaataaaatattaggtttatttgaacatattgaagatgcagcgaaagcgagagaggcagcatctaaagattttggctttgtagtg

SEQ ID NO: 300 - protein, 181 aa, Neisseria gonorrhoeae
LGIYGAWCFMGLTQEVLKELLRYDDNTGKLYWAERPRKYFNSGLHYKSWNTGFSGKEVFLYKGRLGYLKLKIFKKQYNAHRLIWLFVYGKHASSIGHINRDKTDNRISNLRDVTHAENMKNRGKFKNNTSGHTGVYFHKPSKKWQARIMVNRKNKILGLFEHIEDAAKAREAASKDFGFVV

SEQ ID NO: 301 - DNA, 381 bp, Neisseria gonorrhoeae
atgaacggggcggaatttacactgacgccccaaaacaaaaagcaggttatgcggtcgatttgggacagcccggacgggtggtttgaaaacggcaaccttgaaatcacaatccgcccgcgcaagtcaaaacggagcgtcgagcagaacaggcggctatggtttttgtatcgtgaaatttcagaaaaagtttttatcgatgggagaaggtttagtcaagatgtatggcatgaatttttaaaaagaaaatttattggatgtattgaaatgcctaacgggcaattaatgggtatatcaacgacaaaattatcagttcgggaaatgtctgaatatcaagaaaagattatatcttgggcatctatggagcatggtgttttatgggat

SEQ ID NO: 302 - protein, 127 aa, Neisseria gonorrhoeae
MNGAEFTLTPQNKKQVMRSIWDSPDGWFENGNLEITIRPRKSKRSVEQNRRLWFLYREISEKVFIDGRRFSQDVWHEFLKRKFIGCIEMPNGQLMGISTTKLSVREMSEYQEKIISWASMEHGVLWD

SEQ ID NO: 303 - DNA, 630 bp, Neisseria gonorrhoeae
atgccgtcccgcgcaaggaaggggggtctattattacaaatcgtgcaaaacctgccgcaacaaggcagtccggcaaaagcgcgcggcggcgggagccggcgcgatgacggcggcaaggctgcacggatacatccgcgccgcgcacgccgcctgcccgatattgggcgccggcctgtggacgcaaccggcaggggaatgcgcgtgacgcgccttatcctgccttaccccgtatcggcaaaccgatattggcggatttggcgcaacagggcggtcaggagcgcggaggcggcggcgtataaggaaaccgtccgccgtatcgcgcaaggggcgggcgcgatgccgtccgaaggcgcggttgccgtatatgtgcggctgatacccaaagcgaacaaagacggcggcgcaaacaagacggtgatcgatttggacaacgccctgaaggttactctggacgcgcttcaaggcgttgcctatcacaacgacaggcaggtgcggcgcattgccgccgaatatggcggcgaaccggtaacgggcggcggtttggcggtggaggtgggggaattggagatggaacagacggatgcggcagacgagggttgggatttcatcggacaggagggttgggatgtc

SEQ ID NO: 304 - protein, 210 aa, Neisseria gonorrhoeae
MPSRARKGGLLLQIVQNLPQQGSPAKARGGGSRRDDGGKAARIHPRRARRLPDIGRRPVDATGRGMRVTRLILPYPVSANRYWRIWRNRAVRSAEAAAYKETVRRIAQGAGAMPSEGAVAVYVRLIPKANKDGGANKTVIDLDNALKVTLDALQGVAYHNDRQVRRIAAEYGGEPVTGGGLAVEVGELEMEQTDAADEGWDFIGQEGWDV

SEQ ID NO: 305 - DNA, 537 bp, Neisseria gonorrhoeae
atgctgaacgcgtacgacgtggcagatttcttcctttccccttttgaagaagaggacggggagcaaatctccaatctcaaacttcaaaaactcctgtattacgcacaaggctacgcccttgccatacttaaccgccccctgtttgccgaaaatatcgaacactggcagcacggtccggtagtcccctgcatttaccgcacctacaaaaaatacggcggcagcccattgcctgcggcccatatcgaaccggacaaatatgcggacgaagagttggttgtcctcaaccgtgtccgtaaagagcagggctgctacaccgcttgggcattacgcaataaaacccatcaggaagcgccgtggatacagacccggcagggcgaagtcatagggattgcgctgatgggggaatatttccgccatgcgctgccgcagacggattacaatttcaatcttgaaaaactcaaaacagccgttgaagacagctttgtcagcgtcccgcatttcaacggcgccgacgacttggaaaaatggttggagcag

SEQ ID NO: 306 - protein, 179 aa, Neisseria gonorrhoeae
MLNAYDVADFFLSPFEEEDGEQISNLKLQKLLYYAQGYALAILNRPLFAENIEHWQHGPVVPCIYRTYKKYGGSPLPAAHIEPDKYADEELVVLNRVRKEQGCYTAWALRNKTHQEAPWIQTRQGEVIGIALMGEYFRHALPQTDYNFNLEKLKTAVEDSFVSVPHFNGADDLEKWLEQ

SEQ ID NO: 307 - DNA, 870 bp, Neisseria gonorrhoeae
ttgtcggatgaaggcaggcataaacctacttccgccccaaaccgcgtttttatgatgaaaggtatggataaattgagataccaacgggattttttaaatatccgccccatttttacagccggcgaacaagaatacctgaccgaattgtccgatcggcttcctttatctgttttaacggactccgtgcgtaatattgaagaaatcggtatcgattttgtgtacagtcctgccaaattggaaggaaacacttataatcaatacgatacgcaggcattgcttaaactcgggcaaaccgcaggcgggaagttatattcggatgccgtaatgttaatcaacctgagggaaagttaccggcacctgctgtccggtttggacagccccaagccgtttgactggttggatttcttaaaaaccacccacagcctgatttcggaaaacttactggaaaaaggctccggcggcgtagtccgccgcgacagcgttactataagcgggacagactacacccctttatccaacccgcaaagtttggatacggaattgaaatggttgcttcaagaagcccccaaaatagaaaatcctttcgaccgcgccgtttatctccataataatttggcgtatctccgatattttaaggactgcaataaacgtactgccagaaactgtatgaccttgtcgctgatgcgctccggtttttttccttgcgtattctcccccgacagttatcccgcctatgccgaggctgtcgtagcctattacgaaaccggcgattacggtttattcaagaaatattttatttcggcatacgaaaataccgtaaataagtacggtccccagcctgatgtggatattttccgaaatttctccatt

SEQ ID NO: 308 - protein, 290 aa, Neisseria gonorrhoeae
LSDEGRHKPTSAPNRVFMMKGMDKLRYQRDFLNIRPIFTAGEQEYLTELSDRLPLSVLTDSVRNIEEIGIDFVYSPAKLEGNTYNQYDTQALLKLGQTAGGKLYSDAVMLINLRESYRHLLSGLDSPKPFDWLDFLKTTHSLISENLLEKGSGGVVRRDSVTISGTDYTPLSNPQSLDTELKWLLQEAPKIENPFDRAVYLHNNLAYLRYFKDCNKRTARNCMTLSLMRSGFFPCVFSPDSYPAYAEAVVAYYETGDYGLFKKYFISAYENTVNKYGPQPDVDIFRNFSI

SEQ ID NO: 309 - DNA, 753 bp, Neisseria gonorrhoeae
ttgaacaaaaatgggaacactgacatggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagctacgaactgtttgcccacatgaccgtcatcgaaaacatcctcttaggcccggtaaaggtacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactac

SEQ ID NO: 310 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSYELFAHMTVIENILLGPVKVQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 311 - DNA, 1155 bp, Neisseria gonorrhoeae
atgacgaagttatacgcgcaaatcgccaagacggaggcgcaggacgacggcacggtcaaagtttggggctatgcctcgagcgaagcggtcgattcggacggcgaagtcgtcgcggcggaagcaatgaaggcggcgattcccgattatatgaagttcggcgcggtgcgtgaaatgcacggctcaaacgcggcgggaacggcgattgaaatcaacgtggaagacgacgggcgcacatttttcggggcgcatatcgttgaccctgttgcggtgacgaaagtcaagacaggcgtttacaaaggcttttccatcggcggcagcgttaccgcccgcaatgatttgaacaagtcgcaaatcacgggcttgaagctgacggaaatcagccttgtcgaccgccctgccaatcccgacgcggtgtttacctgctttaaggcggacaaaccgaaagatgaggcaggggcggcggataaagacggcaagccgtctgacaaaccaaccgaagaggaagatgaaaatcctaaagacggcgataaagggcctaaaaccgaagataaaggcgataaggacgccggcaaaaaggacgaagccggaaaatcggcaagcgtgaatttgtccgaatctgaaatcgccgccttgaaagcggtattggctaaagccgacaagccgaaaggcgggccggccgccaaatcaatgtaccaagtcaaatcaccggctgatgtattgatgtcgctgaaatggctggttgaggacgcatcctacgacaacatcgatgaagccgttaccgcgcaaatcaaagaatcggcggccggccttgccgaatcgctgaaagcgttggcggcaagcgaagccgataagccggccgacggtttggcggccaaagccggcaaatcaggcgatcttgccaaagcggaatcggctgacgaactggcaaaggcacaagacgcgctgaaaaaatcgaatgacgcccttgccaaagcacaggcggaaatcgaaagcctgaagaaacaggcagtaccgccgaaaggcagtacgaaagctatcagtaaggcagaagataacggcgaagacccgttaaaaggttttcagccgattgtaaagaatgacggcacgctggatgacgtggcgacactcattaaggcaaaacaaacaggccgtctg

SEQ ID NO: 312 - protein, 385 aa, Neisseria gonorrhoeae
MTKLYAQIAKTEAQDDGTVKVWGYASSEAVDSDGEVVAAEAMKAAIPDYMKFGAVREMHGSNAAGTAIEINVEDDGRTFFGAHIVDPVAVTKVKTGVYKGFSIGGSVTARNDLNKSQITGLKLTEISLVDRPANPDAVFTCFKADKPKDEAGAADKDGKPSDKPTEEEDENPKDGDKGPKTEDKGDKDAGKKDEAGKSASVNLSESEIAALKAVLAKADKPKGGPAAKSMYQVKSPADVLMSLKWLVEDASYDNIDEAVTAQIKESAAGLAESLKALAASEADKPADGLAAKAGKSGDLAKAESADELAKAQDALKKSNDALAKAQAEIESLKKQAVPPKGSTKAISKAEDNGEDPLKGFQPIVKNDGTLDDVATLIKAKQTGRL

SEQ ID NO: 313 - DNA, 621 bp, Neisseria gonorrhoeae
ttgacaatcaaatcgggggggatagctgatggctatcaatgccgtctgaaaaatgtggtttggaagacgttgggggaggttgccgaatattcaaaaaaccgtatttgttcggataaactgaacgaacataattacgttggcgtggataatctcttacaaaatagagaaggtaaaaagttatccggttatgttccaagcgaaggaaaaatgacagaatatattgtcaatgacattttgattggaaatattcgtccgtatttgaaaaaaatctggcaggcagactgcacgggcggaacaaacggtgatgttttggttatccgggtaacagatgaaaaggttaatccaaaatatctgtatcaggtattggccgatgataaattttttgcttttaatatgaagcacgccaaaggtgcaaaaatgccgcgtggcagcaaagcagcgattatgcaatataaaatccccatccccccgctccccgaacaggaaaaaatcgtcgccatcctaggcaaattcgataccctgacccactccgtcagcgaaggcctgccgcacgaaatcgccctgcgccgcaaacaatacgaatattaccgcgaacagctgcttgccttccccaaggctgcc

SEQ ID NO: 314 - protein, 207 aa, Neisseria gonorrhoeae
LTIKSGGIADGYQCRLKNVVWKTLGEVAEYSKNRICSDKLNEHNYVGVDNLLQNREGKKLSGYVPSEGKMTEYIVNDILIGNIRPYLKKIWQADCTGGTNGDVLVIRVTDEKVNPKYLYQVLADDKFFAFNMKHAKGAKMPRGSKAAIMQYKIPIPPLPEQEKIVAILGKFDTLTHSVSEGLPHEIALRRKQYEYYREQLLAFPKAA

SEQ ID NO: 315 - DNA, 999 bp, Neisseria gonorrhoeae
atgctgccgcccaactgcggaacggcaaccccttatatattgcgtaacgccgtaggattggacatatccaagttgacttttgacgcaacggccattgtcggcaatgccgaatattcggcaaagtttgacaacgattcaaaaggtttagatcagttttcggaccggttgaaaagcttgggatgtcagaatctgcatatctgcatggaggcaaccggcaattattatgaagaagttgccgactacttcgcgcagtattacagcgtttacgtagtgaatccgctgaaaataagcaagtatgcagaaagcaggttcaagcgaaccaaaacagacaaacaggatgcaaaactgatagcgcagtattgccggtcggcgcaggaaagcgagcttgtaaagaggcagaagcctacggacgagcaatacaggctttcacggatgaccgcagcatacgcgcaaatcaaaagcgaatgcgcggcaatgaaaaaccgtcatcacgcggcaaaagatgaagaagcggccaaagcatatgcggaaatcatcaaagccatgaatgaacagcttgaagttttaaaggagaagataaaagagcagacggagaagcctaactgcaaggaaggcgtgaagcgtcttgaaaccataccggcaataggcagaatgaccgcagccgtattgtttcatcatctaacatcttcgaaatttgaaacatcaaacaaatttgcagcattcgcaggcttaagcccgcaacaaaaagaatccgggacaagcgtaaggggaaaaggcaaactgaccaagtttggcaacaggaaattacgcgccgtcttgtttatgccggccatggtcgcataccggataagggcatttcccgacttcatcaaaaggctggaagaaaagaagaagcctaaaaaagtcatcatcgcagcattgatgcgtaaactcgccgttattgcgtatcacgtacataagaaaggcggagattacgatccatcgcgttacaaatcggcg

SEQ ID NO: 316 - protein, 333 aa, Neisseria gonorrhoeae
MLPPNCGTATPYILRNAVGLDISKLTFDATAIVGNAEYSAKFDNDSKGLDQFSDRLKSLGCQNLHICMEATGNYYEEVADYFAQYYSVYVVNPLKISKYAESRFKRTKTDKQDAKLIAQYCRSAQESELVKRQKPTDEQYRLSRMTAAYAQIKSECAAMKNRHHAAKDEEAAKAYAEIIKAMNEQLEVLKEKIKEQTEKPNCKEGVKRLETIPAIGRMTAAVLFHHLTSSKFETSNKFAAFAGLSPQQKESGTSVRGKGKLTKFGNRKLRAVLFMPAMVAYRIRAFPDFIKRLEEKKKPKKVIIAALMRKLAVIAYHVHKKGGDYDPSRYKSA

SEQ ID NO: 317 - DNA, 1305 bp, Neisseria gonorrhoeae
gtgtgttatcttcatatttcgagggtaacatatctgctaatctggtacagccccaagaaatatgcagtagcattaggatctagttctactgccagtggagagtattcctatgcgtcgggctataattctgttgccagtggaaataaatcctatgctgcaggctatgcttctgttgccagtgcagaaggcagtgttgtaattggcgattcaaggcaagtaaaaccggaagcagatcaaggggttgcagtaggttctaaagcaacggtaaagaacaaagctaaacaaagggttgtggtaggttctgaggcaaaggtaaatgcagaacgtggtattgcgattggtaaagaagccaaagcagggggcaaaacaacgaacacactgttagatggaccggcatattatgcggacgctattgccgtcgggtatcaagcagaggctggcaaaggtggcgccatcgctttgggaaaacaagcaaaagcaacgaagcaaaatggaatggcacttggcgtagaatcagaagctgccggtgattttagtaccgccgtgggtaatgaaagcaaggcaaaggggcaaggcggcgtaggtctcggtaaccaatctaaggcagaggcagattttgcggtggctgtggggaataaggctgaagcgactaaggaaaactcacttgtcattggccgatatgcaagggcaaacggaaatcattctgtgagtttaggatctcgtagtgaaataaaagatggtgtgagcaattctgtggcaccgggttatggttcagtagctagtgagaataatgtcgtctctgttgcctataaagaaacaccacaatctacagaactttcctatagaaaaattgtaggtgttgatgatggtgtcaatgattttgatgccgtcaatgtacgccagttgaaagcgatgcaaggacaaaatatggctgagctattttcagtacgcagcgaagtgcgtggtgtggcagcgagtagtgcagccctatcggctctgactccattatcctatgatgcaaacaatcctacgcagtttatggtcggtttcggcacatacaaaggacgtcaagctatggcattaggattgtcccatttcgtcaatgaccgctttatggtaaaagtaggcggaaccttaggcggcaataagacgggacatatgatgaatgtaggcttgacttggaaatttggaacgagccaaggtgttccggctacaagtgataaggtgcttatggaacagttgatgcaagataatcgtcaattaaagccacgattggagaaattagaagcacgtctgaatgctatg

SEQ ID NO: 318 - protein, 435 aa, Neisseria gonorrhoeae
VCYLHISRVTYLLIWYSPKKYAVALGSSSTASGEYSYASGYNSVASGNKSYAAGYASVASAEGSVVIGDSRQVKPEADQGVAVGSKATVKNKAKQRVVVGSEAKVNAERGIAIGKEAKAGGKTTNTLLDGPAYYADAIAVGYQAEAGKGGAIALGKQAKATKQNGMALGVESEAAGDFSTAVGNESKAKGQGGVGLGNQSKAEADFAVAVGNKAEATKENSLVIGRYARANGNHSVSLGSRSEIKDGVSNSVAPGYGSVASENNVVSVAYKETPQSTELSYRKIVGVDDGVNDFDAVNVRQLKAMQGQNMAELFSVRSEVRGVAASSAALSALTPLSYDANNPTQFMVGFGTYKGRQAMALGLSHFVNDRFMVKVGGTLGGNKTGHMMNVGLTWKFGTSQGVPATSDKVLMEQLMQDNRQLKPRLEKLEARLNAM

SEQ ID NO: 319 - DNA, 288 bp, Neisseria gonorrhoeae
gtgtcggatgcacaccggacaggcggtaagccgggttctgtctcggacagtcattcctctaggcataccgttgccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttgcctgtgctgccaaagcagccatcggcggttttgctttctgttccactttccgtcgcgttaccgcgcccggccgt

SEQ ID NO: 320 - protein, 96 aa, Neisseria gonorrhoeae
VSDAHRTGGKPGSVSDSHSSRHTVAGMLKQPTRTLGGQRHCVLFGLAPNGVWPAAYCYQMRGAPLPHLFTLACAAKAAIGGFAFCSTFRRVTAPGR

SEQ ID NO: 321 - DNA, 135 bp, Neisseria gonorrhoeae
gtgtttttatattccgttgatgcagccctgatgagtcggacaaaatgccttttactcaataggaccggtttccgcccaagcggaaataaacggctatttcccttgcaaacagacggaatcaggcgggtatttaaa

SEQ ID NO: 322 - protein, 45 aa, Neisseria gonorrhoeae
VFLYSVDAALMSRTKCLLLNRTGFRPSGNKRLFPLQTDGIRRVFK

SEQ ID NO: 323 - DNA, 258 bp, Neisseria gonorrhoeae
atgcgccgataccgtctgaacccttcagacggcatttttccgcataatgaaaccaaaccgtttccacccgacaggacaggctttccccccccaaccggaaggcagcctgctgattgtcatttaaatacccgcctgattccgtctgtttgcaagggaaatagccgtttatttccgcttgggcggaaaccggtcctattgagtaaaaggcattttgtccgactcatcagggctgcatcaacggaatataaaaacacagcc

SEQ ID NO: 324 - protein, 86 aa, Neisseria gonorrhoeae
MRRYRLNPSDGIFPHNETKPFPPDRTGFPPPTGRQPADCHLNTRLIPSVCKGNSRLFPLGRKPVLLSKRHFVRLIRAASTEYKNTA

SEQ ID NO: 325 - DNA, 1455 bp, Neisseria gonorrhoeae
atgtcccggcatcccgcccgcaccggagaaaaaacatttttcggccaccccttccagctttccaccctcttccatatcgaattgtgggaacgtttttcattttacggaatgcagggcatcctgctgatttacctctactacaccgccgacaaaggcggcttgggcatagacaaaaccctcgcaggcggcattgtcggcgcatacagcggcagcgtgtacctgtccaccattttgggcgcgtggtttgccgaccgcgtatggggtgcggaaaaaaccctcttcctctcgggcatcgtcgtaatgctcgggcacatcgtccttgccgccgcaccgggcctgtacggccttctaatcgggctgatattcatcgcattgggcagcggcggcgtgaaatctacggccagttctatggtgggcgcattatacgaacaggacgaaatgcgcccgctgcgcgatgcgggattttccattttctacatcgccatcaatatcggcggcttcttaggccccttattgaccggactgcttcaagaaaacatcggtttccattatggtttcggcgcggcggcggtcggtatggcattcggcttgtggcgttattccttgggacgtaaaaacctgccccaccccaccgtcccccatccgctttcaaaaggacagggcaaaactgcggccgccgtcggcatcaccctcatcgccgcacttgcaaccgccatcaaaaccgggcttgtcaacctcgacaatttctccggcatcctcttatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttactgtacccgtcgcctggaaagattctatgcaaagcctgtgggtcatcctgttttccggactcatggcggcaatgtggacaaaaatggggcgcaaacaacccaaaaccccgctgaaattcgctatggcggtatttgttaccggcgcgtcgtttttgggattcgttccctttatttcctccggaacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctaccggctgctgttctacatcggcgcagccacaggcttcctgctgctcctgctcgtccccaaattgaacaaaatgctcgaaggcacagac

SEQ ID NO: 326 - protein, 485 aa, Neisseria gonorrhoeae
MSRHPARTGEKTFFGHPFQLSTLFHIELWERFSFYGMQGILLIYLYYTADKGGLGIDKTLAGGIVGAYSGSVYLSTILGAWFADRVWGAEKTLFLSGIVVMLGHIVLAAAPGLYGLLIGLIFIALGSGGVKSTASSMVGALYEQDEMRPLRDAGFSIFYIAINIGGFLGPLLTGLLQENIGFHYGFGAAAVGMAFGLWRYSLGRKNLPHPTVPHPLSKGQGKTAAAVGITLIAALATAIKTGLVNLDNFSGILLSTVILAVIAYFARLLTNPRVSSDNKRHIIAYIPLFLTICMFWAVWFQIYTVATVYFDETVNRTIGSFTVPVAWKDSMQSLWVILFSGLMAAMWTKMGRKQPKTPLKFAMAVFVTGASFLGFVPFISSGTPMPIAVFALIVLAITIGELMISPIALSISTKIAPPLFKTQMVALNFLAFSLGFTLGGVLFEKGYQAGDEIGFYRLLFYIGAATGFLLLLLVPKLNKMLEGTD

SEQ ID NO: 327 - DNA, 276 bp, Neisseria gonorrhoeae
gtgcgggcgggatgccgggacataaaggttctcctaaaagattttctctcaataccgtctgaaacggatgcggacggcggcggtgttttttgtatgaaaatatcggtttttaaccgatattttcattctttgtcaaacgacgcgctgccgtttttcgcgggcggatgtttttatatttgtttcaattcaatggattgtattttagaggacgtgttccgatacggcgcgggtaaatccttttctgtcaatggcttatccgatagggcggtttttact

SEQ ID NO: 328 - protein, 92 aa, Neisseria gonorrhoeae
VRAGCRDIKVLLKDFLSIPSETDADGGGVFCMKISVFNRYFHSLSNDALPFFAGGCFYICFNSMDCILEDVFRYGAGKSFSVNGLSDRAVFT

SEQ ID NO: 329 - DNA, 807 bp, Neisseria gonorrhoeae
ttgagtgcgagagagaatatgatgaatcccaaaatcgtgtttttcgacattgacgatacgctgtaccgcaaatatacggataccttgcgcccttccgtgaaaacggcggtggcggctttgcgcggcaaaggtatattgacggcgttggcaacggggcggtctttggcgacgattcccgaaaaggtcagggacatgatggcggaaacgggtatggatgccgtggtaacgataaacggacagtttgcgctgctgcacggtaaaactgtgcgcgaagtaccgatggataccggtttgatgggcagggtttgtgcgcatttggatggcttgggcatggattatgcgtttgtcggcggagaggggatcgccgtgtccgcgctgtcggaatgcgtgtgccgcgccttgcagcatatcgccagcgatttttttgccgataaggattatttttcaagcaaaccggtgtatcagatgctggtgtttgcggaggaaaacgaaatgccgctttggtcggatattgtggaacgggaaggcttgaaaacggtgcgctggcacgaggaagcggtcgatctgctgcctgcgggaatgtcgaaaacagacggcatcagaagcgtggttgaagcattgggtttggaaatggcagacgtgatggcgttcggcgacggtttgaacgatgtggaaatgctgtctgaagtcgggttcggcgtggcaatgggtaacggggaacaggcagcgaaagaagcggcgaaatatgtttgccccggcgttgatgaagacggcgtgttgaggggcttgcaagatttgggtgtgatt

SEQ ID NO: 330 - protein, 269 aa, Neisseria gonorrhoeae
LSARENMMNPKIVFFDIDDTLYRKYTDTLRPSVKTAVAALRGKGILTALATGRSLATIPEKVRDMMAETGMDAVVTINGQFALLHGKTVREVPMDTGLMGRVCAHLDGLGMDYAFVGGEGIAVSALSECVCRALQHIASDFFADKDYFSSKPVYQMLVFAEENEMPLWSDIVEREGLKTVRWHEEAVDLLPAGMSKTDGIRSVVEALGLEMADVMAFGDGLNDVEMLSEVGFGVAMGNGEQAAKEAAKYVCPGVDEDGVLRGLQDLGVI

SEQ ID NO: 331 - DNA, 225 bp, Neisseria gonorrhoeae
atgtccgacaagcagacgcgatttcggggcggcgggtttgacggtgaaaaagaatgtgccgccggcaatgaagtttctgcgataacgcgccataggatttttgtttgtggttggggtgttggagaaggaatggtttgttgtttaaggtttaactttgttggacctgatgtttccaaacgacattggaggccgtctgaaagcactagcttcaacgaagttaaaagt

SEQ ID NO: 332 - protein, 75 aa, Neisseria gonorrhoeae
MSDKQTRFRGGGFDGEKECAAGNEVSAITRHRIFVCGWGVGEGMVCCLRFNFVGPDVSKRHWRPSESTSFNEVKS

SEQ ID NO: 333 - DNA, 4167 bp, Neisseria gonorrhoeae
atgaccgataccacaccgacagataccgatccgaccgaaaacggcacgcgcaaaatgccgtctgaacaccgccccgccccgccggcaaaaaaacgccgcccgctgctgaagctgtcggcggcactgctgtctgtcctgattttggcagtatgtttcctcggctggatcgccggtacggaagcaggtttgcgcttcgggctgtaccaaatcccgtcctggttcggcgtaaacatttcctcccaaaacctcaaaggcacactgctcgacggcttcgacggcgacaactggtcgatagaaaccgagggggcagaccttaaaatcagccgcttccgcttcgcgtggaaaccgtccgaactgatgcgccgcagcctgcacatcaccgacatctccgccggcgacatcgccatcgtaaccaaaccgactccgcctaaagaagaacgcccgcctcaaggcctgcccgacagcatagacctgcccgccgccgtctatctcgaccgcttcgagacgggcaaaatcagcatgggcaaaacctttgacaaacaaaccgtctatctcgaacgcctcaacgcggcataccgttacgaccgtaaagggcaccgcctcgacctgaaggccgccgacacgccgtggagcagttcgtcggggtcagcctcggtcggcttgaaaaaaccgtttgccctcgataccgccatttacaccaaaggcggattcgaaggcgaaaccatacacagtacggcgcggctgagcggcagcctgaaggatgtgcgcgccgaactgacgatcgacggcggcaatatccgcctctcgggaaaatccgtcatccacccgtttgccgaatcattggataaaacattggaagaagtactggtcaaaggattcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttgggcggctttgtcatccggcaggacggcacggtgcatatcggcaatacgtccgccgccctgctcggacggggcggcatcaggctgtcgggcaaaatcgacaccgaaaaagacatccttgatttaaatataggcatcaactccgtcggcgcggaagacgtgctgcaaaccgcgttcaaaggcaggttggacggcagcatcggcatcggcggcacgaccgcctcgcccaaaatctcttggcaactcggcaccggcacggcacgcacggacggcagcctcgccatcgcaagcgaccccgcaaacgaacagcggaaactggtgttcgacaccgtcaacatctccgccggggaaggcagcctgaccgcgcaaggctatctcgagctgtttaaagaccgcctgctcaagctggacatccgttcccgcgcattcgacccttcgcgcatcgatccgcaatttccggcaggcaatatcaacggttcgattcatcttgccggtgaactggcaaaagagaaatttacgggcaaaatgcgttttttgcccggtacgttcaacggcgtgccgattgccggcagcgccgacattgtttacgagtcccgccaccttccgcgcgccgccgtcgatttgcggttggggcggaacatcgtcaaaacagacggcggcttcggcaaaaaaggcgaccggcttaacctcaatatcaccgcacccgatttatcccgtttcggtttcggactcgcggggtctttaaatgtacgcggacacctttccggcgatttggacggcggcatccgaacctttgaaaccgacctttccggcacggcgcgcaacttacacatcggcaaagcggcagacatccgttcgctcgattttaccctcaaaggctcacccggcacaagccgcccgatgcgcgccgatatcaagggcggccgcctttccctgtcgggcggcgcggcggttgtcgataccgccggcctgacgctggaaggtacgggcgcgcagcaccgcatccgcacacacgccgccatgacgctggacggcaaaccgttcaaactcgatttggacgcttcaggcggcatcaacagggaacttacccgatggaaaggcagcatcggcatcctcgacatcggcggcgcattcaacctcaagctgcaaaaccgtatgacgctcgaagccggtgcggaacacgtggcggcaagtgcggcaaattggcaggcaatgggcggcagcctcaacctgcaacacttttcttgggacaggaaaaccggcatatcggcaaaaggcggcgcacgcggcctgcacatcgccgagttgcacaatttcttcaaaccgcccttcgaacacaatctggttttaaacggcgactgggatgtcgcctacgggcacaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcggacggattaacgccgatttgggcatcggcaacgccttcggcggcaatatggcaaatacaccgctcggcggcaggattacagcctcccttcccgacttgggcgcattgaagccctttctgcccgccgccgcgcaaaacattaccggcagcctgaatgcctccgcgcaaatcggcggacgggtaggctctccgtccgtcaatgccgccgtcaacggtagcagcaactacgggaaaatcaacggcaatatcaccgtcgggcaaagccgctccttcgataccgcacctttgggcggcaggctcaacctgaccgttgccgatgccgaagcattccgcaacttcctaccggtcggacaaaccgtcaaaggcagcctgaatgccgccgtaaccctcggcggcagcatcgccgacccgcacttgggcggcagtatcaacggcgacaagctctattaccgcaaccaaacccaaggcatcatcttggacaacggctcgctgcgttcgcatattgcaggcaggaaatgggtaatcgacagcctgaaattccggcacgaagggacggcggaactctccggcacggtcagcatggaaaacagcgtgcccgatgtcgatatcggcgcggtgttcgacaaataccgcatcctgtcccgccccaaccgccgcctgacggtttccggcaacacccgcctgcgctattcgccgcaaaaaggcatatccgttaccggtatgattaaaactgatcaggggctgttcggttcgcaaaaatcctcgatgccgtccgtcggcgacgatgtcgtcgtattgggcgaagtcaagaaagaggcggcggcatcgctccccgtcaatatgaacctgactttagacctcaatgacggcatccgcttctccggctacggcgcggacgttaccataggcggcaaactgaccctgaccgcgcaaccgggcggaaatgtgcgtggggtgggcacggtccgcgtcatcaaagggcgttacaaagcatacgggcaggatttagacattaccaaaggcacagtctcctttgtcggcccgctcaacgaccccaacctgaacatccgcgccgaacgccgcctttcccccgtcggtgcgggcgtggaaatattgggcagcctcaacagcccgcgcattacgctgacggcaaacgaaccgatgagtgaaaaagacaagctctcctggctcatcctcaaccgtgccggcagcggcagcagcggcgacaatgccgccctgtccgcagccgcaggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacggcatctccagcgcggaacagtccgtcaaactgatttaccggctgacccgcgccatacaggcggttgcccgtatcggcagccgttcgtcgggcggcgagctgacatacaccatacgtttcgaccgcctcttcggttcggacaaaaaagactccgcaggaaacggcaaagggaaa

SEQ ID NO: 334 - protein, 1389 aa, Neisseria gonorrhoeae
MTDTTPTDTDPTENGTRKMPSEHRPAPPAKKRRPLLKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLAIASDPANEQRKLVFDTVNISAGEGSLTAQGYLELFKDRLLKLDIRSRAFDPSRIDPQFPAGNINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 335 - DNA, 186 bp, Neisseria gonorrhoeae
gtgtggcggatttcgattctaacactgttcggacggggcgggacgcttcagacggcataccgccgccggtatttcggaggttgcggcccgccggaaatgtatctgcttgttttaaggcattttgtttccaatccgcatatggaaaacaggctgcgtttcggaatagtgtcgaaaaataggcaggat

SEQ ID NO: 336 - protein, 62 aa, Neisseria gonorrhoeae
VWRISILTLFGRGGTLQTAYRRRYFGGCGPPEMYLLVLRHFVSNPHMENRLRFGIVSKNRQD

SEQ ID NO: 337 - DNA, 1872 bp, Neisseria gonorrhoeae
gtgttagaatcgaaatccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaagcaaaagccccgacaccgaatcagtcaaattaaaacccaaattccccgtccgcatcgacacgcaggacagtgaaatcaaagatatggtcgaagaacacctgccgctcatcacgcagcagcaggaagaggttttggataaggaacagacgggattccttgccgaagaagcaccggacaacgttaaaacaatgctccgcagcaaaggctatttcagcagcaaggtcagcctgacggaaaaagacggagcttatacggtgcacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaaggctacccgcttgccaagctcggcaacacccgggcggccgtcaaccccgataccgccaccgccgatttgaacgtcgtcgtggacagcggccgccccattgccttcggcgactttgaaatcaccggcacacagcgttaccccgaacaaaccgtctccggcctggcgcgcttccaaccgggcacgccctacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggctcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcatctggtatgtgcgcgaccgcgcgggcatcgatgccaggctgggggcggaatttctcgcagaaggccggaaaatccccggctcggatgtcgatttgggcaacagccacgccacgatgctgaccgcctcttggaaacgccagctgctcaacaacgtgctgcaccccgaaaacggccattacctcgacggcaaaatcgggacgactttgggcacattcctgtcctccaccgcgctaatccgcacctctgcccgcgcaggttatttcttcacgcccgaaaacaaaaaactcggcacgttcatcatacgcggacaagcgggttacaccgttgcacgcgacaatgccgatgtcccctcggggctgatgttccgcagcggcggcgcgtcttccgtgcgcggttacgaacttgacagcatcgggcttgccggtccgaacggatcggtcctgcccgaacgcgccctcttggtgggcagcttggaataccaactgccgtttacgcgcaccctgtccggcgcggtattccacgatatgggcgatgccgccgccaatttcaaacgtatgaagctgaaacacggttcgggactgggcgtgcgctggttcagcccgctcgcgccgttttccttcgacatcgcctacggacacagcgacaaaaaaatccgctggcacatcagcttgggaacgcgtttc

SEQ ID NO: 338 - protein, 624 aa, Neisseria gonorrhoeae
VLESKSATPMHDTRTMMIKPTALLLPALFFFPHAYAPAADLSENKAAGFALFKSKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKGYPLAKLGNTRAAVNPDTATADLNVVVDSGRPIAFGDFEITGTQRYPEQTVSGLARFQPGTPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGIWYVRDRAGIDARLGAEFLAEGRKIPGSDVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 339 - DNA, 120 bp, Neisseria gonorrhoeae
ttgcgccgaatgataaaacaaagcctgtccctgcatagggcaaatcaacgcacctcaaaacacagcttgaaaaataaaaaaacacagagaatgagttttcttttaaaatacaacattttt

SEQ ID NO: 340 - protein, 40 aa, Neisseria gonorrhoeae
LRRMIKQSLSLHRANQRTSKHSLKNKKTQRMSFLLKYNIF

SEQ ID NO: 341 - DNA, 1227 bp, Neisseria gonorrhoeae
atggcgttcggcaaatccttatttcatgcgatcggccgcgtcagcctggtcaggcagattgccgccggtttggcgttgggcatcgtaatcggttcggtttcaccgcaactgggcttggcggcaggcttgttcggcagcctgtttgtcggcgcgctcaaagcggtcgcgccggttttggtatttattttggtggcggccacaatcgcgcagcaccaaaaaggcaacaaggcgcatatcaggccgattatcgtcctttacctcatcggcacgttttccgcagccctgaccgccgtcatcgccggtatggttttcccgacgcacattgttttggcgggcgcgggcgatgtgtccgccgcgccgccttccggcattgtggaagtgttgaaatcgctgctgatgaacctggtcgccaacccgattaacgcgattgccaatgccaactatatcggcattttggcttgggctttggttttgggcgcggcgttgcggaatcacggttcggacgttacgcggcaggtcgttgccgatttggcggaagcggtttccaccgtcgtgaaatggattatccgttttgcccctttgggtattttcgggctggtgtcgtccacaatcgcggagacgggtttcggcgcgctggcgggttatgcgaagctgcttgcggtgctgttgggctgtatggcgtttatcgcgctggcggtcaatcccgccatcgtgtggtggaaaatccgccgcaacccttatccgctggtgtttacctgcctgcgcgaaagcggcgtgtatgccttctttacccgttcttccgccgccaatatccccgtgaatatggctttggcgaaaaagctggggctgcacgaagacacttattcgatttccatcccgttgggggcgaccgtcaatatgggcggcgcggcgattacgattaccgttttggctatggcggcggcgcacacccaaggcatacaggttgattttgccaccgcgctgctgttgagcctggtggcgacggtcagcgcgtgcggcgcgtccggcgtggccggcggttcgctgctgctgattccgctggcgtgcagcctgttcggcatcagcaacgatgtcgccatgcaggtggtcgccgtcggcttcatcatcggcgtgattcaggattcggcggaaacggcgttgaattcttcaaccgacgttttgtttaccgctgccgccgatttgggccgacagagaaaccgtgcggaa

SEQ ID NO: 342 - protein, 409 aa, Neisseria gonorrhoeae
MAFGKSLFHAIGRVSLVRQIAAGLALGIVIGSVSPQLGLAAGLFGSLFVGALKAVAPVLVFILVAATIAQHQKGNKAHIRPIIVLYLIGTFSAALTAVIAGMVFPTHIVLAGAGDVSAAPPSGIVEVLKSLLMNLVANPINAIANANYIGILAWALVLGAALRNHGSDVTRQVVADLAEAVSTVVKWIIRFAPLGIFGLVSSTIAETGFGALAGYAKLLAVLLGCMAFIALAVNPAIVWWKIRRNPYPLVFTCLRESGVYAFFTRSSAANIPVNMALAKKLGLHEDTYSISIPLGATVNMGGAAITITVLAMAAAHTQGIQVDFATALLLSLVATVSACGASGVAGGSLLLIPLACSLFGISNDVAMQVVAVGFIIGVIQDSAETALNSSTDVLFTAAADLGRQRNRAE

SEQ ID NO: 343 - DNA, 147 bp, Neisseria gonorrhoeae
atgccgtctgaagcccgtttggcgttcagacggcatatttttacaattttatgggcatatggcggaaacaataccggctgccttgaatatgtttcaacacacagggcgatacataaagcgtcgccctatgaaggagatgatgatgtt

SEQ ID NO: 344 - protein, 49 aa, Neisseria gonorrhoeae
MPSEARLAFRRHIFTILWAYGGNNTGCLEYVSTHRAIHKASPYEGDDDV

SEQ ID NO: 345 - DNA, 1302 bp, Neisseria gonorrhoeae
atgaaggagatgatgatgtttaaacgcagtgtgattgcaatggcttgtatttttcccctttcagcctgtgggggcggcggtggcggatcgcccgatgtcaagtcggcggacacgccgtcaaaaccggccgcccccgttgttgctgaaaatgccggggaaggggtgctgccgaaagaaaagaaagatgaggaggcagcgggcggtgcgccgcaagccgatacgcaggacgcaaccgccggagaaggcagccaagatatggcggcagtttcggcagaaaatacaggcaatggcggtgcggcaacaacggacaaccccaaaaatgaagacgcgggggcgcaaaatgatatgccgcaaaatgccgccgaatccgcaaatcaaacagggaacaaccaacccgccggttcttcagattccgcccccgcgtcaaaccctgcccctgcgaatggcggtagcgattttggaaggacgaacgtgggcaattctgttgtgattgacggaccgtcgcaaaatataacgttgacccactgtaaaggcgattcttgtaatggtgataatttattggatgaagaagcaccgtcaaaatcagaatttgaaaaattaagtgatgaagaaaaaattaagcgatataaaaaagacgagcaacgggagaattttgtcggtttggttgctgacagggtaaaaaaggatggaactaacaaatatatcatcttctatacggacaaaccacctactcgttctgcacggtcgaggaggtcgcttccggccgagattccgctgattcccgtcaatcaggccgatacgctgattgtggatggggaagcggtcagcctgacggggcattccggcaatatcttcgcgcccgaagggaattaccggtatctgacttacggggcggaaaaattgcccggcggatcgtatgccctccgtgtgcaaggcgaaccggcaaaaggcgaaatgcttgttggcacggccgtgtacaacggcgaagtgctgcatttccatatggaaaacggccgtccgtacccgtccggaggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcggcggggatgtttccggaaggttttacggcccggccggcgaggaagtggcgggaaaatacagctatcgcccgacagatgctgaaaagggcggattcggcgtgtttgccggcaaaaaagatcgggat

SEQ ID NO: 346 - protein, 434 aa, Neisseria gonorrhoeae
MKEMMMFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 347 - DNA, 108 bp, Neisseria gonorrhoeae
ttgataaatccttataaatttcccggcaaaattgaccgcgaacacgaaaaggcggataatccgcccatcttcaaacacccttcagacggcatttgcagcaatgccgtc

SEQ ID NO: 348 - protein, 36 aa, Neisseria gonorrhoeae
LINPYKFPGKIDREHEKADNPPIFKHPSDGICSNAV

SEQ ID NO: 349 - DNA, 204 bp, Neisseria gonorrhoeae
ttgatgttgatgccgcccgaagcgcaggtattcattacggcgggacgacgcgttcaaatcatcaaacaagcccccgaaaaaggcggcatcccaaaatccggcactgaaattgccgcgcgtatcggcggcattccgcagcctgccggggaaaccgtcggcagcagccggaatgtcgggtatttccgcccgcctttttcgggctgt

SEQ ID NO: 350 - protein, 68 aa, Neisseria gonorrhoeae
LMLMPPEAQVFITAGRRVQIIKQAPEKGGIPKSGTEIAARIGGIPQPAGETVGSSRNVGYFRPPFSGC

SEQ ID NO: 351 - DNA, 153 bp, Neisseria gonorrhoeae
ttgcaccgccccgattcggaaaggcgatgcctttccccaaaccggcccgaaccctgccgccccgaagagcggggttcaaggcattatctccctgctgctgccggttggaaccggcggagtgttgaaacacagccgttaaaaaaacaggccgtc

SEQ ID NO: 352 - protein, 51 aa, Neisseria gonorrhoeae
LHRPDSERRCLSPNRPEPCRPEERGSRHYLPAAAGWNRRSVETQPLKKQAV

SEQ ID NO: 353 - DNA, 348 bp, Neisseria gonorrhoeae
gtgcaacggggtgcgccttatgtgccgaaagggtttgcggcaacggtatgccgtctgaagcgggtgcgttcagacggcattgtgatgtttggggcgcgggtccggttcaaatccgcatcagttgataaacccgttgtctttcattttcttttcagaaaaatactggccgcataccagcagggcggcgaggatgatgacaaacagccctgccatagtcagtgtgattttgaagaacaattcggcttcgagaaaagaaaaccaaagttgcacaatcagcagcagcacccagccggcaaacagtccgagacaggcataaacgccgagcttaaacacggtcccgctccaaaa

SEQ ID NO: 354 - protein, 116 aa, Neisseria gonorrhoeae
VQRGAPYVPKGFAATVCRLKRVRSDGIVMFGARVRFKSASVDKPVVFHFLFRKILAAYQQGGEDDDKQPCHSQCDFEEQFGFEKRKPKLHNQQQHPAGKQSETGINAELKHGPAPK

SEQ ID NO: 355 - DNA, 165 bp, Neisseria gonorrhoeae
gtgctgctgctgattgtgcaactttggttttcttttctcgaagccgaattgttcttcaaaatcacactgactatggcagggctgtttgtcatcatcctcgccgccctgctggtatgcggccagtatttttctgaaaagaaaatgaaagacaacgggtttatcaac

SEQ ID NO: 356 - protein, 55 aa, Neisseria gonorrhoeae
VLLLIVQLWFSFLEAELFFKITLTMAGLFVIILAALLVCGQYFSEKKMKDNGFIN

SEQ ID NO: 357 - DNA, 213 bp, Neisseria gonorrhoeae
atgaaagaatacaaagtcgtcatttatcaggaaagcctgttgtccagcctgtttttcggcgcggcaaaggtcaaccccgtcaatttcagcgcgttcctcaacaaacaaacccccgaaggctggcgggtcgtaacgatggaaaaagatttgcgccgtatgctgctgtttttcaaacgcgaagcctacgtcgtcattttggagcgggaccgtgtt

SEQ ID NO: 358 - protein, 71 aa, Neisseria gonorrhoeae
MKEYKVVIYQESLLSSLFFGAAKVNPVNFSAFLNKQTPEGWRVVTMEKDLRRMLLFFKREAYVVILERDRV

SEQ ID NO: 359 - DNA, 231 bp, Neisseria gonorrhoeae
ttgtttgttgaggaacgcgctgaaattgacggggttgacctttgccgcgccgaaaaacaggctggacaacaggctttcctgataaatgacgactttgtattctttcatcgtatttccttttcggttgaaaccccgccctttggggcggtaggatcagactttatttgggagggaaccccttccaaatcaggacgatacatagggcggtgctttatgtatcgtcctgtgtgt

SEQ ID NO: 360 - protein, 77 aa, Neisseria gonorrhoeae
LFVEERAEIDGVDLCRAEKQAGQQAFLINDDFVFFHRISFSVETPPFGAVGSDFIWEGTPSKSGRYIGRCFMYRPVC

SEQ ID NO: 361 - DNA, 1332 bp, Neisseria gonorrhoeae
atgcggcgaaatttattgcttattgcccaactgcggcaataccgagccttcgcccagcgagagcaaaccgctttgcgaataaatacccagtttggcgcgggtgtcggtgatgtcgaggttgcgcatcgtgagctgtccgatgcggtcgagcggtgtgaacgccgcaccttcgactttttccatactcaggcgttcgggttggtaggtcaggttgggcgattcggtgttcagaatcgagtagtcgttgccgcgccgcagttcgagggtaacttcgccggtaacggctttggcgacccagcgttgggcggtttcgcgcaacatcaaggcttggctgtcgaaccagcggccttggtagagcaaacgtccgaggcgcaggccgttgatgcggtattgttcgatggtgtcttcgttgtggatgccggtaaccaagcgttcgtaggcgatgtggaacaatgccatgcccggggcttcgtagatgccgcgcgatttggcttcgatgatgcggttttcgatttggtcgctcatacccaagccgtggcggccgccgatgcggttggcttcgaggaagagttcgacggggtcggcgtattctttgccgttcaatgcaaccggcacgccttcttcaaagcgcacgctgacttcttcgggttcaatttcgacgttttcgtcccagaaggcaacgcccatgatgggcttaacgattttgatgcccgagttcaaaaattccaagtctttggcttcgtgggtcgcgccgagcatattggaatcggtggagtaggctttttcaaccgacattttgtagttgaagccgttggcaatcagaaattcgctcatttcgtgacggccgccgagttcgtcgataaattgctggtcgagccagggtttgtagattttcagcgcgggattggtgagcaagccgtagcggtagaaacgctcgatgtcgttgcctttgtaggtgctgccgtcgccccagatattcacatcgtcttctttcatggcggaaacgagcatggtgccggtcacggcgcggcccagaggcgtggtgttgaaataggcgatgccgccggtggaaacgtggaacgcgccgcattggatggcggcgatgccttcgtgtgccagttgtgcgcggcagtcgatcaggcgggcgttttccgcaccgtattccattgcttttttgggaatggcgttgtaatcgtcttcgtcgggctggccaaggttggcagtgtaggcataaggcagcgcgcctttgagtttcatccacaacagcgcggcagaggtatcaagaccgccggagaaggcgatgccgactttctgaccgacggggaggttttg

SEQ ID NO: 362 - protein, 444 aa, Neisseria gonorrhoeae
MRRNLLLIAQLRQYRAFAQREQTALRINTQFGAGVGDVEVAHRELSDAVERCERRTFDFFHTQAFGLVGQVGRFGVQNRVVVAAPQFEGNFAGNGFGDPALGGFAQHQGLAVEPAALVEQTSEAQAVDAVLFDGVFVVDAGNQAFVGDVEQCHARGFVDAARFGFDDAVFDLVAHTQAVAAADAVGFEEEFDGVGVFFAVQCNRHAFFKAHADFFGFNFDVFVPEGNAHDGLNDFDARVQKFQVFGFVGRAEHIGIGGVGFFNRHFVVEAVGNQKFAHFVTAAEFVDKLLVEPGFVDFQRGIGEQAVAVETLDVVAFVGAAVAPDIHIVFFHGGNEHGAGHGAAQRRGVEIGDAAGGNVERAALDGGDAFVCQLCAAVDQAGVFRTVFHCFFGNGVVIVFVGLAKVGSVGIRQRAFEFHPQQRGRGIKTAGEGDADFLTDGEVL

SEQ ID NO: 363 - DNA, 1341 bp, Neisseria gonorrhoeae
atgaaccaaaaccatactattttacaaaacctccccgtcggtcagaaagtcggcatcgccttctccggcggtcttgatacctctgccgcgctgttgtggatgaaactcaaaggcgcgctgccttatgcctacactgccaaccttggccagcccgacgaagacgattacaacgccattcccaaaaaagcaatggaatacggtgcggaaaacgcccgcctgatcgactgccgcgcacaactggcacacgaaggcatcgccgccatccaatgcggcgcgttccacgtttccaccggcggcatcgcctatttcaacaccacgcctctgggccgcgccgtgaccggcaccatgctcgtttccgccatgaaagaagacgatgtgaatatctggggcgacggcagcacctacaaaggcaacgacatcgagcgtttctaccgctacggcttgctcaccaatcccgcgctgaaaatctacaaaccctggctcgaccagcaatttatcgacgaactcggcggccgtcacgaaatgagcgaatttctgattgccaacggcttcaactacaaaatgtcggttgaaaaagcctactccaccgattccaatatgctcggcgcgacccacgaagccaaagacttggaatttttgaactcgggcatcaaaatcgttaagcccatcatgggcgttgccttctgggacgaaaacgtcgaaattgaacccgaagaagtcagcgtgcgctttgaagaaggcgtgccggttgcattgaacggcaaagaatacgccgaccccgtcgaactcttcctcgaagccaaccgcatcggcggccgccacggcttgggtatgagcgaccaaatcgaaaaccgcatcatcgaagccaaatcgcgcggcatctacgaagccccgggcatggcattgttccacatcgcctacgaacgcttggttaccggcatccacaacgaagacaccatcgaacaataccgcatcaacggcctgcgcctcggacgtttgctctaccaaggccgctggttcgacagccaagccttgatgttgcgcgaaaccgcccaacgctgggtcgccaaagccgttaccggcgaagttaccctcgaactgcggcgcggcaacgactactcgattctgaacaccgaatcgcccaacctgacctaccaacccgaacgcctgagtatggaaaaagtcgaaggtgcggcgttcacaccgctcgaccgcatcggacagctcacgatgcgcaacctcgacatcaccgacacccgcgccaaactgggtatttattcgcaaagcggtttgctctcgctgggcgaaggctcggtattgccgcagttgggcaataagcaa

SEQ ID NO: 364 - protein, 447 aa, Neisseria gonorrhoeae
MNQNHTILQNLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEIEPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEGAAFTPLDRIGQLTMRNLDITDTRAKLGIYSQSGLLSLGEGSVLPQLGNKQ

SEQ ID NO: 365 - DNA, 1353 bp, Neisseria gonorrhoeae
atgaaagcacccgaactcttattgcccgccggcggattggaaagaatgcgcgccgcctacgattacggcgcagatgccgtttacgccggcagcccgcgttactccctgcgcgcccgcaacaacgaatttgccaaactcgacgtcctcgagcaaggcattaaagaagcgcacgaacgcaacaaaaaattctttttgaccgtcaacaccctgccgcacaattccaaactcaaaaccttcgttgccgacatggagccgctgattgccatgaaacccgacgcgctgattatggcggatccgggtttgattatgaccgtgcgcgaaaaatggccggaaatgccgatccatctgtccgtacaggcgaacaccaccaactactggggcgtgaaattttggcagaacattggtgtcgaacgcatcatcctgtcacgcgaattgggcatggaagaaattgccgaaatccgccaagaatgccccgacatcgaactcgaagtcttcatccacggcgcattgtgcatcgcctactcaggccgctgcctgttgtcgggctatttcaaccaccgcgatcccaaccaaggcacctgcaccaactcctgccgttgggactacaaagtccacaacgccacggaaagcgaggcaggcgatgcccagcttctgcaaggtttcaactttgaaaaagcccaagaagaagccaaccaaaactttgaaggcatcaacggtcaaaaacgccatccctacgccgacaaagttttcctgattgaagaatccaaccgcccgggcgagatgatgccgattatggaagacgaacacggcacctacatcatgaactccaaagatcttcgcggtatcgaagtcgtcgaaaaactcgccaaaatcggtgtggacagcctcaaagtcgaaggccgtaccaagtctctctactacgtcgcccgcgtcgcccagtcctaccgcaaagcgattcacgatgccgtcgcaggccgtccgtttgattacagcctgttgagcgaactcgaaggccttgccaaccgaggctacaccagcggcttcctcgaacgccaccaaactcaggattatcaaaactacctcagcggccattccaccgccaaacaaagccaatacgtcggacacgttaccgaaatcgacgaaaatggctgggcgaccatcgaagttaaaaaccgcttcgccgtcggcgattcgctcgaaatcatccacccgagcggcaaccaaaccatcaaattggaacaaatgacccgcaaaggccaacctgtcgatgttgccccgggcaacggcattcaggtcaaaatccccaatatgcagggcaaagaaaaagccctcatcgcacgcgtgttgaacccc

SEQ ID NO: 366 - protein, 451 aa, Neisseria gonorrhoeae
MKAPELLLPAGGLERMRAAYDYGADAVYAGSPRYSLRARNNEFAKLDVLEQGIKEAHERNKKFFLTVNTLPHNSKLKTFVADMEPLIAMKPDALIMADPGLIMTVREKWPEMPIHLSVQANTTNYWGVKFWQNIGVERIILSRELGMEEIAEIRQECPDIELEVFIHGALCIAYSGRCLLSGYFNHRDPNQGTCTNSCRWDYKVHNATESEAGDAQLLQGFNFEKAQEEANQNFEGINGQKRHPYADKVFLIEESNRPGEMMPIMEDEHGTYIMNSKDLRGIEVVEKLAKIGVDSLKVEGRTKSLYYVARVAQSYRKAIHDAVAGRPFDYSLLSELEGLANRGYTSGFLERHQTQDYQNYLSGHSTAKQSQYVGHVTEIDENGWATIEVKNRFAVGDSLEIIHPSGNQTIKLEQMTRKGQPVDVAPGNGIQVKIPNMQGKEKALIARVLNP

SEQ ID NO: 367 - DNA, 219 bp, Neisseria gonorrhoeae; identical to SEQ ID NO: 115

SEQ ID NO: 368 - protein, 73 aa, Neisseria gonorrhoeae; identical to SEQ ID NO: 116

SEQ ID NO: 369 - DNA, 123 bp, Neisseria gonorrhoeae
atggttttggttcatgaaaaaatcctcgatagcttgaaaaatcaaagccattatcttataaatagaaaatattgtcagccatcatgccgtctgaacgggtattccgccgtttcaggcggtatt

SEQ ID NO: 370 - protein, 41 aa, Neisseria gonorrhoeae
MVLVHEKILDSLKNQSHYLINRKYCQPSCRLNGYSAVSGGI

SEQ ID NO: 371 - DNA, 798 bp, Neisseria gonorrhoeae
atgaacgcgttcaacctcatcatcatcggagacgaaatcttacacggcagccgccaagacaagcatttcgccttttttaaatccctgctcgaatccaaagggctgaagctcaatcaggtgcaatatctgcccgacgaacccgatttgctggtcaggcaactgcgccgcagcttttcagacggcataccgacgttcgttaccggcggcatcggcgccacgcccgacgaccgcacgcgccaaaccgcagcggctgctttggatttgcccgtcgtccgccatcctgaagccgccaagtttatcgaaggcataacccggaaacgcggcaagccgctcgattcgcccgaacacgcccaacgcctgaaaatggcggatttccccgagggcgcagagcttgtgcccaacccgttcaacaacatcgccggattttccatccgcgagcattatttcttccccggctttcctgtgatggcgcacccgatggcggaatgggttttggaaacttattatgccggccgcttcaaccaaaccgaacgcggcagccgcagcgtgtatgtgtttgagcagcccgaatcgcgcattacgccgattatagagcatatcgagcaaacttatcccggcgtgcgttcgtacagcctgcccagcgtcggttggacgcattcagacggcacgcaggtcaaaccgcacattgagttcggcatcaaagccgaaggagaagccgtcaaccttttggacgcggcgtgggcggaagtgttgcacagcttggacggattgggagcagagctgaaaaatcgggtaaac

SEQ ID NO: 372 - protein, 266 aa, Neisseria gonorrhoeae
MNAFNLIIIGDEILHGSRQDKHFAFFKSLLESKGLKLNQVQYLPDEPDLLVRQLRRSFSDGIPTFVTGGIGATPDDRTRQTAAAALDLPVVRHPEAAKFIEGITRKRGKPLDSPEHAQRLKMADFPEGAELVPNPFNNIAGFSIREHYFFPGFPVMAHPMAEWVLETYYAGRFNQTERGSRSVYVFEQPESRITPIIEHIEQTYPGVRSYSLPSVGWTHSDGTQVKPHIEFGIKAEGEAVNLLDAAWAEVLHSLDGLGAELKNRVN

SEQ ID NO: 373 - DNA, 984 bp, Neisseria gonorrhoeae
atgcaataccgaatcagaagagaaaacgaagcacccgaagcaaaaaatgcgggggaaaccttatgggagcgcgacattatgcgcgaagtgctgctgtccgcctatcgggacaggcgcagggagcggatgtggaaaaacatctggcgcgccgtcagcaccctgattctggttgccctgattgcaggcattttccgaaaagacgaagccgcattgcagttggcgggcaacacgccgcataccgcagtcgtcaacctgtacggcaaaatcggcaacggcgtagaagaccaggtcaaaaaactcaaagacgggatggaggccgcctacaaaaacccgcaggcaaaagccatcgtcatccgcgccaacagccccggcggttcgcccgtcgtctccaacaccgcttttgaagaaatacgccgtctgaaggcgcagcaccccggcatccccgtttatctcgtggcagaggatatgtgcgcgtccggctgctactacatcgcggcggcggcggacaaaatctatgccgacccgtccagcatcgtcggcagcatcggcgttatcggcagcagtttcgacgcgaccggcctgatggaaaaaatcggcgtaaaacgcagggttaaaattgcgggcagcaacaaaggcatgggcgatccgttttcgcccgaaacgcccgaacagtcgaaaatctgggaagaaatgctgaccggcatacacggcgaatttatcaaagccgtcaaaaccggacgcggcggccgcctcaaattccgacaatatcccgacgtgttcagcggtcgcgtgtacacaggcgcggacgcgctgaaagtcgggctggtggacggactcggcaatatttacagcgtggcgcgagacgtggtcaaagctcccgatgtggtggattacactccgaaggacgatttcggcagaatcttgggcagacgcttcggagcagaactcaaagcaagcgtttcggaagctctgcaggccgtccgg

SEQ ID NO: 374 - protein, 328 aa, Neisseria gonorrhoeae
MQYRIRRENEAPEAKNAGETLWERDIMREVLLSAYRDRRRERMWKNIWRAVSTLILVALIAGIFRKDEAALQLAGNTPHTAVVNLYGKIGNGVEDQVKKLKDGMEAAYKNPQAKAIVIRANSPGGSPVVSNTAFEEIRRLKAQHPGIPVYLVAEDMCASGCYYIAAAADKIYADPSSIVGSIGVIGSSFDATGLMEKIGVKRRVKIAGSNKGMGDPFSPETPEQSKIWEEMLTGIHGEFIKAVKTGRGGRLKFRQYPDVFSGRVYTGADALKVGLVDGLGNIYSVARDVVKAPDVVDYTPKDDFGRILGRRFGAELKASVSEALQAVR

SEQ ID NO: 375 - DNA, 144 bp, Neisseria gonorrhoeae
atgcacaaaacctcccggggacaacctgccttttgcggctttaagtgcacggtaaatagtaacgcggctgacttagtggcagcatactggggaggtgagtgtttttgtgtatatttttattctggtattcccttagaaatactg

SEQ ID NO: 376 - protein, 48 aa, Neisseria gonorrhoeae
MHKTSRGQPAFCGFKCTVNSNAADLVAAYWGGECFCVYFYSGIPLEIL

SEQ ID NO: 377 - DNA, 366 bp, Neisseria gonorrhoeae
atgtttgatggcgaagtagaagcagatgaaagttattttggcggacaacgcaaaggtaaatgcggtcgcggtgctgccggaaaagtcgcagtattcaggcttctcaaacgaaatggcaaggtttcctttgccgtccgttatgtacgtttcgtaacattcgaagacttcctgaaccctgcccgccgtttcggtttctgtacccccctgttagataaggggggggaagattcgaagcggttgccggcttcctgccgtccgtcggcgcgtccgtcatcacgccggcaacctcctttgtcatcccttgcttatctcccatgtgcgaatcctcaaaaacgggcaaaaaaaagccctgttacttgtagaaag

SEQ ID NO: 378 - protein, 122 aa, Neisseria gonorrhoeae
MFDGEVEADESYFGGQRKGKCGRGAAGKVAVFRLLKRNGKVSFAVRYVRFVTFEDFLNPARRFGFCTPLLDKGGEDSKRLPASCRPSARPSSRRQPPLSSLAYLPCANPQKRAKKSPVTCRK

SEQ ID NO: 379 - DNA, 264 bp, Neisseria gonorrhoeae
gtgaaacctgacagcattgtttatacggattgttatcgtcgctatgatgtattggatgcaggcgaatttagccatttccgtatcaatcacagcacacattttgccgaacgacaaaaccatattaatggaattgggaacttttggaaccgggcaaaacgtcatttacgcaagtttgacggcattcccaaagagcattttgagccgtatttaaaggagtgcgaacggcgttttaacaacagtgagataaaagttcttgttccattt

SEQ ID NO: 380 - protein, 88 aa, Neisseria gonorrhoeae
VKPDSIVYTDCYRRYDVLDAGEFSHFRINHSTHFAERQNHINGIGNFWNRAKRHLRKFDGIPKEHFEPYLKECERRFNNSEIKVLVPF

SEQ ID NO: 381 - DNA, 372 bp, Neisseria gonorrhoeae
atgattattcaaaatgaatttaatttatatcctagtaatatgcttcctgaagggttttgttatcctgaaaagtatgttcgtatctctaacgatacatctttaataccttatattcagccacataattttcactggtggtttgagaattatggaacagaaggggcagaagtagcttatatatttagaaattccatcctgcctgatttaaatcttatcccattcgctagtaatggagaatgggaagcttattttgatggtaatgatgtaacaggaaatcctagggttattgttattaatttagataatatagaaaaccatgaattttttaatagttttgaagagtggcttgaattagcaattaaggatacttgg

SEQ ID NO: 382 - protein, 124 aa, Neisseria gonorrhoeae
MIIQNEFNLYPSNMLPEGFCYPEKYVRISNDTSLIPYIQPHNFHWWFENYGTEGAEVAYIFRNSILPDLNLIPFASNGEWEAYFDGNDVTGNPRVIVINLDNIENHEFFNSFEEWLELAIKDTW

SEQ ID NO: 383 - DNA, 1545 bp, Neisseria gonorrhoeae
atgtccaccgccgccgctgtggaacggcggtttcgccagccagccaatgggaatcaggacgataaacaaaatgctgccggcgaggaatatttcgttcgatccgatgatgaagccctgttgcgtaatggtattgttgatgatgcctagagtttgaccgtcggaaatgccttgttgggacaaatgcgccgccgtttcgtgcaatgttgcggaatagggcgtgatgtgttcggcaaaacgcgtgtggtgcaacgcttcgcgccgttcccacagggtgctgacgacggatacgccgacaccgcccatcagcacgcgcaggaaattcgacaggctgccggcggcggcaatctgtccgcccttcatgtgcgacagtgtgatggtggtcagcggcaggaagaacatggcaacgcctaccccctgccaaaactgcggccagatgacgttgccgatatccatgtcggcataaaaatcagtgcgccaataaaaagtgaaggcaaaggtcaggaagctggcggttacgagcaggcgcatatcgattttattgccgaacctgccgattaacggagataggaagacggggaggatgccgacgggcgcggcagcaagccctgcccacgcggaggtatagcccaagttggtctgcaacactaacggcagcagggtcagcgtccccatatacaccatgaaacccaacgaggtggcaattacgccgacggtaaaattccgatctttaaacagcgataaatcgacaatcggatatttttctcccaattcccaaacaataaaatacgacaagcacaccagcgcggttatgcccaaggtaatgatttctccagaggcgaaccagtcaagttccttacccctgtccagcatcatctgtaacgcgccgataccgaccatcatcagcgtcagcccgacatagtcggtcggcgttctgacggttgccgtttcgcggtgtttcaaatgtttccatgtaatccatgccgatatgatcccgatggggatattaatgaagaaaatccaaccccaatgccagtttccggaaatccaaccgccgagtatcggcccgaggacaggggcgacaacgacggtcattgcccacaatgccagtgccagcatccgttttgcgggcggataggatgccattaacaggctttgcgacaggggaatcaacggcccggcgataaagccctgcaaaatgcggaaaacaaccagcgactgaaggttgggcgcgatgccgcacagccacgatgcgatgacgaaaccggcggcggcggcggtaaacaatttgacctcgccgatacgttttgccaaaaagcccgtcagcggcacggaaacggcgtttgccacggaaaaagaagtgatgacccacgtcccctgcgtggttgccgcaccgaggttgccggcaatgacggggacggcgacgttggcgatggtcgtatctaaaacctccataaatacggcaagccccaaagacagcgtaacccacgccaatgccgcacccttaagcggtggataatccattgtgtcctccgtttcagacggcat

SEQ ID NO: 384 - protein, 48 aa, Neisseria gonorrhoeae
MSTAAAVERRFRQPANGNQDDKQNAAGEEYFVRSDDEALLRNGIVDDA

SEQ ID NO: 385 - DNA, 171 bp, Neisseria gonorrhoeae
ttggcaggctgccagcatcagggcggcggcggagagtatgaggattttttatgtcggatgtccttgtttgctgtgggaaatcattgccattgtacagtaagattcaacaaaatgccgtctgaaaacggggttcggacggcattgtggctcaggggttcaacacgcgtgcga

SEQ ID NO: 386 - protein, 57 aa, Neisseria gonorrhoeae
LAGCQHQGGGGEYEDFLCRMSLFAVGNHCHCTVRFNKMPSENGVRTALWLRGSTRVR

SEQ ID NO: 387 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagggccccgccgggccgggcggaagctgtttcggcggacggcgtaaaggcagacgcggtcgcggcgcggcaggaaaagcggttgtcttcggcattccgaaacgcaacgggcgggcctataccgttgccgcggacaatgccgagcctgaaacgttaccccctgccgtcaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgacttaacttcggcacaccgtcccggcagctaaaaatcctgcgggatcggtgtggaatt

SEQ ID NO: 388 - protein, 217 aa, Neisseria gonorrhoeae
MKITHCKLKKEVQKEPLRSFVPEVTARSAADILGIHPDSAALFYRKIRTVTNHRLALAADEVFEGPAGPGGSCFGGRRKGRRGRGAAGKAVVFGIPKRNGRAYTVAADNAEPETLPPAVKKKIMPDGIVYADSPGSRGKLDAGGFTRCRINRSKEFADRRNHINGIGNFWNQAKRALRKYNGIDRKPFPPLLRECEFRLNFGTPSRQLKILRDRCGI

SEQ ID NO: 389 - DNA, 354 bp, Neisseria gonorrhoeae
atgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttt

SEQ ID NO: 390 - protein, 118 aa, Neisseria gonorrhoeae
MNEHNLLIFCLKDNVSISEYTEMVDWAYENIQSETVVEITENQIIEYQNRGLWGLVSEITDNWLFGPSEGDWLIDKESILAVKEKLQNSDFSTEPLVKNIIHVLEYAIKNEKTVIFHF

SEQ ID NO: 391 - DNA, 873 bp, Neisseria gonorrhoeae
gtgggcatcaatgccaatcctaactgtgctgatgaagcaggaaaactgatatgggaaaacgaccccgataaaaattggtgggctaaccgtatggatgatattcgcggcatcatccaaggtgcggttaatccttttttaacgggttttcaaggagtagggattggggcaattacagacagtgcggtaagcccggtcacagatacagccgctcagcagactctacaaggtattaatgatttaggaaaattaagtccggaagcacaacttgctgtcgcgagcctattacaggacagtgcttttgcggtaaaagacggcattaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctatgaaaaacctgctgcccgacctatgcagactgttgacggggaaatggcaggtgggaataaacctattaaatctttaccaaacagcgccgctgaaaaaagaaaacaaagttttaagaagtttagtagcaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaa

SEQ ID NO: 392 - protein, 291 aa, Neisseria gonorrhoeae
VGINANPNCADEAGKLIWENDPDKNWWANRMDDIRGIIQGAVNPFLTGFQGVGIGAITDSAVSPVTDTAAQQTLQGINDLGKLSPEAQLAVASLLQDSAFAVKDGINSARQWADAHPNITATAQTALAVAEAAGTVWRGKKVELNPTKWDWVKNTGYEKPAARPMQTVDGEMAGGNKPIKSLPNSAAEKRKQSFKKFSSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 393 - DNA, 237 bp, Neisseria gonorrhoeae
ttgacaagcaaaaataaaattattatgaatataatcaattacacaggtgatgacattattatttctttaacaagagaagagcttcaattattgcgttcccttgttattgaaatttatgcaggtgtttgcatagatgcagaagaatttgagattgtgtcaggaattcgcaatcctcaattagtgcaagagctagaacaacatttaattgaagcatataatctaatggatacatctaac

SEQ ID NO: 394 - protein, 79 aa, Neisseria gonorrhoeae
LTSKNKIIMNIINYTGDDIIISLTREELQLLRSLVIEIYAGVCIDAEEFEIVSGIRNPQLVQELEQHLIEAYNLMDTSN

SEQ ID NO: 395 - DNA, 357 bp, Neisseria gonorrhoeae
atgattaaattggatttaaaaagcataaatttatatgatattgattttgaaaaatttacccccgaaattccagataattttcatagatggatagatttggatatcggaatcgaaggagaacaaggctcatctattttttcactttgcatttgttctcctaaatggatttcccatcattgtaataaagaaggttttttttggtctaatgcattaatattagaacagtttgatcataagattattaaaagtgaaattgataaaatattagaatattgctcaaaagaaacttgggatttgacactttcaaacttattacgatttttttcttgggaattcgaagattacaatccaaacaca

SEQ ID NO: 396 - protein, 119 aa, Neisseria gonorrhoeae
MIKLDLKSINLYDIDFEKFTPEIPDNFHRWIDLDIGIEGEQGSSIFSLCICSPKWISHHCNKEGFFWSNALILEQFDHKIIKSEIDKILEYCSKETWDLTLSNLLRFFSWEFEDYNPNT

SEQ ID NO: 397 - DNA, 117 bp, Neisseria gonorrhoeae
gtgcagatggcacaaggctatatcgtcctccaactacaaaatcaaacacccctgaatcacttaacccaacgggagtgcaagctaattttgttactagaagtgttgatggaaaaacct

SEQ ID NO: 398 - protein, 39 aa, Neisseria gonorrhoeae
VQMAQGYIVLQLQNQTPLNHLTQRECKLILLLEVLMEKP

SEQ ID NO: 399 - DNA, 783 bp, Neisseria gonorrhoeae
ttgtcggatacaaataaatatccgacctacatttctgcgcagcaaactttacagggtattcacgatttaggaaatttaagtcccgcagcacaacttgcggctgcaaccgcattacaagacagtgcctttgcggtaaaagacggcatcaattccgccagacaatgggctgatgcccatccgaacattacagctactgcccaaactgcccttgccgtagcagaggccgcaggtacggtttggggcggtaaaaaagtagaacttaacccggccaaatgggattgggttaaaaataccggctataaaacacctgctgttcgcaccatgcatactttggatggggagatggccggtgggaatagaccgcctaaatctataacgtcgaaaggaaaagctaatgctgcaacctatcctaagttggttaatcagctaaatgagcaaaacttaaataacattgcggctcaagattcaaggttagcaagtgctgtaaaagattggaaaacaatacaaccaaataaaaagggggaaattaattttggtattggttctgcaactcgtcaagaggctgaacagttaggaaaaatttgggttggagacggggctaagccagttagtagtccatcttgtcaaggatgtatgttaagtgcagatggcacaaggctatatcgtcctccaactacaaaatcaaacacccctgaatcacttaacccaacgggagtgcaagctaattttgttactagaagtgttgatggaaaaaccttaactaatggacatttgaatataaaa

SEQ ID NO: 400 - protein, 261 aa, Neisseria gonorrhoeae
LSDTNKYPTYISAQQTLQGIHDLGNLSPAAQLAAATALQDSAFAVKDGINSARQWADAHPNITATAQTALAVAEAAGTVWGGKKVELNPAKWDWVKNTGYKTPAVRTMHTLDGEMAGGNRPPKSITSKGKANAATYPKLVNQLNEQNLNNIAAQDSRLASAVKDWKTIQPNKKGEINFGIGSATRQEAEQLGKIWVGDGAKPVSSPSCQGCMLSADGTRLYRPPTTKSNTPESLNPTGVQANFVTRSVDGKTLTNGHLNIK

SEQ ID NO: 401 - DNA, 90 bp, Neisseria gonorrhoeae
ttgtatccgacaaaaatatttgacgcgcctatcgtttccgagatgccgctgttggaaaatgtcggattcgagaatccgatctacggctgc

SEQ ID NO: 402 - protein, 30 aa, Neisseria gonorrhoeae
LYPTKIFDAPIVSEMPLLENVGFENPIYGC

SEQ ID NO: 403 - DNA, 204 bp, Neisseria gonorrhoeae
atgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaact

SEQ ID NO: 404 - protein, 68 aa, Neisseria gonorrhoeae
MNILSINNQNSTISLTQDEVFVLRAILNEIYAGVCVDSREFENVSGVRKHEVDNLQQQFAGIYKKMTT

SEQ ID NO: 405 - DNA, 870 bp, Neisseria gonorrhoeae
gtgggcatcaatgccaatcctaactgtgcggatgaagcaggaaaactgatatgggaagacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaaattaagtccggaagcacaacttgctgccgcgagcctattacaggacagtgcctttgcggtaaaagacggcatcaattccgccaaacaatgggctgatgcccatccgaacattacagctactgcccaaactgcccttgccgtagcagaggctgcaggtacggtttggggcggtaaaaaagtagaacttaacccggccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgattta

SEQ ID NO: 406 - protein, 290 aa, Neisseria gonorrhoeae
VGINANPNCADEAGKLIWEDDPDKNWRANRMDDIRGIVQGAVNPFLTGFQGVGIGAITDSAVSPVTDTAAQQTLQGINDLGKLSPEAQLAAASLLQDSAFAVKDGINSAKQWADAHPNITATAQTALAVAEAAGTVWGGKKVELNPAKWDWVKNTGYKTPAVRTMHTLDGEMAGGNRPPKSITSNSKADASTQPSLQAQLIGEQISSGHAYNKHVIRQQEFTDLNINSPADFARHIENIVSHPTNMKELPRGRTAYWDDKTGTIVIRDKNSDDGGTAFRPTSGKKYYDDL

SEQ ID NO: 407 - DNA, 144 bp, Neisseria gonorrhoeae
gtgttatcttcatatttcgagggtaacatatctgctaatctggtacagacccaaattaaattgatggcttttatgatccccgatttgcgaaaatgccgtctgaaagtctttgtcaggctttcagacggcattttgatcatcaag

SEQ ID NO: 408 - protein, 48 aa, Neisseria gonorrhoeae
VLSSYFEGNISANLVQTQIKLMAFMIPDLRKCRLKVFVRLSDGILIIK

SEQ ID NO: 409 - DNA, 1182 bp, Neisseria gonorrhoeae
gggcgcggattgcccgaggatttcatcgaccgtccgatcgacttccgaccagtcggtactttccatttccggcaatgccgcacccggcgtttttgaaacaggcgcgcctgcggcggaagtatccactttaaccgtcatcgacaaaccgatacgcaacggatgcctgtccacatcttcgcggttcagcacgatacggacggggacgcgctgcaccactttaatccagttgcccgttgcgttttgcgccggaatcagcgaaaacgcgctgcccgtacctgccgaaaaccctgccaccctgccgcgataaacaatttgtttgccgtacaaatcggacaccagctcggcaggctgtccgattttcatatgccgcaactgcgtctctttaaaattggcatccacccacacatccgacagcggcaccaccgccatcagcggcgcgcctgccgccacctgctgcccgacctgcaccgaacgcttcgccacctgaccgtccgccggcgcgcggacttgcgtccgccgaaggttcagccacgcatctttcaacctgccgattgccgtctgaacctccggctgttcgcgcaaagaaacatctccgcccaaagccgcgcgtgccgaagattcttccgccaaagccgccttaaccgccgcctgcgcctgagacactgccgtacgggcgtgtgccagctcttcggcggacaccgcacccgattccgccaaagcggaccggcggcgtaaatcatcctgcgcgcgcgccaaatccgcacggcgcaaggcaacctgcgcccccgcctgcgaagtggcggcattttgccggcggttttggcgcaccgcctgaaccaactcgttttttgcccgctcgtaagccagcacatcattatcgtcatccaacaccgccagcacgtcgccttttttcacggcatccgtatcgtcgtgcaaaaccttccgcaccgtgccgcccttttgcggcgtaacctgaaccacgcgtccggcaacataagcgtcttccgtttcctcttcgtgctgccaccataaaaaaaacgccgatccggcggctgcggcggaaagcgcgaacagcagcgtcaatgccgtcaggcggcgtttgcgtttgacttgcgtgttttgaagttttgtttcgtctgtgtgcgtttccataagattgggttccgaatttcctgatttcat

SEQ ID NO: 410 - protein, 31 aa, Neisseria gonorrhoeae
GRGLPEDFIDRPIDFRPVGTFHFRQCRTRRF

SEQ ID NO: 411 - DNA, 162 bp, Neisseria gonorrhoeae
ttgcatgattctccggccggtgtcccggcggatgccgtgtgcgcgtttttaagcgcgcggccggattggcaggctgccagcatcagggcggcggcggagagtatgaggattttttatgtcggatgtccttgtttgctgtgggaaatcattgccattgtacag

SEQ ID NO: 412 - protein, 54 aa, Neisseria gonorrhoeae
LHDSPAGVPADAVCAFLSARPDWQAASIRAAAESMRIFYVGCPCLLWEIIAIVQ

SEQ ID NO: 413 - DNA, 207 bp, Neisseria gonorrhoeae
atgaaattaattgattttgaagggaatttagttaaaattagtctcgataaagatgagttgtatattattcaagcaattgtaggagaaatttattcaggcgtatgcgtggattgtagagattttgagataattcatggtgttgaaaaaaataaagttcttcttttggataaagaacttaaaaaaatatatgatacttgggataaatgt

SEQ ID NO: 414 - protein, 69 aa, Neisseria gonorrhoeae
MKLIDFEGNLVKISLDKDELYIIQAIVGEIYSGVCVDCRDFEIIHGVEKNKVLLLDKELKKIYDTWDKC

SEQ ID NO: 415 - DNA, 357 bp, Neisseria gonorrhoeae
atgagattaaaattaaaaaattatgattgttctgactttgatttggaagatttcccacaagacaagttagaaaatttttgtatacttttgacattatcaataggttttgatgaaagtaatggtgctgattatttttatgtttatatatatagcaccgaatggttactttcaaatatacatagaccgatgtcattaaaaaactcaattgttacaaaccgttttaatattgaacacatattaaaattgataaatgatatattggaaatatgtaattcaacgtctgaagataagtctatatcaaatttggcaaaatattttgactgggaatttgacgattataatctaaatatccaagac

SEQ ID NO: 416 - protein, 119 aa, Neisseria gonorrhoeae
MRLKLKNYDCSDFDLEDFPQDKLENFCILLTLSIGFDESNGADYFYVYIYSTEWLLSNIHRPMSLKNSIVTNRFNIEHILKLINDILEICNSTSEDKSISNLAKYFDWEFDDYNLNIQD

SEQ ID NO: 417 - DNA, 129 bp, Neisseria gonorrhoeae
atggcactcgacaatatcggccaccaacagaaaaaaaatcacaatttgcaactacaggtattcaagcaaattttgaaacttatactattgattcaaatgaaaaaagaaataaaattaaaaatggacatt

SEQ ID NO: 418 - protein, 43 aa, Neisseria gonorrhoeae
MALDNIGHQQKKNHNLQLQVFKQILKLILLIQMKKEIKLKMDI

SEQ ID NO: 419 - DNA, 1443 bp, Neisseria gonorrhoeae
ttgctgcaaatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatacatcccgcagacggatatgacgggcctcaaggcggcggttatccggaaccacaaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaatttaagtccggaagcacaacttgccgccgcgagcctattacaggacagtgcctttgcggtaaaagacggcatcaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctataaaaaacctgctgcccgccatatgcagactgtagatggggagatggcaggggggaatagaccgcctaaatctataacgtcggaaggaaaagctaatgctgcaacctatcctaagttggttaatcagctaaatgagcaaaacttaaataacattgcggctcaagatccaagattgagtctagctattcatgagggtaaaaaaaattttccaataggaactgcaacttatgaagaggcagatagactaggtaaaatttgggttggtgagggtgcaagacaaactagtggaggcggatggttaagtagagatggcactcgacaatatcggccaccaacagaaaaaaaatcacaatttgcaactacaggtattcaagcaaattttgaaacttatactattgattcaaatgaaaaaagaaataaaattaaaaatggacatttaaatattagg

SEQ ID NO: 420 - protein, 481 aa, Neisseria gonorrhoeae
LLQIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 421 - DNA, 111 bp, Neisseria gonorrhoeae
ttgattcacactgccataaccgcttgctgccaaggaaaacaaaatgaatttgcctattcaaaaattcatgatgctgtttgcagcggcaatatcgttgctgcaaatccccat

SEQ ID NO: 422 - protein, 37 aa, Neisseria gonorrhoeae
LIHTAITACCQGKQNEFAYSKIHDAVCSGNIVAANPH

SEQ ID NO: 423 - DNA, 960 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaacct

SEQ ID NO: 424 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 425 - DNA, 96 bp, Neisseria gonorrhoeae
ttgatgattgaccatagggtcggcagatatagtcgcatatgggcttcagacagccatttattatatggagattatagtggattaaatttacaattt

SEQ ID NO: 426 - protein, 32 aa, Neisseria gonorrhoeae
LMIDHRVGRYSRIWASDSHLLYGDYSGLNLQF

SEQ ID NO: 427 - DNA, 291 bp, Neisseria gonorrhoeae
ttggaatcagggattcccgtcagcttcggcggcggcgtaccggttgcaaacggcaggaatctagttacacggcaagcggcaaacggcattggcaaatccgactccgaggcctgcgaacacgccctaatcaatgccgcccgcaaattccagcagaccgccggcaaactcggcgggcgcagtgttaccggcttccacagctactttggcaagcaatcgctgcaaggcggacaatacgactgtcaggcaggttcgttccacgtccgcgcggtcatgcgcgccaatgtcgtccgt

SEQ ID NO: 428 - protein, 97 aa, Neisseria gonorrhoeae
LESGIPVSFGGGVPVANGRNLVTRQAANGIGKSDSEACEHALINAARKFQQTAGKLGGRSVTGFHSYFGKQSLQGGQYDCQAGSFHVRAVMRANVVR

SEQ ID NO: 429 - DNA, 702 bp, Neisseria gonorrhoeae
atggtcaatcatcaatcagcagtggaccagtgtgccttcgtcttcgccggtaatgacgcgtttgagcgagccttgtttggcgatgccgaagacgacgatattgagcttgcgttcgcggcagagggcaaaggcggtcgcgtccatgactttgaggtttttattcaaggcttcgtcaaaagtaatggtttcgtagcgtgtggcggacgggtcttttttcgggtctgcggtgtacacgccgtcgacgttggtggctttgagcatcacgtcgcagttcatttccgcgccgcgcaatgcggcggcagtgtcggtcgtgaagaacggattaccggtaccggcggcgaaaatcacgactttgccttcttccaaatattgaatggctttaggacgggcgtaagtttcagcgatttgctgcatagacagtgcggattgtacgcgcgctttgatgcccaaggtttcaaatgcgtctttgagtgccaaggcgttcatcacggtcgccatcatgcccatgtagtcggcagtggcgcggtccatgctgcctgcttgtgcagatacgccgcggaaaatgttaccgccgccgacaacgataccgacttgcacacccattttcacgatttcggcaatttcgccgacagtttgaacaatggtatcgtgattgatgccgaacggatcggaacccatcagggattcgccggagagtttcag

SEQ ID NO: 430 - protein, 234 aa, Neisseria gonorrhoeae
MVNHQSAVDQCAFVFAGNDAFERALFGDAEDDDIELAFAAEGKGGRVHDFEVFIQGFVKSNGFVACGGRVFFRVCGVHAVDVGGFEHHVAVHFRAAQCGGSVGREERITGTGGENHDFAFFQILNGFRTGVSFSDLLHRQCGLYARFDAQGFKCVFECQGVHHGRHHAHVVGSGAVHAACLCRYAAENVTAADNDTDLHTHFHDFGNFADSLNNGIVIDAERIGTHQGFAGEFQ

SEQ ID NO: 431 - DNA, 717 bp, Neisseria gonorrhoeae
atgacacagcaaatcaaatacaaacgcgtattactgaaactctccggcgaatccctgatgggttccgatccgttcggcatcaatcacgataccattgttcaaactgtcggcgaaattgccgaaatcgtgaaaatgggtgtgcaagtcggtatcgttgtcggcggcggtaacattttccgcggcgtatctgcacaagcaggcagcatggaccgcgccactgccgactacatgggcatgatggcgaccgtgatgaacgccttggcactcaaagacgcatttgaaaccttgggcatcaaagcgcgcgtacaatccgcactgtctatgcagcaaatcgctgaaacttacgcccgtcctaaagccattcaatatttggaagaaggcaaagtcgtgattttcgccgccggtaccggtaatccgttcttcacgaccgacactgccgccgcattgcgcggcgcggaaatgaactgcgacgtgatgctcaaagccaccaacgtcgacggcgtgtacaccgcagacccgaaaaaagacccgtccgccacacgctacgaaaccattacttttgacgaagccttgaataaaaacctcaaagtcatggacgcgaccgcctttgccctctgccgcgaacgcaagctcaatatcgtcgtcttcggcatcgccaaacaaggctcgctcaaacgcgtcattaccggcgaagacgaaggcacactggtccactgc

SEQ ID NO: 432 - protein, 239 aa, Neisseria gonorrhoeae
MTQQIKYKRVLLKLSGESLMGSDPFGINHDTIVQTVGEIAEIVKMGVQVGIVVGGGNIFRGVSAQAGSMDRATADYMGMMATVMNALALKDAFETLGIKARVQSALSMQQIAETYARPKAIQYLEEGKVVIFAAGTGNPFFTTDTAAALRGAEMNCDVMLKATNVDGVYTADPKKDPSATRYETITFDEALNKNLKVMDATAFALCRERKLNIVVFGIAKQGSLKRVITGEDEGTLVHC

SEQ ID NO: 433 - DNA, 144 bp, Neisseria gonorrhoeae
ttgctgtgtcatgggataccttgctttcttgaatgtcgtcggtcggagttgggacgtctgaatttcaaatggtcggattacaatgatatggtgtgtcgttctattattgttttgttttcagacggcctttatattcggtcgtct

SEQ ID NO: 434 - protein, 48 aa, Neisseria gonorrhoeae
LLCHGIPCFLECRRSELGRLNFKWSDYNDMVCRSIIVLFSDGLYIRSS

SEQ ID NO: 435 - DNA, 897 bp, Neisseria gonorrhoeae
gtggaaaatcctttccgtatttcccaaaaatctaggagattcaaaatggcagaaattactgcaaaaatggttgccgacctgcgcgccgctaccggcctgggtatgatggaatgcaaaaaagccttggttgaagctgaaggcaacttcgacaaagccgaagaaatcctgcgtattaaatccggtgcgaaagcgggcaaactggctggccgtactgctgccgaaggcgtattggcttatgcaatcaacggtaatgtcggcgcattggtcgaagtaaactgcgaaaccgacttcgttgctaaagacgccggcttcgtagaatttgccaacttcgttgcgaaaactgctgccgagaaaaaaccggcttctgttgaagaactgagcgaactggttgaatcagaacgcaaagccatcatcgctaaattgggcgagaacatgtctgtccgccgcttccaagtgattgacactgccaaccaactggttgcctacatccacggcgcattggcgaccgaaggcgttttggtcgagtacaaaggctctgaagatgtagcacgcaaaatcggtatgcacatcgttgccgccaaaccgcaatgcgtaagcgaagccgaagtagatgctgaaaccgttgaaaaagaacgccacatctacaccgagcaagccatcgcttccggcaaacctgccgacatcgccgctaaaatggttgaaggccgtatccgcaaattcttggctgaaatcactctgaacggccaagcattcgtgatgaaccctgaccaaactgttgcccaattcgctaaagaaaacgacactgaagtggttagcttcatccgctacaaagtaggcgacggtatcgagaaagccgttgtcgactacgcagccgaagtagccgcagccgccaaagtg

SEQ ID NO: 436 - protein, 299 aa, Neisseria gonorrhoeae
VENPFRISQKSRRFKMAEITAKMVADLRAATGLGMMECKKALVEAEGNFDKAEEILRIKSGAKAGKLAGRTAAEGVLAYAINGNVGALVEVNCETDFVAKDAGFVEFANFVAKTAAEKKPASVEELSELVESERKAIIAKLGENMSVRRFQVIDTANQLVAYIHGALATEGVLVEYKGSEDVARKIGMHIVAAKPQCVSEAEVDAETVEKERHIYTEQAIASGKPADIAAKMVEGRIRKFLAEITLNGQAFVMNPDQTVAQFAKENDTEVVSFIRYKVGDGIEKAVVDYAAEVAAAAKV

SEQ ID NO: 437 - DNA, 726 bp, Neisseria gonorrhoeae
atgtctcaaattactatgcgtcagatgattgaagccggtgttcacttcggtcaccaaacccgtttctggaacccgaaaatggctcaatacattttcggcgcgcgcaacaaaatccatatcgtaaacttggaaaaaaccctgccgatgttccaagaggcgcaagaagccgtacgtcgtctggttgccaacaaaggtacggtattgttcgtaggtaccaaacgccaggcacgcgacatcatccgcgaagaagcgacccgcgccggtatgcctttcgtcgaccaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgacgttgaaaaactggaacgctctttgggcggtatcaaaaacatgaaaggcctgcccgacgcgattttcgttatcgataccggctaccaaaaaggtactttggttgaggctgaaaaactgggcatccccgttatcgccgtagtcgataccaacaacagcccagacggcgtgaaatacgtcatccccggcaacgacgactccgccaaagccatccgcctgtactgccgaggcatcgccgacgcagttttggaaggcaaaaaccaagcgctgcaagaaaccgtagccgctgcccaagaaaccgctgccgag

SEQ ID NO: 438 - protein, 242 aa, Neisseria gonorrhoeae
MSQITMRQMIEAGVHFGHQTRFWNPKMAQYIFGARNKIHIVNLEKTLPMFQEAQEAVRRLVANKGTVLFVGTKRQARDIIREEATRAGMPFVDHRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQETAAE

SEQ ID NO: 439 - DNA, 753 bp, Neisseria gonorrhoeae
ttgggcagcggctacggtttcttgcagcgcttggtttttgccttccaaaactgcgtcggcgatgcctcggcagtacaggcggatggctttggcggagtcgtcgttgccggggatgacgtatttcacgccgtctgggctgttgttggtatcgactacggcgataacggggatgcccagtttttcagcctcaaccaaagtacctttttggtagccggtatcgataacgaaaatcgcgtcgggcaggcctttcatgtttttgataccgcccaaagagcgttccagtttttcaacgtcgcgttgcatttccagaatttcttttttgctgaaaccgctttcggcagcattttccaaggctgcggttttttcttccaggcgtttgatggattgcttaacggttttgtagttggtcagcataccgcccaaccagcggtggtcgacgaaaggcataccggcgcgggtcgcttcttcgcggatgatgtcgcgtgcctggcgtttggtacctacgaacaataccgtacctttgttggcaaccagacgacgtacggcttcttgcgcctcttggaacatcggcagggttttttccaagtttacgatatggattttgttgcgcgcgccgaaaatgtattgagccattttcgggttccagaaacgggtttggtgaccgaagtgaacaccggcttcaatcatctgacgcatagtaatttgagacatgttatttccttgaaagggttaaagagcacacattcaatcgca

SEQ ID NO: 440 - protein, 251 aa, Neisseria gonorrhoeae
LGSGYGFLQRLVFAFQNCVGDASAVQADGFGGVVVAGDDVFHAVWAVVGIDYGDNGDAQFFSLNQSTFLVAGIDNENRVGQAFHVFDTAQRAFQFFNVALHFQNFFFAETAFGSIFQGCGFFFQAFDGLLNGFVVGQHTAQPAVVDERHTGAGRFFADDVACLAFGTYEQYRTFVGNQTTYGFLRLLEHRQGFFQVYDMDFVARAENVLSHFRVPETGLVTEVNTGFNHLTHSNLRHVISLKGLKSTHSIA

SEQ ID NO: 441 - DNA, 231 bp, Neisseria gonorrhoeae
atgtggcacatcgtcgccatcggctatctttttgttgccgttatgtattccgccgcgcagccgagtattgcgcgcgctttgatttatttggttttttgggtggttctgcccaccgtgttcacggtcttcgccgtaaccgtccgccgccgcaaccgcctgatggggcagcaggaacaggcagaatccgaacagcagcgcgcacaacggcaaaaagacagcggcacaaaaccc

SEQ ID NO: 442 - protein, 77 aa, Neisseria gonorrhoeae
MWHIVAIGYLFVAVMYSAAQPSIARALIYLVFWVVLPTVFTVFAVTVRRRNRLMGQQEQAESEQQRAQRQKDSGTKP

SEQ ID NO: 443 - DNA, 330 bp, Neisseria gonorrhoeae
ttgttaacattcaaacaggacgcacacaatgtggcacatcgtcgccatcggctatctttttgttgccgttatgtattccgccgcgcagccgagtattgcgcgcgctttgatttatttggttttttgggtggttctgcccaccgtgttcacggtcttcgccgtaaccgtccgccgccgcaaccgcctgatggggcagcaggaacaggcagaatccgaacagcagcgcgcacaacggcaaaaagacagcggcacaaaaccctgaatcccttttcagacggcatcttatccgctataatccgtcagttttccatttcggaaacacactatttt

SEQ ID NO: 444 - protein, 110 aa, Neisseria gonorrhoeae
LLTFKQDAHNVAHRRHRLSFCCRYVFRRAAEYCARFDLFGFLGGSAHRVHGLRRNRPPPQPPDGAAGTGRIRTAARTTAKRQRHKTLNPFSDGILSAIIRQFSISETHYF

SEQ ID NO: 445 - DNA, 657 bp, Neisseria gonorrhoeae
ttgtgtgcgtcctgtttgaatgttaacaaaatcgttataatcgcaacattctaccgcaatcctgaaaggccgtctgaaatgaggaacgaggaaaaacgcgccctgcgccgcgaattgcgcgggcggcgttcgcaaatggggcgggacgtgcgggcggcggcggcggtaaaaatcaaccgcctgctcaaacgttatatcaagcgcggtcggaaaatcggcgtgtattggccgatgggcaaggaattgcgtttgggcggctttgtccgcgcggcgcaaaaacgcggcgcaaaactctatctgccttatatcgaaccgcacacgcggcggatgtggtttacgccgtatcctgaacgcggaatggaacgggaacgcaagcgcggtagggcgaagctgcatgtccctcagtttgcagggcgcaaaatccgcgtgcacggtttgtcggtattgctcgtcccgcttgtcggcatagaccgcgaaggctaccgtttggggcaggcaggcggctattacgatgcgacgctttcggcgatgaaataccgtttgcaggcgaaaaccgtgggcgtgggctttgcctgccagttggtggacaggctcccacgcgaggcgcacgacctgccgctggacggttttgtatcggaagcggggatattgtgtttt

SEQ ID NO: 446 - protein, 219 aa, Neisseria gonorrhoeae
LCASCLNVNKIVIIATFYRNPERPSEMRNEEKRALRRELRGRRSQMGRDVRAAAAVKINRLLKRYIKRGRKIGVYWPMGKELRLGGFVRAAQKRGAKLYLPYIEPHTRRMWFTPYPERGMERERKRGRAKLHVPQFAGRKIRVHGLSVLLVPLVGIDREGYRLGQAGGYYDATLSAMKYRLQAKTVGVGFACQLVDRLPREAHDLPLDGFVSEAGILCF

SEQ ID NO: 447 - DNA, 105 bp, Neisseria gonorrhoeae
agtcagtattttagatgcaatattcaaaaaacaacgcttcaggtggcaaaactgaaaatatatttcgtttatatatgacatggcaaacaccgccgcccgcaccat

SEQ ID NO: 448 - protein, 25 aa, Neisseria gonorrhoeae
SQYFRCNIQKTTLQVAKLKIYFVYI

SEQ ID NO: 449 - DNA, 753 bp, Neisseria gonorrhoeae
atgccgtctgaacggctaaaaacacaatatccccgcttccgatacaaaaccgtccagcggcaggtcgtgcgcctcgcgtgggagcctgtccaccaactggcaggcaaagcccacgcccacggttttcgcctgcaaacggtatttcatcgccgaaagcgtcgcatcgtaatagccgcctgcctgccccaaacggtagccttcgcggtctatgccgacaagcgggacgagcaataccgacaaaccgtgcacgcggattttgcgccctgcaaactgagggacatgcagcttcgccctaccgcgcttgcgttcccgttccattccgcgttcaggatacggcgtaaaccacatccgccgcgtgtgcggttcgatataaggcagatagagttttgcgccgcgtttttgcgccgcgcggacaaagccgcccaaacgcaattccttgcccatcggccaatacacgccgattttccgaccgcgcttgatataacgtttgagcaggcggttgatttttaccgccgccgccgcccgcacgtcccgccccatttgcgaacgccgcccgcgcaattcgcggcgcagggcgcgtttttcctcgttcctcatttcagacggcctttcaggattgcggtagaatgttgcgattataacgattttgttaacattcaaacaggacgcacacaatgtggcacatcgtcgccatcggctatctttttgttgccgttatgtattccgccgcgcagccgagtattgcgcgcgctt

SEQ ID NO: 450 - protein, 251 aa, Neisseria gonorrhoeae
MPSERLKTQYPRFRYKTVQRQVVRLAWEPVHQLAGKAHAHGFRLQTVFHRRKRRIVIAACLPQTVAFAVYADKRDEQYRQTVHADFAPCKLRDMQLRPTALAFPFHSAFRIRRKPHPPRVRFDIRQIEFCAAFLRRADKAAQTQFLAHRPIHADFPTALDITFEQAVDFYRRRRPHVPPHLRTPPAQFAAQGAFFLVPHFRRPFRIAVECCDYNDFVNIQTGRTQCGTSSPSAIFLLPLCIPPRSRVLRAL

SEQ ID NO: 451 - DNA, 141 bp, Neisseria gonorrhoeae
gtgtttttagccgttcagacggcatttcgggcggaaatgccgtctgaaggcggaatattgggagaaaaggatgtcggaaaggataatactgccggttttgtcattgggcggcgtacggttcgaaccgttggatgtgcatca

SEQ ID NO: 452 - protein, 47 aa, Neisseria gonorrhoeae
VFLAVQTAFRAEMPSEGGILGEKDVGKDNTAGFVIGRRTVRTVGCAS

SEQ ID NO: 453 - DNA, 93 bp, Neisseria gonorrhoeae
atgattttgcaacaggtgtttatccgtttccgccgtgccgatgccgcataccatgtgaatccgatatccaaacgcggaatctgcggttcaaaa

SEQ ID NO: 454 - protein, 31 aa, Neisseria gonorrhoeae
MILQQVFIRFRRADAAYHVNPISKRGICGSK

SEQ ID NO: 455 - DNA, 531 bp, Neisseria gonorrhoeae
ttggatgtgcatcatgaaacgggtttgcgcgaggcggtttgcgatggggaggtttggaagctgggggtaacgtccgcgccccatccggatagggtggcagactatatcgggacagcattggcaacgcgtttggcgtttgcggttgtcgatgaagaggcggacagggtggtcgggacaacggcgtattatcattttgaaccgcagattccgcgtttggatatcggattcacatggtatgcggcatcggcacggcggaaacggataaacacctgttgcaaaatcatgctgttggattacgcatttgatgttttggtttgctgttgcgcgggatggcgcacggatattctgaaccttgcctcgcaacgtgccatcgaacggctgggcgcggaaaaagacggcgtgctgcgtatgcatatgctccgtaaagacggcagtgtgcgcgatacggttgtgtacagtatgctgagggaagattggtgcaaaaacagggaaatcctgaccggcaggttggcagggtatggcgtgcaggtg

SEQ ID NO: 456 - protein, 177 aa, Neisseria gonorrhoeae
LDVHHETGLREAVCDGEVWKLGVTSAPHPDRVADYIGTALATRLAFAVVDEEADRVVGTTAYYHFEPQIPRLDIGFTWYAASARRKRINTCCKIMLLDYAFDVLVCCCAGWRTDILNLASQRAIERLGAEKDGVLRMHMLRKDGSVRDTVVYSMLREDWCKNREILTGRLAGYGVQV

SEQ ID NO: 457 - DNA, 603 bp, Neisseria gonorrhoeae
ttgtcagcatatcgcgttaagttttttaaatttgagaatactgcctcacacctgcacgccataccctgccaacctgccggtcaggatttccctgtttttgcaccaatcttccctcagcatactgtacacaaccgtatcgcgcacactgccgtctttacggagcatatgcatacgcagcacgccgtctttttccgcgcccagccgttcgatggcacgttgcgaggcaaggttcagaatatccgtgcgccatcccgcgcaacagcaaaccaaaacatcaaatgcgtaatccaacagcatgattttgcaacaggtgtttatccgtttccgccgtgccgatgccgcataccatgtgaatccgatatccaaacgcggaatctgcggttcaaaatgataatacgccgttgtcccgaccaccctgtccgcctcttcatcgacaaccgcaaacgccaaacgcgttgccaatgctgtcccgatatagtctgccaccctatccggatggggcgcggacgttacccccagcttccaaacctccccatcgcaaaccgcctcgcgcaaacccgtttcatgatgcacatccaacggttcgaaccgtacgccgcccaa

SEQ ID NO: 458 - protein, 201 aa, Neisseria gonorrhoeae
LSAYRVKFFKFENTASHLHAIPCQPAGQDFPVFAPIFPQHTVHNRIAHTAVFTEHMHTQHAVFFRAQPFDGTLRGKVQNIRAPSRATANQNIKCVIQQHDFATGVYPFPPCRCRIPCESDIQTRNLRFKMIIRRCPDHPVRLFIDNRKRQTRCQCCPDIVCHPIRMGRGRYPQLPNLPIANRLAQTRFMMHIQRFEPYAAQ

SEQ ID NO: 459 - DNA, 144 bp, Neisseria gonorrhoeae
gtgaatgtagtggattttactgggaaatgcaaagtttttctgtcgcccgccaagccggggaactgcgaaacaaaaaataaaaatagttatttatctatatatatcaaatttttaatagacaaaaaatcaaaattgtttatatat

SEQ ID NO: 460 - protein, 48 aa, Neisseria gonorrhoeae
VNVVDFTGKCKVFLSPAKPGNCETKNKNSYLSIYIKFLIDKKSKLFIY

SEQ ID NO: 461 - DNA, 114 bp, Neisseria gonorrhoeae
gtgctcggacacacaccattgccggtttcccctgcttttgcgattcaggcgtttgtagtacggcaaataaccataagggcagaagatgcctgttttttaggagtaaaccatggc

SEQ ID NO: 462 - protein, 38 aa, Neisseria gonorrhoeae
VLGHTPLPVSPAFAIQAFVVRQITIRAEDACFLGVNHG

SEQ ID NO: 463 - DNA, 1464 bp, Neisseria gonorrhoeae
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgctgggtgcggacggcgtcatcaatccggcgcgcgccctgaatattgccgaacagtttcatgtcagccgccagttttgggcgacgctggtcgcggaaggcaagttggaagacaattccttcatcaatgccgtgccgcatatgtctttggtgatgaacgaagaccactgccgttacctgcaaaaacgctatgatgtgtttaaaacgcagaaactttttgaaaatatggaattttccaccgatcggaacaaaatttccgattgggctccgctgattatgcgcggccgggacgaaaaccaacccgtcgccgccaactattccgccgaaggcacggatgtcgatttcggacggctgacgcgccagatggtgaaatatttgcagggcaagggcgtaaaaaccgagttcaaccgccacgtcgaagacatcaaacgcgaatccgacggcgcgtgggtgctcaaaaccgccgatacccgcaacccagactggcagctcaccctccgcacccgcttcctcttcctcggcgcgggcggcggcgcactgaccctgctgcaaaaatccggcatccccgaaggcaaaggctacggcggcttacccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtagacggcaaacgacaccttatgttcggtccttacgcaggtttccgttccaacttcctcaagcaaggctcgtttatggatttgccgctgtccatccatatggacaacctctatcctatgctgcgcgccggctgggcgaatatgccgctgaccaaatacctgctgggcgaattgcgtaaaaccaaagaagaacgctttgcctccctgctggaatactaccccgaggcaaaccccgacgactgggaactcatcaccgcagggcaacgcgtccaaatcattaaaaaagactccgaaaaaggcggcgtgctgcagtttggtacggagattgtcgcccacgccgacggctcgctcgccgcattgctgggagcgtcgccgggcgcatcgaccgctgtgccgctgatgatccggctgatgcaccaatgcttccccgagcgcgccccgtcttgggaaggtcgtctgaaagagctggtaccgggttacggcatcaagttgaacgaaaaccctgaaagggcggatgaaattatcgcctataccgcgaaagtgttggatatt

SEQ ID NO: 464 - protein, 488 aa, Neisseria gonorrhoeae
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERAPSWEGRLKELVPGYGIKLNENPERADEIIAYTAKVLDI

SEQ ID NO: 465 - DNA, 102 bp, Neisseria gonorrhoeae
atggcaaacaccgccgcccgcaccatgccgtctgaagaaaactacacaaataccgccgcttatattacaatcgccgccccgtggttcgaaaacctcccacac

SEQ ID NO: 466 - protein, 34 aa, Neisseria gonorrhoeae
MANTAARTMPSEENYTNTAAYITIAAPWFENLPH

SEQ ID NO: 467 - DNA, 1632 bp, Neisseria gonorrhoeae
atgaccaaattcattttcgtaaccggcggcgttgtctcctcactgggtaaaggtatcgccgccgcttctattgccgccatcctcgaatcgcgcggcttgaacgttaccatgctcaagcttgatccttatatcaacgtcgatcccggcacgatgagcccgttccaacacggcgaagtgttcgtaaccgacgacggcgcggaaaccgacctcgacttgggacactacgaacgtttcatcgattccacgatgacccgccgcaacagcttcagcacgggtcaggtgtacgaaaacgttatcgccaaagaacgccgcggcgactatctcggcggtacggttcaagtcatcccgcacattaccgacgaaatcaaacgacgcatccacgaaggcgcggcgggttacgatgtggcgattgtcgaaatcggcggtacggtcggcgacatcgaatcgctgccgtttttggaagccatccgccagatgcgaagccagttgggacgcaacaacaccctgttcgcccacttgagctacgttccctacatcgccgccgcaggcgaaatcaaaaccaagccgacccagcacaccgtgaaagaaatgttgagcatcggcttgcaacccgacatcctgatttgccgtatggacaggaaaatgccggcagacgaacgccgcaaaatcgccttgttctgcaacgtggaagagcgcgcgattgtcggcagctacgatgtggacagcatctacgaatgccccgaaatgctgcacgaccaaggcatcgacaacatcattaccgagcagttgcagcttaacgtgcagcaggcggatttgaccgcgtggaaaaaaatcgtccacgccgtcaaaaacccgaaacacaccgtcaaaatcgcgatggtcggcaaatacgttgatttgaccgaatcctacaaatcattgattgaagccttgaaacacgcgggcatccataccgaaaccgatgtgcagattaccttcgttgacagcgaaagcatcgagaaaaacaagggcgacgtttccgtactcaaagatatggatgccatcctcgttcccggcggcttcggttcgcgcggcgtggaaggcaaaatcgccgccgtgcgctacgcccgtgaaaacaacgtgccatacttgggcatctgcctcggtatgcagattgcgctgattgaatacgcccgcgacgtggcaggtttgaaaggtgcgaattccactgagtttgacttgaaatgcgctgcccccgtcgtcgccctgattgacgaatggcaaaccgccgacggcagcgtcgaaacccgtgacgaatccgccgatttgggcggcacgatgcgtttgggcgcgcaagaagtcgaattgaaagcaggcagcctcgccgtcaaaatctacggcagcggacacattcgcgaacgccaccgccaccgctacgaagtcaacaacaactatgtttccgcgctggaacaggcaggtttggtcatcggcggcgtatccgccggacgcgaacgcttggtcgaaaccatcgaactgccgaaccatccttggttcttcgcctgccagttccatcccgagttcacgtccaacccgcgcaaagggcatcctttgttcaccgcgtttgtcaaagccgcgttgaacaataaaaaagcc

SEQ ID NO: 468 - protein, 544 aa, Neisseria gonorrhoeae
MTKFIFVTGGVVSSLGKGIAAASIAAILESRGLNVTMLKLDPYINVDPGTMSPFQHGEVFVTDDGAETDLDLGHYERFIDSTMTRRNSFSTGQVYENVIAKERRGDYLGGTVQVIPHITDEIKRRIHEGAAGYDVAIVEIGGTVGDIESLPFLEAIRQMRSQLGRNNTLFAHLSYVPYIAAAGEIKTKPTQHTVKEMLSIGLQPDILICRMDRKMPADERRKIALFCNVEERAIVGSYDVDSIYECPEMLHDQGIDNIITEQLQLNVQQADLTAWKKIVHAVKNPKHTVKIAMVGKYVDLTESYKSLIEALKHAGIHTETDVQITFVDSESIEKNKGDVSVLKDMDAILVPGGFGSRGVEGKIAAVRYARENNVPYLGICLGMQIALIEYARDVAGLKGANSTEFDLKCAAPVVALIDEWQTADGSVETRDESADLGGTMRLGAQEVELKAGSLAVKIYGSGHIRERHRHRYEVNNNYVSALEQAGLVIGGVSAGRERLVETIELPNHPWFFACQFHPEFTSNPRKGHPLFTAFVKAALNNKKA

SEQ ID NO: 469 - DNA, 558 bp, Neisseria gonorrhoeae
atgccgtctgaaacaccggacaggccgccgtatcccgcctgccgcccctgcctcaaaccgccgaaccgcccgaacccgcctttttacaaactttatccaatttcctgtttatttcaggatacgccgacattagaatgtcaaaccgtccgaaacgggcaaactccacatccatccaaaggaataaaaatgaaacttctgaccaccgcaatcctgtcttccgcaatcgcgctcagcagtatggctgctgctgccggcacgaacaaccccaccgttgccaaaaaaaccgtcagctacgtctgccagcaaggtaaaaaagtcaaagtaacctacggctttaacaaacagggcctgaccacatacgcctccgccgtcatcaacggcaaacgtgtgcaaatgcccatcaatttggataaatccgacaatatggacacgttctacggcaaagaaggcggttatgtgctgagcaccggcgcaatggacagcaaatcctaccgcaaacagcctattatgattaccgcacctgacaaccaaatcgtcttcaaagactgttccccacgt

SEQ ID NO: 470 - protein, 186 aa, Neisseria gonorrhoeae
MPSETPDRPPYPACRPCLKPPNRPNPPFYKLYPISCLFQDTPTLECQTVRNGQTPHPSKGIKMKLLTTAILSSAIALSSMAAAAGTNNPTVAKKTVSYVCQQGKKVKVTYGFNKQGLTTYASAVINGKRVQMPINLDKSDNMDTFYGKEGGYVLSTGAMDSKSYRKQPIMITAPDNQIVFKDCSPR

SEQ ID NO: 471 - DNA, 297 bp, Neisseria gonorrhoeae
atgaaaatatttgaaaatatagaagatgttaaagccatccgtaaaaagaccgggatgaaccagatagacttctggggcaaggtcggcgttactcaatccggaggttcacgctacgaaaccggccgtaagatgcccaaacccgtacgcgaactgctccgcctcgtccatatcgaatgcctcgatttggcaaaagtcaacaaaaaagatatggaaatcgccgccctgttgaaaaaacaccatcccgacctgtatgccgagttgtccaaacagaccaagtccgaaagaaaaaaacaaagt

SEQ ID NO: 472 - protein, 99 aa, Neisseria gonorrhoeae
MKIFENIEDVKAIRKKTGMNQIDFWGKVGVTQSGGSRYETGRKMPKPVRELLRLVHIECLDLAKVNKKDMEIAALLKKHHPDLYAELSKQTKSERKKQS

SEQ ID NO: 473 - DNA, 93 bp, Neisseria gonorrhoeae
atgcaatataaaaacaggcttgacccggcacattacgaaaacaaagcaaatcggaatttgccccgcaaccagaaaaacttaaaggaagtttta

SEQ ID NO: 474 - protein, 31 aa, Neisseria gonorrhoeae
MQYKNRLDPAHYENKANRNLPRNQKNLKEVL

SEQ ID NO: 475 - DNA, 645 bp, Neisseria gonorrhoeae
ttgtttacgactaccacgtcaacgtccaaggcggctatcccgccccccctccactacggcaacccgccctaccccaaatcctgctgcacctccgtcaaccacgtcatctgccacggcattcccgacgacaagccgctcaaagaaggtgacattatcaacatcgacctcaccatcaaaaaagacggtttccacggcgactccagccgtatgtttaccgtcggcaaagtctcccccatcgcccaacgcctgatcgacgtaacccacgcctctatgatggcgggcatagaagccgtcaaacctggcgcgacgctgggcggcgtaggttacgcctgccagcaggttgccgaaaatgcaggttattcggttgtacaagaattctgcggacacggcatcgggcgcggtttccacgaagccccgcaagtgttgcactacggaaaaaaagggcagggtcccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtaaccgaaaccggctacgaaatcctcaccgtcagccccgccaccggcaaaccc

SEQ ID NO: 476 - protein, 215 aa, Neisseria gonorrhoeae
LFTTTTSTSKAAIPPPLHYGNPPYPKSCCTSVNHVICHGIPDDKPLKEGDIINIDLTIKKDGFHGDSSRMFTVGKVSPIAQRLIDVTHASMMAGIEAVKPGATLGGVGYACQQVAENAGYSVVQEFCGHGIGRGFHEAPQVLHYGKKGQGPVLKPGMIFTVEPMINQGKRHLRILNDGWTVVTKDRSLSAQWEHEVLVTETGYEILTVSPATGKP

SEQ ID NO: 477 - DNA, 168 bp, Neisseria gonorrhoeae
gatgcaatattcaaaaaacaacgcttcaggtggcaaaactgaaaatatatttcgtttatatatgacatggcaaacaccgccgcccgcaccatgccgtctgaagaaaactacacaaataccgccgcttatattacaatcgccgccccgtggttcgaaaacctcccacac

SEQ ID NO: 478 - protein, 13 aa, Neisseria gonorrhoeae
DAIFKKQRFRWQN

SEQ ID NO: 479 - DNA, 348 bp, Neisseria gonorrhoeae
gtgttctcccgcctgacttatctgggtgcgaaaaaggccaaagacgcgcaatacaccgtttatgaaaacaagggccggggtacgcctttgcagaaaaaggtaaaagattacccgtggctgaacaagtcggcttatgtgtttgatatgtacggcttctacaaaccggctaaaaacctgactttgcgtgcaggcgtatataatgtgttcaaccgcaaatacaccacttgggattccctgcgcggtttgtatagctacagcaccaccaacgcggtcgaccgagatggcaaaggcttagaccgctaccgcgcctcaggccgtaattacgccgtatcgctggaatggaagttt

SEQ ID NO: 480 - protein, 116 aa, Neisseria gonorrhoeae
VFSRLTYLGAKKAKDAQYTVYENKGRGTPLQKKVKDYPWLNKSAYVFDMYGFYKPAKNLTLRAGVYNVFNRKYTTWDSLRGLYSYSTTNAVDRDGKGLDRYRASGRNYAVSLEWKF

SEQ ID NO: 481 - DNA, 648 bp, Neisseria gonorrhoeae
atgccgtctgaaccgccttcagacggcattgcccgacaccccaaaagcacaatcaaaatggcaaaaaaaccgaacaaacccttcaggctgacccccaaactcctgatacgcgccgtattgctcatctgtatcaccgccatcggcgcattggcagtaggcatcgtcagcacattcaacccgaacggcgacaaaaccctccaaaccgaaccgcaacacaccgacagcccccgcgaaaccgaattctggctgccaaacggcgccgtcggacaagatgccgcccaacccgaacaccaccacgccgcctcatccgaacccgcacagccggacggcacagaagaaagcggcagcggactgccgtcccctgccgcacccaagaaaaaccgggtcaaaccgcgcccttcggatgcggcccgggcagccgattcgttaaccggcaccggaacacaagctgaaaacacactcaaagaaacccccgtactgcccacaaacgccccccatcccgaaccccgaaaagaaacacccgaaaaacaggcgcagcccaaagaaacacccaaagaaaaagaaacgcccaaagaaaaccataccaaaccggacaccccgaaaaacacgccggccaaaccccataaagagattctcgacaacctcttt

SEQ ID NO: 482 - protein, 216 aa, Neisseria gonorrhoeae
MPSEPPSDGIARHPKSTIKMAKKPNKPFRLTPKLLIRAVLLICITAIGALAVGIVSTFNPNGDKTLQTEPQHTDSPRETEFWLPNGAVGQDAAQPEHHHAASSEPAQPDGTEESGSGLPSPAAPKKNRVKPRPSDAARAADSLTGTGTQAENTLKETPVLPTNAPHPEPRKETPEKQAQPKETPKEKETPKENHTKPDTPKNTPAKPHKEILDNLF

SEQ ID NO: 483 - DNA, 606 bp, Neisseria gonorrhoeae
atgaaacccaaaccacacaccgtccgcaccctgattgccgccgtcctcagccttgccctcggcggctgcttcagcgcagtcgtcggcggggccgccgtcggcgcaaaatccgtcatcgaccgccgaaccaccggcgcgcaaaccgatgacaacgttatggcgttgcgtatcgaaaccaccgcccgttcctacctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtatacaactacattaccgtcgcctccctgccgcgcactgcgggcgacatcgccggcgacacttggaacacgtccaaagtccgcgccacgctgctgggcatcagccccgctacacaggcgcgcgtcaaaatcattacctacggcaatgtaacctacgttatgggcatcctcacccccgaagaacaggcgcagattacccaaaaagtcagcaccaccgtcggcgtacaaaaagtcattaccctctaccaaaactacgtccaacgc

SEQ ID NO: 484 - protein, 202 aa, Neisseria gonorrhoeae
MKPKPHTVRTLIAAVLSLALGGCFSAVVGGAAVGAKSVIDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIITYGNVTYVMGILTPEEQAQITQKVSTTVGVQKVITLYQNYVQR

SEQ ID NO: 485 - DNA, 1419 bp, Neisseria gonorrhoeae
ttgcccagctcgcgcattttttcgatttcttcgggggttttgatgatgatgccgttcataatgcttccttggattgcgggtgtgcctgccgtgccgggtcaaaagaggttgtcgagaatctctttatggggtttggccggcgtgtttttcggggtgtccggtttggtatggttttctttgggcgtttctttttctttgggtgtttctttgggctgcgcctgtttttcgggtgtttcttttcggggttcgggatggggggcgtttgtgggcagtacgggggtttctttgagtgtgttttcagcttgtgttccggtgccggttaacgaatcggctgcccgggccgcatccgaagggcgcggtttgacccggtttttcttgggtgcggcaggggacggcagtccgctgccgctttcttctgtgccgtccggctgtgcgggttcggatgaggcggcgtggtggtgttcgggttgggcggcatcttgtccgacggcgccgtttggcagccagaattcggtttcgcgggggctgtcggtgtgttgcggttcggtttggagggttttgtcgccgttcgggttgaatgtgctgacgatgcctactgccaatgcgccgatggcggtgatacagatgagcaatacggcgcgtatcaggagtttgggggtcagcctgaagggtttgttcggtttttttgccattttgattgtgcttttggggtgtcgggcaatgccgtctgaaggcggttcagacggcattgccgagtcagcgttggacgtagttttggtagagggtaatgactttttgtacgccgacggtggtgctgactttttgggtaatctgcgcctgttcttcgggggtgaggatgcccataacgtaggttacattgccgtaggtaatgattttgacgcgcgcctgtgtagcggggctgatgcccagcagcgtggcgcggactttggacgtgttccaagtgtcgccggcgatgtcgcccgcagtgcgcggcagggaggcgacggtaatgtagttgtatacgccttcggcggcctgttcggaacgtgcaatctgaccgacgaactgtttttcgccttcggtggcgacttgtccgagcagcagcaggtggcggttgtagccgacgacggagatttggggcgtgtagcctttggtttggttgttttggcgcaggtaggaacgggcggtggtttcgatacgcaacgccataacgttgtcatcggtttgcgcgccggtggttcggcggtcgatgacggattttgcgccgacggcggccccgccgacgactgcgctgaagcagccgccgagggcaaggctgaggacggcggcaatcagggtgcggacggtgtgtggtttgggtttcatcggggacttcctttcttgggcgtttcagacggcattgctttgcgccatgccgtc

SEQ ID NO: 486 - protein, 473 aa, Neisseria gonorrhoeae
LPSSRIFSISSGVLMMMPFIMLPWIAGVPAVPGQKRLSRISLWGLAGVFFGVSGLVWFSLGVSFSLGVSLGCACFSGVSFRGSGWGAFVGSTGVSLSVFSACVPVPVNESAARAASEGRGLTRFFLGAAGDGSPLPLSSVPSGCAGSDEAAWWCSGWAASCPTAPFGSQNSVSRGLSVCCGSVWRVLSPFGLNVLTMPTANAPMAVIQMSNTARIRSLGVSLKGLFGFFAILIVLLGCRAMPSEGGSDGIAESALDVVLVEGNDFLYADGGADFLGNLRLFFGGEDAHNVGYIAVGNDFDARLCSGADAQQRGADFGRVPSVAGDVARSARQGGDGNVVVYAFGGLFGTCNLTDELFFAFGGDLSEQQQVAVVADDGDLGRVAFGLVVLAQVGTGGGFDTQRHNVVIGLRAGGSAVDDGFCADGGPADDCAEAAAEGKAEDGGNQGADGVWFGFHRGLPFLGVSDGIALRHAV

SEQ ID NO: 487 - DNA, 483 bp, Neisseria gonorrhoeae
atgctgcaatgcctgatgaacgacggcaaaatcctggcctgcggcaacggcggttcggctgccgacgcgcaacacttcgccgccgaaatgaccgggcgttttgagaaagaacgcatggaactcgccgccgtcgccctgaccacagacacctccgcgctgaccgccatcggcaacgactacggtttcgaccacgtattcagcaaacaagtgcgcgcgctcggacgtgcaggcgacgtcctcgtcggcatttccacctccggcaattccgccaacgtcatcgaagccgtcaaagccgcacacgaacgcgatatgcacgtcatcgccctgaccggccgcgacggcggcaaaatcgccgccatgctcaaagacaccgacgttctgctcaacgtcccccatccgcgcaccgcccgcattcaggaaaaccacatcctgctgatacacgccatgtgcgactgtatcgactccgtactgctggaaggaatg

SEQ ID NO: 488 - protein, 161 aa, Neisseria gonorrhoeae
MLQCLMNDGKILACGNGGSAADAQHFAAEMTGRFEKERMELAAVALTTDTSALTAIGNDYGFDHVFSKQVRALGRAGDVLVGISTSGNSANVIEAVKAAHERDMHVIALTGRDGGKIAAMLKDTDVLLNVPHPRTARIQENHILLIHAMCDCIDSVLLEGM

SEQ ID NO: 489 - DNA, 345 bp, Neisseria gonorrhoeae
atgcgcttaaaccacaaacagggtacggcaggggaagatgccgcacttgccttcctccaatcccaaggctgcacgctgcttgcccgcaactggcactgcgcctacggcgaaatcgacctgattgtcaaaaacggcggcatgattctgtttgttgaagtaaaataccgcaaaaaccaacggttcggcggcgcggcatacagcatttctccgtccaaattattgaaactgcaacgaagtgtagagtattatctgcaacagaacaggctgacaaacgtaccgtgccgcctcgatgcggtacttatcgaaggaaaccgcccgcccgagtggataaagaatattacaggt

SEQ ID NO: 490 - protein, 115 aa, Neisseria gonorrhoeae
MRLNHKQGTAGEDAALAFLQSQGCTLLARNWHCAYGEIDLIVKNGGMILFVEVKYRKNQRFGGAAYSISPSKLLKLQRSVEYYLQQNRLTNVPCRLDAVLIEGNRPPEWIKNITG

SEQ ID NO: 491 - DNA, 936 bp, Neisseria gonorrhoeae
ttgtggtttaagcgcataatcggtttaacctttataatgtctgtttttcagacggcattttttatgtttcagaaacacttgcagaaagcctccgacagcgtcgtcggagggacattatacgtggttgccacgcccatcggcaatttggcagacattaccctgcgcgctttggcggtattgcaaaaggcggacatcatttgtgccgaagacacgcgcgttactgcgcagcttttgagcgcgtacggcattcagggcaggttggtcagtgtgcgcgaacacaacgagcggcagatggcggacaaggtaatcggtttcctttcagacggcctggttgtggcgcaggtttccgatgcgggtacgccggccgtgtgcgacccgggcgcgaaactcgcccgccgcgtgcgcgaagcagggttcaaagtcgttcccgtcgtgggcgcaagcgcggtaatggcggcgttgagtgtggccggtgtggcggaatccgatttttatttcaacggttttgtaccgccgaaatcgggcgaacgtaggaaattgtttgccaaatgggtgcgggcggcatttcctgtcgtcatgtttgaaacgccgcaccgaatcggggcaacgcttgccgatatggcggaattgttccccgaacgccgtctgatgctggcgcgcgaaatcacgaaaacgtttgaaacgttcttaagcggcacggttggggaaattcagacggcattggcggcggacggcaaccaatcgcgcggcgagatggtgttggtgctttatccggcgcaggatgaaaaacacgaaggcttgtccgagtctgcgcaaaatgcgatgaaaatccttgcggccgagctgccgaccaagcaggcggcggagcttgccgccaagattacaggtgagggcaaaaaggctttgtacgatttggcactgtcgtggaaaaacaaa

SEQ ID NO: 492 - protein, 312 aa, Neisseria gonorrhoeae
LWFKRIIGLTFIMSVFQTAFFMFQKHLQKASDSVVGGTLYVVATPIGNLADITLRALAVLQKADIICAEDTRVTAQLLSAYGIQGRLVSVREHNERQMADKVIGFLSDGLVVAQVSDAGTPAVCDPGAKLARRVREAGFKVVPVVGASAVMAALSVAGVAESDFYFNGFVPPKSGERRKLFAKWVRAAFPVVMFETPHRIGATLADMAELFPERRLMLAREITKTFETFLSGTVGEIQTALAADGNQSRGEMVLVLYPAQDEKHEGLSESAQNAMKILAAELPTKQAAELAAKITGEGKKALYDLALSWKNK

SEQ ID NO: 493 - DNA, 471 bp, Neisseria gonorrhoeae
atgtcccgcaacaacgaagagctgcaaggcatctctcttttgggtaatcaaaaaacccaatatccgaccggctacgcgcctgaaattctcgaagcattcgacaacaaacatcccgacaacgactatttcgtcaaattcgtctgccccgaattcaccagcctctgcccgatgaccgggcagcccgacttcgccaccatcgtcatccgctatatcccgcacatcaaaatggtggaaagcaaatccctgaaactctacctcttcagcttccgcaaccacggcgattttcatgaagactgcgtcaacatcatcatgaaagacctcatcgccctgatggatccgaaatacatcgaagtgttcggcgagttcacaccgcgcggcggcatcgccgttcatccgtttgccaactacggcaaagcaggcacagagtttgaagcattggcacgcaaacgcctgttcgagcacgacgcacaa

SEQ ID NO: 494 - protein, 157 aa, Neisseria gonorrhoeae
MSRNNEELQGISLLGNQKTQYPTGYAPEILEAFDNKHPDNDYFVKFVCPEFTSLCPMTGQPDFATIVIRYIPHIKMVESKSLKLYLFSFRNHGDFHEDCVNIIMKDLIALMDPKYIEVFGEFTPRGGIAVHPFANYGKAGTEFEALARKRLFEHDAQ

SEQ ID NO: 495 - DNA, 864 bp, Neisseria gonorrhoeae
ttgtcgtttaaaactttcgccagtcggcgtgagtttgaaaacttaaaccgcgacgattattacttcagcggacagatatcccgtactaccagctcgattcaacaccctgtgaaaaccactaattatggtttctcactgtctgatcaaatccaatggaacgacgtgttcagcagccgtgcagatatccgttacgatcataccaaaatgacgcctcaggaattgaatgccgagtgtcatgcttgtgacaaaacaccgcctgcagccaatacttataaaggctggagcggatttgtcggtttggcggcgcaactgaatcaggcttggcatgtcggttacgacattacttccggctaccgtgtccccaatgcgtccgaagtgtatttcacttacaaccacggttcgggtaattggctgcccaattccaacctgaaagccgagcgcagcaccacccacaccctgtctctgcaaggccgcagcgaaaaaggtactttggatgccaacctgtatcaaaacaattaccgcaacttcttgtctgaagagcagaagctgaccaccagcggcgatgtcggctgtactcagatgaattactactacggtatgtgtagcaatccttattccgaaaaaccggaatggcagatgcaaaatatcgataaggcccgaatccgtggtcttgagctgacaggccgtctgaatgtggacaaaatagcgtcttttgttcctgagggctggaaattgttcggctcgctgggttatgcgaaaagcaaactgtcgggcgacaacagcctgctgtccacacagccgccgaaagtgattgccggtgtcgactacgaagcccgagcgaaaaatggggtgtgttctcccgcc

SEQ ID NO: 496 - protein, 288 aa, Neisseria gonorrhoeae
LSFKTFASRREFENLNRDDYYFSGQISRTTSSIQHPVKTTNYGFSLSDQIQWNDVFSSRADIRYDHTKMTPQELNAECHACDKTPPAANTYKGWSGFVGLAAQLNQAWHVGYDITSGYRVPNASEVYFTYNHGSGNWLPNSNLKAERSTTHTLSLQGRSEKGTLDANLYQNNYRNFLSEEQKLTTSGDVGCTQMNYYYGMCSNPYSEKPEWQMQNIDKARIRGLELTGRLNVDKIASFVPEGWKLFGSLGYAKSKLSGDNSLLSTQPPKVIAGVDYEARAKNGVCSPA

SEQ ID NO: 497 - DNA, 1668 bp, Neisseria gonorrhoeae
atggaaaaaatctggttagaaagctacgagaagggcgtcagtgccgaaatcgacatcacgcaatacaattccgtcagcgacgtattccgccaaagcgtggaaaaatttgcccgtctgcccgcttttcaaaatatgggcaaaacgctcacttatgccgaaaccggcaaactggcgaccgatttcgcctcttatctgcaaaacgtcctcaagctgccgcgcggcgaacgtgttgccattatgatgccgaacgtattgcaatatccgattgcccttttcggtattttgcaggcaggtttggtggcggtgaacaccaatccgctctatacgccgcgcgagttggagcatcagctgaaagacagcggtgcgaccgccatcatcgttttggaaaatttcgccaacacgctggagctggtgctgccgcgcacgcagatcaaacacgtcatcgtcgcctccgtcggcgaaatgttcgggctgcttaaaggttcgctgatcaatttcatcatccgaaaaatcaagaaaatggttcccgaataccgtattcgggaaaccgtttcctttcagacggcattgaaagagggggcgaagcacgttttccaacctgtcgcattaaaccgcgaagataccgcattgttgcaatacacgggcggcacgacaggcgttgccagaggcgcggtgctgagccacggcaacatctgcgccaatatgcttcaggcaaaagaatggattaaaaaccaattgcgcgagggaaaagaaaccgttatcgccgccctgccgctgtaccacatcttcgccctgacagtgaatctgatgatttttgccaatgccggctcgaaaattgtcctgattgccaacccgcgcgatatgaaaggctttatcggcgaactgaaaaagcagcgggttaacgtatttatcggcgtgaacacgctgtttaacgcgatggtcaaccggcccgatttcgccgaagtcgatttttcaggattgcggctgactttgggcggcggtatggcgacccaaaaagccgttgccgaaaaatggaaaaaaatcaccggcacgcccatcgtcgaagcctacggtttgaccgaagccagccccggcgtgtgctgcaaccccttaaacatcgaatcatacagcggcagcatcggtttgcccgtcccgtccaccgaagtcgaactgcgcgacgcaaacggcaaagaagtccccgttgggcagccgggcgaattgtgggtaaaaggcccgcaagtgatgcaaggctactggaaccgccccgaagaaaccgccaaagccatagacgcgtgcggctttttggaaaccggcgatattgccgtgatggacgaaaaaggccgtctgaagctggtcgatcgcaaaaaagacctcgtcgtcgtttccggattcaatgtttatccgaacgaaatcgaggaattcatcgcgcaccacgaaaaagttatggaagttgcgtgtatcggcgttccgaacgaaaaaaccggcgaggcactcaaagtgttcgtcgtcaaaaaagacccgtctttgaccaaagaagaactcaccgctttctgccgtaccggtctgaccgcatacaaagtgccgaaagacatcgaattccgcgacgagttgcccaagtccaatgtcggcaaaatcctgcgccgcgagttgcgccaaagtgccgggaaa

SEQ ID NO: 498 - protein, 556 aa, Neisseria gonorrhoeae
MEKIWLESYEKGVSAEIDITQYNSVSDVFRQSVEKFARLPAFQNMGKTLTYAETGKLATDFASYLQNVLKLPRGERVAIMMPNVLQYPIALFGILQAGLVAVNTNPLYTPRELEHQLKDSGATAIIVLENFANTLELVLPRTQIKHVIVASVGEMFGLLKGSLINFIIRKIKKMVPEYRIRETVSFQTALKEGAKHVFQPVALNREDTALLQYTGGTTGVARGAVLSHGNICANMLQAKEWIKNQLREGKETVIAALPLYHIFALTVNLMIFANAGSKIVLIANPRDMKGFIGELKKQRVNVFIGVNTLFNAMVNRPDFAEVDFSGLRLTLGGGMATQKAVAEKWKKITGTPIVEAYGLTEASPGVCCNPLNIESYSGSIGLPVPSTEVELRDANGKEVPVGQPGELWVKGPQVMQGYWNRPEETAKAIDACGFLETGDIAVMDEKGRLKLVDRKKDLVVVSGFNVYPNEIEEFIAHHEKVMEVACIGVPNEKTGEALKVFVVKKDPSLTKEELTAFCRTGLTAYKVPKDIEFRDELPKSNVGKILRRELRQSAGK

SEQ ID NO: 499 - DNA, 252 bp, Neisseria gonorrhoeae
atgccgtctgaaaacatcttcagacggcattataaaatctgttcaccttttcagatgagtaatgtacacccctatacaatttttgctaccatgcaccataaatccacggctaaagataattgggtttattcttttatccagaaacaatccagatacggatcacgggtcataactataggcttaatattacacgattctcattccatcaaggcggaaaaccgcacaaatactgaaacactatcgatcgatttg

SEQ ID NO: 500 - protein, 84 aa, Neisseria gonorrhoeae
MPSENIFRRHYKICSPFQMSNVHPYTIFATMHHKSTAKDNWVYSFIQKQSRYGSRVITIGLILHDSHSIKAENRTNTETLSIDL

SEQ ID NO: 501 - DNA, 90 bp, Neisseria gonorrhoeae
ataaaattcaacaaaattaaacggttgcgcgaatatatttgtgtaaccgtgcatttgcatatcgtaaataaacgtaaataaaaataacaa

SEQ ID NO: 502 - protein, 26 aa, Neisseria gonorrhoeae
IKFNKIKRLREYICVTVHLHIVNKRK

SEQ ID NO: 503 - DNA, 528 bp, Neisseria gonorrhoeae
atgaacacaaaccaacctgccgtttacgacccgttgacacgcgcgctgcactggctgaccgttgccggcttcatcggcattctgaccaccattgtcctgtggacaatttacgaagaggcggaatgggcgggcagcctgttcggcctgcacaaatctttcggtttcctcatgctgacggtgattgcattgcgcatcgtgtgggcggttgccaaccgcgccaagcgtccgcaaagcgacagcaaggcggcagcggcaggacacggcattctgtatctgctcatgcttgccgttcccgttatcggcatgatccgccaatacggtggcggacgcggcccgttgaaagtgttcggcgttgaagtaatgcagggttcgccggaaaaaatcgagtggatggcaaacttgggcaacacgttccacggcaatttgggctggctgctgtttgccgccgtcgtcggacacgtcgccatggtcgtcgtccaccgtgttcaaggcaaagacgtgctgtaccgcatgacggggcgtgtccgt

SEQ ID NO: 504 - protein, 176 aa, Neisseria gonorrhoeae
MNTNQPAVYDPLTRALHWLTVAGFIGILTTIVLWTIYEEAEWAGSLFGLHKSFGFLMLTVIALRIVWAVANRAKRPQSDSKAAAAGHGILYLLMLAVPVIGMIRQYGGGRGPLKVFGVEVMQGSPEKIEWMANLGNTFHGNLGWLLFAAVVGHVAMVVVHRVQGKDVLYRMTGRVR

SEQ ID NO: 505 - DNA, 912 bp, Neisseria gonorrhoeae
ttgccgccaagattacaggtgagggcaaaaaggctttgtacgatttggcactgtcgtggaaaaacaaatgatgccggatggaccggcaccatagtgcgaacggaatcaacggacacgccccgtcatgcggtacagcacgtctttgccttgaacacggtggacgacgaccatggcgacgtgtccgacgacggcggcaaacagcagccagcccaaattgccgtggaacgtgttgcccaagtttgccatccactcgattttttccggcgaaccctgcattacttcaacgccgaacactttcaacgggccgcgtccgccaccgtattggcggatcatgccgataacgggaacggcaagcatgagcagatacagaatgccgtgtcctgccgctgccgccttgctgtcgctttgcggacgcttggcgcggttggcaaccgcccacacgatgcgcaatgcaatcaccgtcagcatgaggaaaccgaaagatttgtgcaggccgaacaggctgcccgcccattccgcctcttcgtaaattgtccacaggacaatggtggtcagaatgccgatgaagccggcaacggtcagccagtgcagcgcgcgtgtcaacgggtcgtaaacggcaggttggtttgtgttcataaaaaaatccttatcatatgtaacggtttgaacggacattccgtcgggtcggaatgtcaaaaaggcgcgattgtaccaaagaagttggacatattttgtttgcaggctgaagatttgcttaaaaattcattaagatgggcagaacaaatagtttctccgcggtatattgaaataccgcttataccttataatgtcggcagaaaatctgttcagacggcatcaaaacatatggcaatccgcctgaaaccctatttaaaaccaacaaacaagagcatt

SEQ ID NO: 506 - protein, 304 aa, Neisseria gonorrhoeae
LPPRLQVRAKRLCTIWHCRGKTNDAGWTGTIVRTESTDTPRHAVQHVFALNTVDDDHGDVSDDGGKQQPAQIAVERVAQVCHPLDFFRRTLHYFNAEHFQRAASATVLADHADNGNGKHEQIQNAVSCRCRLAVALRTLGAVGNRPHDAQCNHRQHEETERFVQAEQAARPFRLFVNCPQDNGGQNADEAGNGQPVQRACQRVVNGRLVCVHKKILIICNGLNGHSVGSECQKGAIVPKKLDIFCLQAEDLLKNSLRWAEQIVSPRYIEIPLIPYNVGRKSVQTASKHMAIRLKPYLKPTNKSI

SEQ ID NO: 507 - DNA, 1152 bp, Neisseria gonorrhoeae
atgaaattcatcgacgaagcaaaaatcgaagtcgccgcaggcaaaggcggtaatggcgcaaccagtttccgccgcgaaaaattcgtaccccgcggcggcccggacggtggcgacggcggcaaaggcggcagcgtctgggcagaagccgacgaaaacaccaacaccctcgtcgaataccgcttcgtcaaacgctaccaagccaaaaacggcgaaaaaggccacggttccgaccgctacggcgcaggtgcggacgacattgtcctcaaaatgcccgtcggcacccttatccgcgacctcgacaccgacgaaatcgttgccgacctcacctaccacggacagcgcgtctgcctcgccaaaggcggcaaaggcggcttgggcaacatccacttcaaatcctccgtcaaccgcgccccaaaacaatccacgcccggcgaagaaggcgaaacccgttccctgcaactcgaactcaaagtcctcgccgatgtcggcttgttaggcatgcccaacgccggcaaatccaccctgattaccgccgtctccgccgcacgccccaaaatcgccaactaccccttcaccaccctgcatccgaacttgggcgtggtacgcatcgacgaaaaccacagcttcgtgatggccgacatccccggcctgattgaaggcgcggcagaaggcgcaggcctcggccaccgcttcctcaaacacctatcacgcaccggtctgctgttacacgttgtcgatttggcacccttcgacgaaaccgtcaatcccgccgaagaagcactcgccatcatcaacgaattacgcaaatacgacgaagaactttacggcaaaccgcgctggctggtgctgaacaaactcgatatgctcgacgaagaagaagcccgggcgcgaacagccgccttcctcgaagccgtcggctgggactaccccgaacctgatgaccgtttccaattcgacatggaaaccccgcgcctcttccaaatcagcgcgctgacacatcaaggcacgcaggagttggtacaccaaatcaaccaatacctggccgagaaaaaacgtatcgaggctgaaaaagccgaagcggagaaagcagcggcaaatgttgaaattatcgaacagcagcctaaaacggatactggcgtgtttaagccggag

SEQ ID NO: 508 - protein, 384 aa, Neisseria gonorrhoeae
MKFIDEAKIEVAAGKGGNGATSFRREKFVPRGGPDGGDGGKGGSVWAEADENTNTLVEYRFVKRYQAKNGEKGHGSDRYGAGADDIVLKMPVGTLIRDLDTDEIVADLTYHGQRVCLAKGGKGGLGNIHFKSSVNRAPKQSTPGEEGETRSLQLELKVLADVGLLGMPNAGKSTLITAVSAARPKIANYPFTTLHPNLGVVRIDENHSFVMADIPGLIEGAAEGAGLGHRFLKHLSRTGLLLHVVDLAPFDETVNPAEEALAIINELRKYDEELYGKPRWLVLNKLDMLDEEEARARTAAFLEAVGWDYPEPDDRFQFDMETPRLFQISALTHQGTQELVHQINQYLAEKKRIEAEKAEAEKAAANVEIIEQQPKTDTGVFKPE

SEQ ID NO: 509 - DNA, 945 bp, Neisseria gonorrhoeae
atgtacaaaacaatagatttattttcaggcattggcggaatacgcctaggctttgaaaaatacgggtgcaccaatgtattctcatcggaatgggacaaatatgcccgacaagtgtatgaagcaaactttggagaaaaaccttttggcgacattaacggcatcgatccttcagatattcccgatcatgatattctgcttgcgggatttccgtgccaacctttcagtatcgcaggtaagggattgggatttgaagatacgcgcggaacattgtttttcaatattgccgaaatcctgaaaaccaaacagccgaaggcttttcttctggaaaacgttaagcggctgactacgcacgattcgggcaggactttccgtattattttagaaacccttaaacagcttggttatacggtttattttaaggttttaaatactttggatttcggattgccgcaaaaacgcgagagaatttatattgtgggtttttcagacaacatccctttttactttcccgaacccataaaccaatatcggccattgggcgaactgctggaaaacgatcgagatgtcgaaccaagctattttttatcagataccttgaaacaaaaacgtttggcagccttaaaaaaagctccgcccaccccatcaatttggcatgaaaatattggcgggaatgtttccgcacttccatattcctgtgccttaagggccgggggaagttacaattatttggtggtaaacggagtaagaaggctaacaggaagggaaatgttaagattacaaggttttcccgatgattttgaaatcaatatcccctactcgcaagtcaggaaagtcgccggaaattctgtatccgtccctgtaatagaagccatcgcggaaaatatgctcgcttctctttccggcaaggtcgaacaaaaagggcaattggatttattggaggcagga

SEQ ID NO: 510 - protein, 315 aa, Neisseria gonorrhoeae
MYKTIDLFSGIGGIRLGFEKYGCTNVFSSEWDKYARQVYEANFGEKPFGDINGIDPSDIPDHDILLAGFPCQPFSIAGKGLGFEDTRGTLFFNIAEILKTKQPKAFLLENVKRLTTHDSGRTFRIILETLKQLGYTVYFKVLNTLDFGLPQKRERIYIVGFSDNIPFYFPEPINQYRPLGELLENDRDVEPSYFLSDTLKQKRLAALKKAPPTPSIWHENIGGNVSALPYSCALRAGGSYNYLVVNGVRRLTGREMLRLQGFPDDFEINIPYSQVRKVAGNSVSVPVIEAIAENMLASLSGKVEQKGQLDLLEAG

SEQ ID NO: 511 - DNA, 1050 bp, Neisseria gonorrhoeae; identical to SEQ ID NO: 223

SEQ ID NO: 512 - protein, 350 aa, Neisseria gonorrhoeae; identical to SEQ ID NO: 224

SEQ ID NO: 513 - DNA, 96 bp, Neisseria gonorrhoeae
ttgacgggtaagggtgttgtagatggcggtcatattcatcaagtaagtttagaaatgagtaacagtaatgtcatatccgcgattttgggcgaaatc

SEQ ID NO: 514 - protein, 32 aa, Neisseria gonorrhoeae
LTGKGVVDGGHIHQVSLEMSNSNVISAILGEI

SEQ ID NO: 515 - DNA, 1353 bp, Neisseria gonorrhoeae
gtgcgtatgtacgtctgcggcatgaccgtttacgactattgccacttaggccatgcccgtgtgatggtggtgttcgacatgattgcccgctggttgcgcgagtgcggttatccgctcacttatgtgcgcaacatcaccgacatcgacgacaaaatcatcgcccgtgcggctgaaaacggcgaaaccatcggcgaactgaacgcgcgtttcattcaggcgatgcacgaagatgccgatgctttgggcgtgttgcgtcccgacatcgagccgaaggcgacggaaaacatcccgcaaatgattgccatgattgagaccctgattcaaaacggcaaggcatatcctgccgcaaacggcgacgtttactacgccgtgcgcgagtttgccgcttacggacaattatcgggcaaatcgttggacgacctgcgtgcgggcgaacgcgtggaagtggacggtttcaaacgcgatccgcttgattttgtattgtggaaagcggcgaaagcaggcgaaccggcgtgggaaagcccgtggggcaacggccgtccgggttggcacatcgaatgttccgcgatgagtgaaaacctgttcggcgatacgttcgacattcacggcggcggcgcggatttgcagttcccgcaccatgaaaatgaaatcgcccaaagcgtcggtgccagcggtcacacctgcggtcatgaccacgcgcaaacccaccacggtcaaagtattgccagccacgtcaaatactggctgcacaacggcttcatccgtgtggacggcgaaaaaatgtccaaatcgctgggcaacttctttactatccgcgaagtattgaaacaatacgaccccgaagtcgtgcgtttcttcatcctgcgcgcccactaccgcagcccgttgaactactccgacgcgcatttggacgacgcgaaaggcgcgttgacccgtctgtacaccaccttgaaaaacacaccggcggctgagtttgatttgtctgaaaacgccaacggctacacccgccgtttctacgccgccatgaacgacgatttcggtacggtcgaagcggttgccgtgttgtttgagctggcaggcgaagtgaacaaaaccaatgacgcacacctcgccggctgcctgaaagctttgggcggcatcatcggcctgctgcaacgcaacccgattgagttcctccaaggcggcgcagtttcagacggcctctccaacgaagaaatcgaagacttgattgcccgacgcaaacaggctcgcgcggataaaaactgggcggagtccgaccgcatccgcgaccttctgaacgaacacaaaatcattttggaagacagcgccggcggcacgacttggcggcgcggt

SEQ ID NO: 516 - protein, 451 aa, Neisseria gonorrhoeae
VRMYVCGMTVYDYCHLGHARVMVVFDMIARWLRECGYPLTYVRNITDIDDKIIARAAENGETIGELNARFIQAMHEDADALGVLRPDIEPKATENIPQMIAMIETLIQNGKAYPAANGDVYYAVREFAAYGQLSGKSLDDLRAGERVEVDGFKRDPLDFVLWKAAKAGEPAWESPWGNGRPGWHIECSAMSENLFGDTFDIHGGGADLQFPHHENEIAQSVGASGHTCGHDHAQTHHGQSIASHVKYWLHNGFIRVDGEKMSKSLGNFFTIREVLKQYDPEVVRFFILRAHYRSPLNYSDAHLDDAKGALTRLYTTLKNTPAAEFDLSENANGYTRRFYAAMNDDFGTVEAVAVLFELAGEVNKTNDAHLAGCLKALGGIIGLLQRNPIEFLQGGAVSDGLSNEEIEDLIARRKQARADKNWAESDRIRDLLNEHKIILEDSAGGTTWRRG

SEQ ID NO: 517 - DNA, 489 bp, Neisseria gonorrhoeae
aaaaactaaggaaaccctatgtcccgcaacaacgaagagctgcaaggcatctctcttttgggtaatcaaaaaacccaatatccgaccggctacgcgcctgaaattctcgaagcattcgacaacaaacatcccgacaacgactatttcgtcaaattcgtctgccccgaattcaccagcctctgcccgatgaccgggcagcccgacttcgccaccatcgtcatccgctatatcccgcacatcaaaatggtggaaagcaaatccctgaaactctacctcttcagcttccgcaaccacggcgattttcatgaagactgcgtcaacatcatcatgaaagacctcatcgccctgatggatccgaaatacatcgaagtgttcggcgagttcacaccgcgcggcggcatcgccgttcatccgtttgccaactacggcaaagcaggcacagagtttgaagcattggcacgcaaacgcctgttcgagcacgacgcacaa

SEQ ID NO: 518 - protein, 160 aa, Neisseria gonorrhoeae
GNPMSRNNEELQGISLLGNQKTQYPTGYAPEILEAFDNKHPDNDYFVKFVCPEFTSLCPMTGQPDFATIVIRYIPHIKMVESKSLKLYLFSFRNHGDFHEDCVNIIMKDLIALMDPKYIEVFGEFTPRGGIAVHPFANYGKAGTEFEALARKRLFEHDAQ

SEQ ID NO: 519 - DNA, 222 bp, Neisseria gonorrhoeae
ttgtcgtctttgaaggcggacttcgattatcagaaaaccaaagtggcggcggttaacaacaaaggctcgttcccgatggattattccacctggacgcgcaactataaatcagaaggatttggacgaaatatacaaccgcagcatggacacccgattcaaacgttttactttgcgtatggacagccaaccgttgcaactgggcggccaacatcgcttgtcgtt

SEQ ID NO: 520 - protein, 74 aa, Neisseria gonorrhoeae
LSSLKADFDYQKTKVAAVNNKGSFPMDYSTWTRNYKSEGFGRNIQPQHGHPIQTFYFAYGQPTVATGRPTSLVV

SEQ ID NO: 521 - DNA, 261 bp, Neisseria gonorrhoeae
atgccaatagccgtgcatcccgtgcggatttttcatatcggcagacaaatcagcctcctgcgctttgagttcctgcacgcagacaatgtctgcgcccgatgcggcgatgtattcgtaaaaaccttttttgtaggcggagcggatgccgttgacgttggcggaaatgattttaagcataataaaaataagttctcacaatgttcccatacacaaagcggcacccggtgcgccgcccggtatttcccattcggtcctgcctgc

SEQ ID NO: 522 - protein, 87 aa, Neisseria gonorrhoeae
MPIAVHPVRIFHIGRQISLLRFEFLHADNVCARCGDVFVKTFFVGGADAVDVGGNDFKHNKNKFSQCSHTQSGTRCAARYFPFGPAC

SEQ ID NO: 523 - DNA, 618 bp, Neisseria gonorrhoeae
atgcacggctattggcattgcgccgagaagcgcggttacagcggtgtggcggtgtacagcaaacgcaaacccgacaatgtgcaaatcggcatgggcattgaggaattcgaccgcgaagggcggtttgtgcgttgcgatttcggcaggttgggcgtcatttcgctttatttgcccagcggcagcagcgcggaagaacgccagcaggtgaaataccgtttcctcgatgcgttttaccctatgctcgaagcgatgaaaaacgaagggcgcgacatcgtcgtctgcggcgactggaacatcgcccaccaaaacatcgacctgaaaaattggaaaggcaatcagaaaaattcgggcttcctgcccgaagagcgcgagtggataggcaaagtcatccatacgctgggctggacggacatgtggcgcacgctctatcccgatgtgccgggttatacatggtggagcaaccgcgggcaggcgtatgcgaaagatgtcgggtggcgcatcgattatcagatggttacgcccgaacttgccgccaaagccgtgtccgcacacgtttataaagatgaaaaattctcggatcacgcccctttagttgtggagtatgactatgctgccgaa

SEQ ID NO: 524 - protein, 206 aa, Neisseria gonorrhoeae
MHGYWHCAEKRGYSGVAVYSKRKPDNVQIGMGIEEFDREGRFVRCDFGRLGVISLYLPSGSSAEERQQVKYRFLDAFYPMLEAMKNEGRDIVVCGDWNIAHQNIDLKNWKGNQKNSGFLPEEREWIGKVIHTLGWTDMWRTLYPDVPGYTWWSNRGQAYAKDVGWRIDYQMVTPELAAKAVSAHVYKDEKFSDHAPLVVEYDYAAE

SEQ ID NO: 525 - DNA, 357 bp, Neisseria gonorrhoeae
ttgtggagtatgactatgctgccgaataaggttttgggtaaatatgattggaatgtggacggaaaaacaggaataggcgcggcatgggttgtcgctgcgtttatcctgcccatattggtgtgggcggtgtttatgttgtcgcggatgcaaggctggcttgcgccgaccaaggcaaacccgatatgggcgttggtgtggctgctgatttgtctgccctgcctgctgattgcggccaaatgtttgggttggaaaggctggcggcgggtggtgaatatttttgtctgcctgaccgtctgcgccatattgagcgtacccgcttcgctgctcatcgcctttaccctccgggacctgctcaaa

SEQ ID NO: 526 - protein, 119 aa, Neisseria gonorrhoeae
LWSMTMLPNKVLGKYDWNVDGKTGIGAAWVVAAFILPILVWAVFMLSRMQGWLAPTKANPIWALVWLLICLPCLLIAAKCLGWKGWRRVVNIFVCLTVCAILSVPASLLIAFTLRDLLK

SEQ ID NO: 527 - DNA, 357 bp, Neisseria gonorrhoeae
ttgagcaggtcccggagggtaaaggcgatgagcagcgaagcgggtacgctcaatatggcgcagacggtcaggcagacaaaaatattcaccacccgccgccagcctttccaacccaaacatttggccgcaatcagcaggcagggcagacaaatcagcagccacaccaacgcccatatcgggtttgccttggtcggcgcaagccagccttgcatccgcgacaacataaacaccgcccacaccaatatgggcaggataaacgcagcgacaacccatgccgcgcctattcctgtttttccgtccacattccaatcatatttacccaaaaccttattcggcagcatagtcatactccacaac

SEQ ID NO: 528 - protein, 119 aa, Neisseria gonorrhoeae
LSRSRRVKAMSSEAGTLNMAQTVRQTKIFTTRRQPFQPKHLAAISRQGRQISSHTNAHIGFALVGASQPCIRDNINTAHTNMGRINAATTHAAPIPVFPSTFQSYLPKTLFGSIVILHN

SEQ ID NO: 529 - DNA, 528 bp, Neisseria gonorrhoeae
atggaaagtttcgagcttgaggatttgacgctgtggctgatacgcgatgcggatgaagcggaaatgtggatagaccgttgggcggtcagttatcccgttgtgcagatgtccgaagcgtccgcaaacggcagcacggaagcgtggcaaagcgcgcttcagacggcattcgaacggatacagggcaggcatatcgccgttgtcgcacacggcgcgggcgcggccgcattcttggcgtggctgtaccgcgccgacatcctgacgcagaagaaactcgccggtatcattctcgtatctccgcgtcccgatatttttcccgacgatgcggaacacactttccaacgcgtccgctgtccttgccgtgccgcattggtggtgtccgaacacggcggcgtgccgcacggttgggcgcaaaaacaggcggatttgtggaacgcccgcctgttggtttccccgcattcgggcagtttgaacggtatgctcggcggctggcagtggggtatgaagctgatgcaggaaatgttgctggcg

SEQ ID NO: 530 - protein, 176 aa, Neisseria gonorrhoeae
MESFELEDLTLWLIRDADEAEMWIDRWAVSYPVVQMSEASANGSTEAWQSALQTAFERIQGRHIAVVAHGAGAAAFLAWLYRADILTQKKLAGIILVSPRPDIFPDDAEHTFQRVRCPCRAALVVSEHGGVPHGWAQKQADLWNARLLVSPHSGSLNGMLGGWQWGMKLMQEMLLA

SEQ ID NO: 531 - DNA, 828 bp, Neisseria gonorrhoeae
gtgttcggacaccaccaatgcggcacggcaaggacagcggacgcgttggaaagtgtgttccgcatcgtcgggaaaaatatcgggacgcggagatacgagaatgataccggcgagtttcttctgcgtcaggatgtcggcgcggtacagccacgccaagaatgcggccgcgcccgcgccgtgtgcgacaacggcgatatgcctgccctgtatccgttcgaatgccgtctgaagcgcgctttgccacgcttccgtgctgccgtttgcggacgcttcggacatctgcacaacgggataactgaccgcccaacggtctatccacatttccgcttcatccgcatcgcgtatcagccacagcgtcaaatcctcaagctcgaaactttccattgtccgcgactatttgagcaggtcccggagggtaaaggcgatgagcagcgaagcgggtacgctcaatatggcgcagacggtcaggcagacaaaaatattcaccacccgccgccagcctttccaacccaaacatttggccgcaatcagcaggcagggcagacaaatcagcagccacaccaacgcccatatcgggtttgccttggtcggcgcaagccagccttgcatccgcgacaacataaacaccgcccacaccaatatgggcaggataaacgcagcgacaacccatgccgcgcctattcctgtttttccgtccacattccaatcatatttacccaaaaccttattcggcagcatagtcatactccacaactaaaggggcgtgatccgagaatttttcatctttataaacgtgtgcggacacggctttggcggcaagttcgggcg

SEQ ID NO: 532 - protein, 276 aa, Neisseria gonorrhoeae
VFGHHQCGTARTADALESVFRIVGKNIGTRRYENDTGEFLLRQDVGAVQPRQECGRARAVCDNGDMPALYPFECRLKRALPRFRAAVCGRFGHLHNGITDRPTVYPHFRFIRIAYQPQRQILKLETFHCPRLFEQVPEGKGDEQRSGYAQYGADGQADKNIHHPPPAFPTQTFGRNQQAGQTNQQPHQRPYRVCLGRRKPALHPRQHKHRPHQYGQDKRSDNPCRAYSCFSVHIPIIFTQNLIRQHSHTPQLKGRDPRIFHLYKRVRTRLWRQVRA

SEQ ID NO: 533 - DNA, 1113 bp, Neisseria gonorrhoeae
atgaaagtaggtttcgtcggctggcgcggtatggtcggttcggttttgatgcagcgtatgaaagaagaaaacgacttcgcccacattcccgaagcgtttttctttacctcttccaacgtcggcggcgcggcacctgatttcggtcaggcggctaaaacattattggacgcgaacgacgttgccgagctggcgaaaatggacattatcgtcacctgccaaggcggcgattacaccaaatccgtcttccaagccctgcgcgacagcggctggaacggctactggattgacgcggcgtcctcactgcgcatgaaagacgacgcgattatcgccctcgaccccgtcaaccgcaacgtcatcgacaacggtctcaaaaacggcgtgaaaaactacatcggcggcaactgtaccgtctccctgatgctgatggctttgggcggcctgttccaaaacgatttggtcgaatgggcgaccagcatgacctaccaagccgcttccggcgcgggcgcgaaaaatatgcgcgaactcatcagcggcatgggcgcgattcacgcccaagtggcggacgagcttgccgatccttccagcgcgattctcgatatcgaccgcaaagtgtccgatttcctccgcagcgaagactatccgaaagccaacttcggcgtaccgctcgccggcagcctgattccgtggattgacgtggatttgggcaacggccagtccaaagaagaatggaagggcggcgtggaaaccaacaaaatcctcggacgcagcggcaatccgaccgtcatcgacggcctgtgcgtccgcatcggcgcgatgcgctgccacagccaagccatcactctgaagttgaaaaaagacctgcctgtttccgaaatcgaagcgattttggcaggcgcgaacgactgggtgaaagtcgtccccaacgaaaaagaagccggcatccgcgagctgacgcccgccaaagttaccggcacgctgtccgtccctgtcggacgcatccgcaaactgggcatgggcggcgaatacatcagcgcgttcaccgtcggcgaccaacttttgtggggtgcagccgaaccgatgcgccgcgtgttgcgtatcgtgttgggcagcctg

SEQ ID NO: 534 - protein, 371 aa, Neisseria gonorrhoeae
MKVGFVGWRGMVGSVLMQRMKEENDFAHIPEAFFFTSSNVGGAAPDFGQAAKTLLDANDVAELAKMDIIVTCQGGDYTKSVFQALRDSGWNGYWIDAASSLRMKDDAIIALDPVNRNVIDNGLKNGVKNYIGGNCTVSLMLMALGGLFQNDLVEWATSMTYQAASGAGAKNMRELISGMGAIHAQVADELADPSSAILDIDRKVSDFLRSEDYPKANFGVPLAGSLIPWIDVDLGNGQSKEEWKGGVETNKILGRSGNPTVIDGLCVRIGAMRCHSQAITLKLKKDLPVSEIEAILAGANDWVKVVPNEKEAGIRELTPAKVTGTLSVPVGRIRKLGMGGEYISAFTVGDQLLWGAAEPMRRVLRIVLGSL

SEQ ID NO: 535 - DNA, 852 bp, Neisseria gonorrhoeae
atgaaaccattacacatgcttcctattgccgcgctggtcggcagtattttcggcaatccggtcttggcagcggatgaagctgcaaccgaaaccacacccgttaaagcagagataaaagaagtgcgcgttaaagaccagcttaatgcgcctgcaaccgtggaacgtgtcaacctcgaccgcattcaacaggaaatgatacgcgacaacaaagacttggtgcgttactccaccgacgtcggcttgagcgatagcggccgccatcaaaaaggctttgctgtgcgcggcgtggaaggcaaccgtgtcggtgtcagcattgacggcgtgagcctgcctgattcggaagaaaactcactgtatgcacgttatggcaacttcaacagctcgcgcctgtctatcgaccccgaactcgtgcgcaacatcgaaatcgcgaagggcgctgactctttcaataccggtagcggcgcattgggtggcggcgtgaattaccaaaccctgcaaggccatgatttgctgttggacgacagacaattcggcgtgatgatgaaaaacggttacagcagccgcaaccgcgaatggacaaatacactcggtttcggtgtgagcaacgaccgcgtggatgccgctttgctgtattcgcaacgtcgcggtcatgagaccgaaagcgcgggcgagcgtggctatccggtagagggtgctggcagcggagcgaatatccgtggttcggcacgcggtatccctgatccgtccaaacacaaataccacaacttcttgggtaagattgcttatcaaatcaacgacaagcaccgcatcggcgcatcgtttaacggccagcaggggcataattacacgatt

SEQ ID NO: 536 - protein, 284 aa, Neisseria gonorrhoeae
MKPLHMLPIAALVGSIFGNPVLAADEAATETTPVKAEIKEVRVKDQLNAPATVERVNLDRIQQEMIRDNKDLVRYSTDVGLSDSGRHQKGFAVRGVEGNRVGVSIDGVSLPDSEENSLYARYGNFNSSRLSIDPELVRNIEIAKGADSFNTGSGALGGGVNYQTLQGHDLLLDDRQFGVMMKNGYSSRNREWTNTLGFGVSNDRVDAALLYSQRRGHETESAGERGYPVEGAGSGANIRGSARGIPDPSKHKYHNFLGKIAYQINDKHRIGASFNGQQGHNYTI

SEQ ID NO: 537 - DNA, 99 bp, Neisseria gonorrhoeae
ttgttcttaaacagatggaattctaccgccctactgctgcaaacgccaatcccaaaaagaaaattcgataaagaactttacattttcccaatacggcgt

SEQ ID NO: 538 - protein, 33 aa, Neisseria gonorrhoeae
LFLNRWNSTALLLQTPIPKRKFDKELYIFPIRR

SEQ ID NO: 539 - DNA, 579 bp, Neisseria gonorrhoeae
atggaagaaaaaaacgactacaccgacgcggtatccgacaaccgcaacgggcaggaaattgaagtcggaattgccggcgcaggcgaccggatacttgccgcgctgctgaaccaattgtttacctttttgattttgttggtgccgtttgtcggactgattgccttcgccgtcaaaaatgaaggcaggattggcggccgtgaggaaatattcgggctgcttttgggcatgacttccttttgggtcggactggcgggcattttggcgtacaccgtcatccaaatctactatatgagcagggacgggcagtcattgggtaagaaaatcatgagaatccgcgtgttgaaaaccgacggccgcaatccgggttttgtcggcacggttttggtacgcgaaatcgcgtggtcggttttggttgccattattgccgccgttatcggtcttgcagtaggtgaaaacggggaaaacgccatcaacctgctggcattccttgccaactttgtcctgctctttatggtcaaacgcgaccgccgcacgctttacgacatattggcggatacggttgtcgtcaagctgcccaaa

SEQ ID NO: 540 - protein, 193 aa, Neisseria gonorrhoeae
MEEKNDYTDAVSDNRNGQEIEVGIAGAGDRILAALLNQLFTFLILLVPFVGLIAFAVKNEGRIGGREEIFGLLLGMTSFWVGLAGILAYTVIQIYYMSRDGQSLGKKIMRIRVLKTDGRNPGFVGTVLVREIAWSVLVAIIAAVIGLAVGENGENAINLLAFLANFVLLFMVKRDRRTLYDILADTVVVKLPK

SEQ ID NO: 541 - DNA, 786 bp, Neisseria gonorrhoeae
gtggcgcaacgccaacaggacaatctgcacacgccttgcctggccgtggttttggtcggaggcgaccctgccggcgcagtttatgtccgcaacaagaaaaccgcctgccaaaaatgcggcatcaagtcgctgtcgtacgaactgcccgaatcaacatcgcaggaagaactgctggcattggtcgaccgtctgaatgccgattccgaagtggacggtattctggttcagcttccactgccgaagcacctcgacagccaagcgatcttggaacgtatttcgccggataaggacgtggacggcttccatccttacaatgtcggcaggctggcggtcaaaatgccgctgatgcgcccgtgtacgcccaagggcgtgatgacgcttttggaggcttacggcattgatccgaaggggaaaaaagcggtcgtggtcggcgcgtcgaatattgtcggccgcccgcaggcgttggaattgctgctggcgcgcgcaacggtaacggtctgccacagtgcgaccgaaaatcttgccgatgaagttgccgccgccgatattttggtggtcggcgtgggcattccgaactttgtcaaaggcgggtggatcaaacccggcgcggtcgttatcgatgtgggcatcaaccgtttggacgacggcagcctgtgcggcgacgtggaatttgaaacggcaaaagaacgggcggcgatgattacgcccgttcccggcggcgtgggtccgatgacgattgccacattaatggaaaacactttgcacgcagcttcgctgcacgatgct

SEQ ID NO: 542 - protein, 262 aa, Neisseria gonorrhoeae
VAQRQQDNLHTPCLAVVLVGGDPAGAVYVRNKKTACQKCGIKSLSYELPESTSQEELLALVDRLNADSEVDGILVQLPLPKHLDSQAILERISPDKDVDGFHPYNVGRLAVKMPLMRPCTPKGVMTLLEAYGIDPKGKKAVVVGASNIVGRPQALELLLARATVTVCHSATENLADEVAAADILVVGVGIPNFVKGGWIKPGAVVIDVGINRLDDGSLCGDVEFETAKERAAMITPVPGGVGPMTIATLMENTLHAASLHDA

SEQ ID NO: 543 - DNA, 141 bp, Neisseria gonorrhoeae
gtgtttttgcgaaacttctttaccgttgatcagttgtgccgacatatccgtccttttgttaaacaggtagaaaatgctgaaaattatcgcattttccgtttgtttttacagcagaatgccgaaaataaatttgccccgaaa

SEQ ID NO: 544 - protein, 47 aa, Neisseria gonorrhoeae
VFLRNFFTVDQLCRHIRPFVKQVENAENYRIFRLFLQQNAENKFAPK

SEQ ID NO: 545 - DNA, 159 bp, Neisseria gonorrhoeae
atgccgaaaataaatttgccccgaaataaaatacggctgtttggacggattaaatattttttcaaatcaaaaaactatatttttcatcttggtgttttgaaaataaatgttgacgcatctttccctgaactgtatattccgcttcttcaagtcggggcg

SEQ ID NO: 546 - protein, 53 aa, Neisseria gonorrhoeae
MPKINLPRNKIRLFGRIKYFFKSKNYIFHLGVLKINVDASFPELYIPLLQVGA

SEQ ID NO: 547 - DNA, 507 bp, Neisseria gonorrhoeae
ttgatggttgacgcttggtctgtccctgattttgaatcgaaaatctgtccgcccgaggcgttggcggcgcgtttggcgttgttgccgcgcccgctggtgtttaccaacggctgtttcgacatcctccacagggggcacgttacttatctggcgcaggcgcgttcggcaggggcggcgttggtgctggcgttgaataccgatgcttcggtgcggcgtttgggcaagggcggcgaccgcccggttaatcctttggagaaccgtgccgccgttgccgccgcgttggaaagtgtggatttggttacttggtttgacgaggatacgccggcggcgttgattgaggcggtcaagccggaggtgttggtcaagggcggcgattgggtcgtggataagattgtcggtgcggcggaaacgctggcacgcggcggtcaggtgttttcaattccgtttctgcatcagacttcgacaacgaagactttggcaaaaatccgtgcggcagagggcggaaaa

SEQ ID NO: 548 - protein, 169 aa, Neisseria gonorrhoeae
LMVDAWSVPDFESKICPPEALAARLALLPRPLVFTNGCFDILHRGHVTYLAQARSAGAALVLALNTDASVRRLGKGGDRPVNPLENRAAVAAALESVDLVTWFDEDTPAALIEAVKPEVLVKGGDWVVDKIVGAAETLARGGQVFSIPFLHQTSTTKTLAKIRAAEGGK

SEQ ID NO: 549 - DNA, 1776 bp, Neisseria gonorrhoeae
atgacggttttgaagccttcgcattggcgggtgttggcggagcttgccgacggtttgccgcaacacgtatcgcaattggcgcgtgaggcggacatgaagccgcagcagctcaacggtttttggcagcagatgccggcgcatatacgcgggctgttgcgccaacacgacggctattggcggctggtgcgccccttggcggttttcgatgccgaaggtttgcgcgatctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgcctgatgttcagtttcggctgggcgtttgaccggccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgct

SEQ ID NO: 550 - protein, 592 aa, Neisseria gonorrhoeae
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 551 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttgccaaccatcgtttggccttggctgccgatggggttttcgagggccccgccgggccgggcggaagctgtttcggcggacggcgtaaaggcagacgcggtcgcggcgcggcaggaaaagcggttgtcttcggcattccgaaacgcaacgggcgggcctataccgttgccgcggacaatgccgagcctgaaacgttgccccctgccgtcaaaaagaaaatcatgccggacggtattgtttatgccgatagcccgggcagccgcggcaagtcggacgcgggcggttttacccgttgccgcatcaaccgttccgaggaatttgcagaccgtcggaaccacattaacggcattgggaacttttggaatcaggcaaaacgcgccttgcggaaatacaacggaatcgatcgtaaacctttcccgccgttgttgagggaatgcgaatttcgacttaacttcggcacaccgtcccggcagctaaaaatcctgcgggatcggtgtggaatt

SEQ ID NO: 552 - protein, 217 aa, Neisseria gonorrhoeae
MKITHCKLKKEVQKEPLRSFVPEVTARSAADILGIHPDSAALFYRKIRTVANHRLALAADGVFEGPAGPGGSCFGGRRKGRRGRGAAGKAVVFGIPKRNGRAYTVAADNAEPETLPPAVKKKIMPDGIVYADSPGSRGKSDAGGFTRCRINRSEEFADRRNHINGIGNFWNQAKRALRKYNGIDRKPFPPLLRECEFRLNFGTPSRQLKILRDRCGI

SEQ ID NO: 553 - DNA, 1149 bp, Neisseria gonorrhoeae
gtgttaaaatccgcctttaaaaaccgccgtttccaagccatcctgcgtatgaatacgacatcaaacacttccaatatcatcgtcgggctttccggcggtgtcgattcttccgtaaccgccgccctgctcaagcagcagggttatcaagtgcgcggtgtgttcatgcagaactgggaaaacgacgacaacgacgaatattgcagcatcaaacaggattcgttcgatgccatcgccgttgccgatattgtcggcatcgacatcgacatcgttaatttcgccgcgcaatataaagacaaagtttttgcttattttcttcaggaatacagtgcggggcgcacgccgaatccggatgtgttgtgcaatgccgaaatcaaattcaaatgctttttggactacgccgtagggcagggcgcggataccattgccaccggacactatgcgcgcaaagaagcccgcaacggcgtgcattacctgctcaaaggtttggatcgaaacaaagaccaaagctattttctctaccgcctcaagcctttccaactcgaacgcgcgatttttccgttgggcggtttggaaaaacccgaagtgcgccgccttgccgccgaatttaatttgccgactgccgctaaaaaagacagtaccggcatctgtttcatcggcgagcgtccgttccgcgagtttctgcagaaatacttgccgaccgacaacggcaaaatggtgacgcccgaagggaaaaccatcggcgaacacgtcgggctgatgttttacacattgggtcagcgcaaaggattgggcatcggcggcgcgggcgaaccgtggtttgttgcggctaaagatttgacgaaaaacgaactcatcgtcgtacaaggacacgaccatccgctgctctatacccgcagccttgtgatgaacgatttgagtttcacgctgcccgaacgtccgaaggcaggacgctatacctgcaaaacgcgttaccgtatggcggacgcgccttgcgaattgtgctatttggatgatgaaaccgccgagctggtgtttgacgaaccgcaatgggcggttacgccgggtcagtccgccgtgctgtacgacgtcgacatctgtttgggcggcggcatcatccaaacgaccgacaaacccgtcatcatcacgcga

SEQ ID NO: 554 - protein, 383 aa, Neisseria gonorrhoeae
VLKSAFKNRRFQAILRMNTTSNTSNIIVGLSGGVDSSVTAALLKQQGYQVRGVFMQNWENDDNDEYCSIKQDSFDAIAVADIVGIDIDIVNFAAQYKDKVFAYFLQEYSAGRTPNPDVLCNAEIKFKCFLDYAVGQGADTIATGHYARKEARNGVHYLLKGLDRNKDQSYFLYRLKPFQLERAIFPLGGLEKPEVRRLAAEFNLPTAAKKDSTGICFIGERPFREFLQKYLPTDNGKMVTPEGKTIGEHVGLMFYTLGQRKGLGIGGAGEPWFVAAKDLTKNELIVVQGHDHPLLYTRSLVMNDLSFTLPERPKAGRYTCKTRYRMADAPCELCYLDDETAELVFDEPQWAVTPGQSAVLYDVDICLGGGIIQTTDKPVIITR

SEQ ID NO: 555 - DNA, 969 bp, Neisseria gonorrhoeae
ttgccgccgaaggcggggaatcggaacacgcttaaaaaatatgccttttttcaacacggggcggcatccgtccgaatctgtccggattctgccgcccgacagactgccgcccgggcgggcggggtttcaaacattgaggaaattctaatgaaatggctcttcacccttttggcggtactcaatattgccgtattcggcggcacggtgggctataaattggccgttaaagcggcgggcggcgtgccggaaaaccgggccgtcgaaaacacgccccccgcaacgcccgccgccggcaatgcggcggcatccgtggaggatacggcggcactgctcaaaccgggcgacatcctgagcgaagaacaggcggagcagttgcgcttgaaaaaagaagcggaacagaaaaaactgagggagaaaaaacagcgtgaagaaaaagcccgccgcgaaaaactcgccgccgaaaaggcgcaggcggaacgtgaaaacggcgcggcggatgccttatgcgccgcgcaggcaagcctcacgatggacgaagacgactaccaccgcatcaaagggcttttgggcaaatggtcgcacgttgccagcaggagcgtcgaaaaacgcaccgccaaagccaaacctgccgacaaaacctaccgcgtcgtcctgcccgtttccgccgatgccgaaaatcaggcggcggagctgtctgccaaaggtttcaaccccataccgtttgacggcgcattgagtttgggtgtcggcaacagccgggaaaacgcccaagccctgcaaaaccgacttgccgatgccggattcggcggggcgcatattgtcgaacactttgccgaagccgacaggcaggacgattctttgagcgtgtcgcgtatgacggttttgtttacgggcgtgaatgccgccgatgcggacgaaatccgtaaaatcacgtccctatacggcaaactgaacctcaagtcttgcaaa

SEQ ID NO: 556 - protein, 323 aa, Neisseria gonorrhoeae
LPPKAGNRNTLKKYAFFQHGAASVRICPDSAARQTAARAGGVSNIEEILMKWLFTLLAVLNIAVFGGTVGYKLAVKAAGGVPENRAVENTPPATPAAGNAAASVEDTAALLKPGDILSEEQAEQLRLKKEAEQKKLREKKQREEKARREKLAAEKAQAERENGAADALCAAQASLTMDEDDYHRIKGLLGKWSHVASRSVEKRTAKAKPADKTYRVVLPVSADAENQAAELSAKGFNPIPFDGALSLGVGNSRENAQALQNRLADAGFGGAHIVEHFAEADRQDDSLSVSRMTVLFTGVNAADADEIRKITSLYGKLNLKSCK

SEQ ID NO: 557 - DNA, 156 bp, Neisseria gonorrhoeae
atgtatgtctcgtatatgccgactccaagtgtgaaagtgaattgtgagggaatacagtgtttaatggttcggaacggacggcttccgagtggttttgattatacgctaataataataattatcaataaaaatttaaaaataaatgcggattttttg

SEQ ID NO: 558 - protein, 52 aa, Neisseria gonorrhoeae
MYVSYMPTPSVKVNCEGIQCLMVRNGRLPSGFDYTLIIIIINKNLKINADFL

SEQ ID NO: 559 - DNA, 180 bp, Neisseria gonorrhoeae
ttgttcaaacacggcaggcttctttccgacaggcacgaagcccccgtccatgcctgccgaccccgatttgtccggcgcaatgaaagtttgccgacccaaatcacaaacatcggcggacaggttaatttgtttatttttcatcgcattacaaaaaatccgcatttatttttaaatttttat

SEQ ID NO: 560 - protein, 60 aa, Neisseria gonorrhoeae
LFKHGRLLSDRHEAPVHACRPRFVRRNESLPTQITNIGGQVNLFIFHRITKNPHLFLNFY

SEQ ID NO: 561 - DNA, 327 bp, Neisseria gonorrhoeae
ttgaacaaccgtccgatttggtgcggacagggttgccattcgggggtgtttgagcgcggattcggggatgcaaaagcggtgaaaccgttgcggatgaaggcttacggatgccccgaggtatttttaaatgtattcaaacgacaaaactcccttctattgccgtacttagggcttgcgcagcagcctgcgcgccggggagtccgggtgtttcgttggttgcggtgtcggggcgggcggcaaggttttccggccggtttccctgttcctcacgacaaagccgtgatgccggggaatggcggtttgcccgtttggggccgcgatgccgtc

SEQ ID NO: 562 - protein, 109 aa, Neisseria gonorrhoeae
LNNRPIWCGQGCHSGVFERGFGDAKAVKPLRMKAYGCPEVFLNVFKRQNSLLLPYLGLAQQPARRGVRVFRWLRCRGGRQGFPAGFPVPHDKAVMPGNGGLPVWGRDAV

SEQ ID NO: 563 - DNA, 246 bp, Neisseria gonorrhoeae
ttggcattcggcggaatattgaaaaaggcggcaaaaatgccgtctgaaggcttcagacggcatcgcggccccaaacgggcaaaccgccattccccggcatcacggctttgtcgtgaggaacagggaaaccggccggaaaaccttgccgcccgccccgacaccgcaaccaacgaaacacccggactccccggcgcgcaggctgctgcgcaagccctaagtacggcaatagaagggagttttgtcgtt

SEQ ID NO: 564 - protein, 82 aa, Neisseria gonorrhoeae
LAFGGILKKAAKMPSEGFRRHRGPKRANRHSPASRLCREEQGNRPENLAARPDTATNETPGLPGAQAAAQALSTAIEGSFVV

SEQ ID NO: 565 - DNA, 786 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatat

SEQ ID NO: 566 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 567 - DNA, 684 bp, Neisseria gonorrhoeae
atgtacgcattgaccgccgcacagcaacagaaggcactcttccggctggtgcttttccatatcctcatcatcgccgccagcaactatctggtgcagttccccttccggattttcggcatccacaccacttggggcgcgttttcctttcccttcatcttcctcgccaccgacctgaccgtccgcattttcggttcgcacttggcgcggcggattatcttttgggtgatgttccccgcccttttgctttcatacgtcttttccgttttgttccacaacggcagttggacgggcttgggcgcgctgtcccaattcaacacctttgtcggacgcatcgcgctggcaagttttgccgcctacgcgctcggacaaatccttgatattttcgtattcgacaaattacgccgtctgaaagcgtggtggattgccccggccgcatcaaccgtcatcggcaatgcactggacacgttagtattttttgccgttgccttttacgcaagcagcgatgaatttatggcggcaaactggcagggcatcgcttttgtcgattacctgttcaaacttaccgtctgcaccctcttcttcctgcccgcctacggcgtgatactgaatctgctgacgaaaaaactgacggccctgcaaaccaaacaggcgcaagaccgccccgtgccctcgctgcaaaatccg

SEQ ID NO: 568 - protein, 228 aa, Neisseria gonorrhoeae
MYALTAAQQQKALFRLVLFHILIIAASNYLVQFPFRIFGIHTTWGAFSFPFIFLATDLTVRIFGSHLARRIIFWVMFPALLLSYVFSVLFHNGSWTGLGALSQFNTFVGRIALASFAAYALGQILDIFVFDKLRRLKAWWIAPAASTVIGNALDTLVFFAVAFYASSDEFMAANWQGIAFVDYLFKLTVCTLFFLPAYGVILNLLTKKLTALQTKQAQDRPVPSLQNP

SEQ ID NO: 569 - DNA, 711 bp, Neisseria gonorrhoeae
atgattctttattatttttgtatgcgggcaagtccggattttgcccgcaccgcatccttatcccttaccgacaaaggagaacttatgagcgaaaccgaaaaccaagccctgacgtttgccaaacgcctgaaggcggataccacggcggttcacgacagcgtggataacctcgttatgtctgtccaaccgtttgtcagcaaagaaaactacatcaaatttttgaaactgcaatccgtgttccacaaagcggttgatcatatctataaagaccccgagttgaacaaagccatttccgagctggaatacatggcgcgatacgatgccgtaacgcaagacttgaaagacttgggcgaagagccttacaaattcgacaaagaattgccacacgaaaccggcaacaaagccgtcggctggctttattgcgccgaaggatccaatttgggcgcggcatttttgttcaaacacgcgcaaaagctggattacaccggcgaacacggcgcgcgccacctcgctccgcatccggacgggcgcggcaaacactggcgcgccttcgtcgagcacctgaatgccctgaacttaactccggaagcagaagcagaagccattcaaggcgcgcaggaagcgtttgctttctataaagtgattctgcgtgaaaccttcggtttgccggaaggaacagaagcccccgaaggcatgatgccgcacagacat

SEQ ID NO: 570 - protein, 237 aa, Neisseria gonorrhoeae
MILYYFCMRASPDFARTASLSLTDKGELMSETENQALTFAKRLKADTTAVHDSVDNLVMSVQPFVSKENYIKFLKLQSVFHKAVDHIYKDPELNKAISELEYMARYDAVTQDLKDLGEEPYKFDKELPHETGNKAVGWLYCAEGSNLGAAFLFKHAQKLDYTGEHGARHLAPHPDGRGKHWRAFVEHLNALNLTPEAEAEAIQGAQEAFAFYKVILRETFGLPEGTEAPEGMMPHRH

SEQ ID NO: 571 - DNA, 471 bp, Neisseria gonorrhoeae
atgaaaaaattattggcagccgtgatgatggcaggtttggcaggcgcggtttccgccgccggagtccatgtcgaggacggctgggcgcgcaccactgtcgaaggtatgaaaatgggcggcgcgttcatgaaaatccccaacgacgaagccaaacaagactttttgctcgtcggaagcagccccgttgccgaccgcgtcgaagtgcatacccacatcaacgacaacggcgtgatgcgtatgcgcgaagtcaaaggcggcgtgcctttggaggcgaaatccgttaccgaactcaaacccggcagctatcacgtgatgtttatgggtttgaaaaaacaactgaaagagggcgacaagattcccgttaccctgaaatttaaaaacgccaaagcgcaaaccgtccaactggaagtcaaaaccgcgccgatgtcggcaatgaaccacggtcatcaccacggcgaagcgcatcagcac

SEQ ID NO: 572 - protein, 157 aa, Neisseria gonorrhoeae
MKKLLAAVMMAGLAGAVSAAGVHVEDGWARTTVEGMKMGGAFMKIPNDEAKQDFLLVGSSPVADRVEVHTHINDNGVMRMREVKGGVPLEAKSVTELKPGSYHVMFMGLKKQLKEGDKIPVTLKFKNAKAQTVQLEVKTAPMSAMNHGHHHGEAHQH

SEQ ID NO: 573 - DNA, 216 bp, Neisseria gonorrhoeae
ttgtcggacgcgatgccgtctgaaagccggcggcgtgcctttggggtttcagacggcattcagccgccgacgacggggcggacgatgtcgattttgtcgttttcgtgtaaaacggtttccgtatacgcgcctttggggatgaaaacggtgttgaccgccacggcaaagggtttttgcggcgcggtttgggcgatgaggtcggcaacgcttgtgccg

SEQ ID NO: 574 - protein, 72 aa, Neisseria gonorrhoeae
LSDAMPSESRRRAFGVSDGIQPPTTGRTMSILSFSCKTVSVYAPLGMKTVLTATAKGFCGAVWAMRSATLVP

SEQ ID NO: 575 - DNA, 192 bp, Neisseria gonorrhoeae
atgaacatcatcttaaacggcggacccgccgaacttcacggcacaagcgttgccgacctcatcgcccaaaccgcgccgcaaaaaccctttgccgtggcggtcaacaccgttttcatccccaaaggcgcgtatacggaaaccgttttacacgaaaacgacaaaatcgacatcgtccgccccgtcgtcggcggc

SEQ ID NO: 576 - protein, 64 aa, Neisseria gonorrhoeae
MNIILNGGPAELHGTSVADLIAQTAPQKPFAVAVNTVFIPKGAYTETVLHENDKIDIVRPVVGG

SEQ ID NO: 577 - DNA, 159 bp, Neisseria gonorrhoeae
atgtggcatatcatcaaattccgtcattcccgctcaggcgggaatccgccggaaaacttgagaaaccatcatttgaaaaacagtttccgaatttcaaaaatggattcccgcctgcgcgggaatgacggcaaccggccggttgcgtatcaaaaaataaag

SEQ ID NO: 578 - protein, 53 aa, Neisseria gonorrhoeae
MWHIIKFRHSRSGGNPPENLRNHHLKNSFRISKMDSRLRGNDGNRPVAYQKIK

SEQ ID NO: 579 - DNA, 615 bp, Neisseria gonorrhoeae
atgaccttcccgcccctaaaatccctacttaaattctacgccgtcgttcccaccgccgattgggtggggcgcatggtcaaagcaggtgccgacacggtgcaactgcgctgtaaaaccttgcacggcaacgaattgaaacgcgaaatcgcccgctgcgtcgccgcctgtcaaggcagccgcacacagcttttcatcaacgaccactggcgcgaggcaatcgaagcgggcgcatacggcgtacatctcgggcaggaagacatggacaccgccgaccttgccgccatcgccgccgccggtttgcgtttgggtttgagtacgcactccgtcgccgaactcgaccgcgccctgttcgtacaccccggctacatcgccagcggcgcgattttccagaccacgaccaaacaaatgcccaccgccccgcaaggcttggacaaattgcgcgaatatgtggaacaggctcgcggcacgcccgtcgtcgccatcggcggcatcgatttgaacaacgcccgagccgtgctggccaccggcgtttcctcactcgccgccgtccgcgccgtaaccgaagcggcaaatcccgaagcggtggttaaagcgtttcaggctttgtgggatgga

SEQ ID NO: 580 - protein, 205 aa, Neisseria gonorrhoeae
MTFPPLKSLLKFYAVVPTADWVGRMVKAGADTVQLRCKTLHGNELKREIARCVAACQGSRTQLFINDHWREAIEAGAYGVHLGQEDMDTADLAAIAAAGLRLGLSTHSVAELDRALFVHPGYIASGAIFQTTTKQMPTAPQGLDKLREYVEQARGTPVVAIGGIDLNNARAVLATGVSSLAAVRAVTEAANPEAVVKAFQALWDG

SEQ ID NO: 581 - DNA, 1098 bp, Neisseria gonorrhoeae
atgacccgtatcgccgtcctcggaggcggcctttccggaaggctgaccgcattgcagcttgcagaacaaggttatcagattgaacttttcgacaagggcacccgccaaggcgaacacgccgccgcctatgttgccgccgcgatgctcgcgcctgcggcggaagcggtcgaggcaacgcccgaagtcatcaggctgggcaggcagagcattccgctttggcgcggcatccgatgccgtctgaacacgctcacgatgatgcaggaaaacggcagcctgattgtgtggcacgggcaggacaagccattatccagcgagttcgtccgccatctcaaacgcggcggcgtagcggatgacgaaatcgtccgttggcgcgccgatgaaatcgccgaacgcgaaccgcaactcggcggacgtttttcagacggcatctacctgccgaccgaaggccagctcgacgggcggcaaatattgtctgcacttgccgacgctttggacgaactgaacgtcccttgccattgggaacacgaatgcgccccccaagacctgcaagcccaatacgactgggtaatcgactgccggggctacggcgcgaaaaccgcgtggaaccaatcccccgagcacaccagcaccttgcgcggcatacgcggcgaagtggcgcgggtttacacgcccgaaatcacgctcaaccgccccgtgcgcctgctgcacccgcgctatccgctctacatcgccccgaaagaaaaccacgtcttcgtcatcggcgcgacccaaatcgaaagcgaaagccaagcccccgccagcgtacgttccgggctggaactcttatccgcgctctatgccgtccaccccgccttcggcgaagccgacatcctcgaaatcgccgccggcctgcgccccacgctcaaccaccacaaccccgaaatccgctacagccgcgaacgccgcctcatcgaaatcaacggccttttccggcacggctttatgatttcccccgccgtaaccgccgccgccgtcagattggcagtggcactgtttgacggaaaagacgcgcccgaacgtgatgaagaaagcggtttggcgtatatcggaagacaagat

SEQ ID NO: 582 - protein, 366 aa, Neisseria gonorrhoeae
MTRIAVLGGGLSGRLTALQLAEQGYQIELFDKGTRQGEHAAAYVAAAMLAPAAEAVEATPEVIRLGRQSIPLWRGIRCRLNTLTMMQENGSLIVWHGQDKPLSSEFVRHLKRGGVADDEIVRWRADEIAEREPQLGGRFSDGIYLPTEGQLDGRQILSALADALDELNVPCHWEHECAPQDLQAQYDWVIDCRGYGAKTAWNQSPEHTSTLRGIRGEVARVYTPEITLNRPVRLLHPRYPLYIAPKENHVFVIGATQIESESQAPASVRSGLELLSALYAVHPAFGEADILEIAAGLRPTLNHHNPEIRYSRERRLIEINGLFRHGFMISPAVTAAAVRLAVALFDGKDAPERDEESGLAYIGRQD

SEQ ID NO: 583 - DNA, 126 bp, Neisseria gonorrhoeae
atgattatttacaaaatcggggttttatcaaataggcttgtcggccggaggggcagccgctcaaaaaatatttttgccggacaccaagggtttgttcatactgccgaacctgccggttttgcatcc

SEQ ID NO: 584 - protein, 42 aa, Neisseria gonorrhoeae
MIIYKIGVLSNRLVGRRGSRSKNIFAGHQGFVHTAEPAGFAS

SEQ ID NO: 585 - DNA, 381 bp, Neisseria gonorrhoeae
atggaaccttcctcctacgcggcagaaaaaaaaggcaaaagcggcatcaggcgcgtcatcaacgcattcggctattcgatagacggcatcgccgccgcctaccgttacgaagtggcattccgtcaggttttgtggctgaacgcgctgctggtgtgcgcggcatttttttgggtttccgaaaccgccgtccgcctgccgttgattatcgcgtcttttgtgtcggtcattgtcgaactgttcaacaccgccgtcgaagccgccgtcgatcatacttcgaccgaaaaacacgagctggccaaacgcgccaaagatgcaggttctgccgcacaactggttgccatgctgatgttggcggcggtttggctgtccgccctgttcggg

SEQ ID NO: 586 - protein, 127 aa, Neisseria gonorrhoeae
MEPSSYAAEKKGKSGIRRVINAFGYSIDGIAAAYRYEVAFRQVLWLNALLVCAAFFWVSETAVRLPLIIASFVSVIVELFNTAVEAAVDHTSTEKHELAKRAKDAGSAAQLVAMLMLAAVWLSALFG

SEQ ID NO: 587 - DNA, 90 bp, Neisseria gonorrhoeae
gtgctgatttcggcaatcgataccgccgcgccgaaccaaaccagcccgatggcggcggaagatgaaggagaggaggcattgcccgacata

SEQ ID NO: 588 - protein, 30 aa, Neisseria gonorrhoeae
VLISAIDTAAPNQTSPMAAEDEGEEALPDI

SEQ ID NO: 589 - DNA, 1116 bp, Neisseria gonorrhoeae
ttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatcggcacggtgcttgccgtcatgctgcccgttaccgaatataaaaacttcctgctgcttatcggctcggtatttgcgccgatggcggcggttttgattgccgactttttcgtcttaaaacggcgtgaggagattgaaggctttgactttgccggactggttctgtggctggcaggcttcatcctctaccgcttcctgctctcgtccggttgggaaagcagcatcggtctgaccgcccccgtaatgtctgccgttgccattgccaccgtatcggtacgccttttctttaaaaaaacccaatctttacaaaggaacccgtca

SEQ ID NO: 590 - protein, 372 aa, Neisseria gonorrhoeae
LGWQRGLAALLLGHAVGGALFFAAAYIGALTGRSSMESVRLSFGKCGSVLFSVANMLQLAGWTAVMIYVGATVSSALGKVLWDGESFVWWALANGALIVLWLVFGARRTGGLKTVSMLLMLLAVLWLSVEVFASSGTNAAPAVSDGMTFGTAVELSAVMPLSWLPLAADYTRQARRPFAATLTATLAYTLTGCWMYALGLAAALFTGETDVAKILLGAGLGITGILAVVLSTVTTTFLDTYSAGASANNISARFAEIPVAVGVTLIGTVLAVMLPVTEYKNFLLLIGSVFAPMAAVLIADFFVLKRREEIEGFDFAGLVLWLAGFILYRFLLSSGWESSIGLTAPVMSAVAIATVSVRLFFKKTQSLQRNPS

SEQ ID NO: 591 - DNA, 1482 bp, Neisseria gonorrhoeae
atgccgtataatcaagcccctgattttttatgcgccgacactatgcatccgacctattccgccgtacaggcgcggctgctcgaagccaaccgcctttcccccgaactgctcgccaaaagcctgtgcatcatcggtgcgcaccacgtcgattatgccgatatctactgccagcgcaccgcttatgaaagctggcatttggaagagggcatcgtcaaatcgggcagcttccaaatcgatcagggtgtgggcgtgcgcgccgtttcgggcgacaaaaccgcctttgcctacgccgacagcctgtgcatcgattcgataaaccgttccgcccgcgccgtccgcgcgattggggcggcaggcggcaaggtgtccgccaaaatgccgtctgaaacgcgcggcaagccggtttgttctgcatccgaccccattgccggcctcgattccgccgccaaagtcgcgctgttgaacaaagtggaagcaatcgccaaagccgccgatccgcgcatcgtgcaagtgatggccggtttgacctgcgaatacgatatggtttacctcgcccgtctggacggcaaacacgccgccgacatccgcccgatggtgcgcctgaacgttaccgtcatcgccaaacagggcgaacgccgcgaacagggcggcgcgggcggcggaggacgctacgacttggcttatttcgatgaaaccttggtgcggcagtttgtcgatgccgccgtcaaacaagccctgaccaatctcgaatcccgtcctgcgcctgccggcgagatgaccgtcgttttgggcaacggttggccgggcgtgttgctgcacgaagcggtcggacacggtttggaaggcgatttcaaccgcaaggggaccagcgtcttttccggccggatcggcgaacgcgtcgccgccaaaggcgttaccgtcgtcgatcagggcgatattgccggccggcgcggttcgctcaacatcgacgacgaaggcaacgaaacacgccgcaccgtattgattgaagacggcatcttggtcggctatatgcaggacgaaaccaacgcccgcctgacgggtacgcaatcgaccggcaacggccgccgccaaagctacgcctccgtcccgatgccgcgtatgaccaacacctttatggaaaacggcagctacgagccggaagaaatcatcgcgtccatcgacaagggcatttacgccgtcaacttcggcggcggacaggtggacatcaccagcgggaaatttgtcttcggcgcgtccgaagcgtggtgggtggaaggcggcaggctgcaataccccgtcaaaggcgcgaccattatcggcaacggccccgaagtgctgaaacacgtttcgatgataggcaacgataccgcgctcgacagcggtgtcggcgtgtgcggcaaagaagggcagagcgtccccgtcggcgtggggcagccgaccctgcgtatcgatgccgggctgaccgtcggcggcagcgcaatc

SEQ ID NO: 592 - protein, 494 aa, Neisseria gonorrhoeae
MPYNQAPDFLCADTMHPTYSAVQARLLEANRLSPELLAKSLCIIGAHHVDYADIYCQRTAYESWHLEEGIVKSGSFQIDQGVGVRAVSGDKTAFAYADSLCIDSINRSARAVRAIGAAGGKVSAKMPSETRGKPVCSASDPIAGLDSAAKVALLNKVEAIAKAADPRIVQVMAGLTCEYDMVYLARLDGKHAADIRPMVRLNVTVIAKQGERREQGGAGGGGRYDLAYFDETLVRQFVDAAVKQALTNLESRPAPAGEMTVVLGNGWPGVLLHEAVGHGLEGDFNRKGTSVFSGRIGERVAAKGVTVVDQGDIAGRRGSLNIDDEGNETRRTVLIEDGILVGYMQDETNARLTGTQSTGNGRRQSYASVPMPRMTNTFMENGSYEPEEIIASIDKGIYAVNFGGGQVDITSGKFVFGASEAWWVEGGRLQYPVKGATIIGNGPEVLKHVSMIGNDTALDSGVGVCGKEGQSVPVGVGQPTLRIDAGLTVGGSAI

SEQ ID NO: 593 - DNA, 1500 bp, Neisseria gonorrhoeae
atgccgtctgaaaacctttcagacggcatcgtgccggattccgcgtcagattgcgctgccgccgacggtcagcccggcatcgatacgcagggtcggctgccccacgccgacggggacgctctgcccttctttgccgcacacgccgacaccgctgtcgagcgcggtatcgttgcctatcatcgaaacgtgtttcagcacttcggggccgttgccgataatggtcgcgcctttgacggggtattgcagcctgccgccttccacccaccacgcttcggacgcgccgaagacaaatttcccgctggtgatgtccacctgtccgccgccgaagttgacggcgtaaatgcccttgtcgatggacgcgatgatttcttccggctcgtagctgccgttttccataaaggtgttggtcatacgcggcatcgggacggaggcgtagctttggcggcggccgttgccggtcgattgcgtacccgtcaggcgggcgttggtttcgtcctgcatatagccgaccaagatgccgtcttcaatcaatacggtgcggcgtgtttcgttgccttcgtcgtcgatgttgagcgaaccgcgccggccggcaatatcgccctgatcgacgacggtaacgcctttggcggcgacgcgttcgccgatccggccggaaaagacgctggtccccttgcggttgaaatcgccttccaaaccgtgtccgaccgcttcgtgcagcaacacgcccggccaaccgttgcccaaaacgacggtcatctcgccggcaggcgcaggacgggattcgagattggtcagggcttgtttgacggcggcatcgacaaactgccgcaccaaggtttcatcgaaataagccaagtcgtagcgtcctccgccgcccgcgccgccctgttcgcggcgttcgccctgtttggcgatgacggtaacgttcaggcgcaccatcgggcggatgtcggcggcgtgtttgccgtccagacgggcgaggtaaaccatatcgtattcgcaggtcaaaccggccatcacttgcacgatgcgcggatcggcggctttggcgattgcttccactttgttcaacagcgcgactttggcggcggaatcgaggccggcaatggggtcggatgcagaacaaaccggcttgccgcgcgtttcagacggcattttggcggacaccttgccgcctgccgccccaatcgcgcggacggcgcgggcggaacggtttatcgaatcgatgcacaggctgtcggcgtaggcaaaggcggttttgtcgcccgaaacggcgcgcacgcccacaccctgatcgatttggaagctgcccgatttgacgatgccctcttccaaatgccagctttcataagcggtgcgctggcagtagatatcggcataatcgacgtggtgcgcaccgatgatgcacaggcttttggcgagcagttcgggggaaaggcggttggcttcgagcagccgcgcctgtacggcggaataggtcggatgcatagtgtcggcgca

SEQ ID NO: 594 - protein, 500 aa, Neisseria gonorrhoeae
MPSENLSDGIVPDSASDCAAADGQPGIDTQGRLPHADGDALPFFAAHADTAVERGIVAYHRNVFQHFGAVADNGRAFDGVLQPAAFHPPRFGRAEDKFPAGDVHLSAAEVDGVNALVDGRDDFFRLVAAVFHKGVGHTRHRDGGVALAAAVAGRLRTRQAGVGFVLHIADQDAVFNQYGAACFVAFVVDVERTAPAGNIALIDDGNAFGGDAFADPAGKDAGPLAVEIAFQTVSDRFVQQHARPTVAQNDGHLAGRRRTGFEIGQGLFDGGIDKLPHQGFIEISQVVASSAARAALFAAFALFGDDGNVQAHHRADVGGVFAVQTGEVNHIVFAGQTGHHLHDARIGGFGDCFHFVQQRDFGGGIEAGNGVGCRTNRLAARFRRHFGGHLAACRPNRADGAGGTVYRIDAQAVGVGKGGFVARNGAHAHTLIDLEAARFDDALFQMPAFISGALAVDIGIIDVVRTDDAQAFGEQFGGKAVGFEQPRLYGGIGRMHSVGA

SEQ ID NO: 595 - DNA, 678 bp, Neisseria gonorrhoeae
atgccgtctgaaaggttttcagacggcatcgccttattcttttttccgatgtttgatattcctaagcattctttaacattatcttacaagttcattaaaataccgcctttcgttaagctgatttctgatgaactggccttatttaatcgatgccgtacccaaattcgccgatgcggcaaagctgacgctggaattgtccgtttacggcgttgttttgtcgttgctgttcggcctgcccgtcgccgtggtaacggcataccgcatccgccccttctacgcattggcgcgcgcctatatcgagctgtcgcgcaatacgcccctgctgatccaattgtttttcctatattacggtctgccgaaaatgggcatcaaatgggacggtttcacctgcggcgtaatcgcgctggttttcttgggcgcaagctatatggcggaagctgtccgcgccggcatcctcgccgtccccaaagggcaggtcggagcgggcaaggcaatcggtttgagccgctttcaagtgttccgctatgtcgaattgccgcaggtttgggcggtcgccgttcccgccatcggcgcaaatatattgtttttaatgaaagaaacatccgtcgtcagcacggtcggcattgcggaattgttatttgttaccaaagacgtcatcggtatggactacaaaaccaa

SEQ ID NO: 596 - protein, 226 aa, Neisseria gonorrhoeae
MPSERFSDGIALFFFPMFDIPKHSLTLSYKFIKIPPFVKLISDELALFNRCRTQIRRCGKADAGIVRLRRCFVVAVRPARRRGNGIPHPPLLRIGARLYRAVAQYAPADPIVFPILRSAENGHQMGRFHLRRNRAGFLGRKLYGGSCPRRHPRRPQRAGRSGQGNRFEPLSSVPLCRIAAGLGGRRSRHRRKYIVFNERNIRRQHGRHCGIVICYQRRHRYGLQNQ

SEQ ID NO: 597 - DNA, 657 bp, Neisseria gonorrhoeae; identical to SEQ ID NO: 225

SEQ ID NO: 598 - protein, 219 aa, Neisseria gonorrhoeae; identical to SEQ ID NO: 226

SEQ ID NO: 599 - DNA, 624 bp, Neisseria gonorrhoeae; identical to SEQ ID NO: 227

SEQ ID NO: 600 - protein, 208 aa, Neisseria gonorrhoeae; identical to SEQ ID NO: 228

SEQ ID NO: 601 - DNA, 144 bp, Neisseria gonorrhoeae
ttgcaaacactgccggaacggataaatccggattcccacccacttcgtcattcccgcgaaagcgggaatccggtgcgttggggttcagtcatttccgataaactcctgccgcattgtatttctagattcccgctttcgcgggaa

SEQ ID NO: 602 - protein, 48 aa, Neisseria gonorrhoeae
LQTLPERINPDSHPLRHSRESGNPVRWGSVISDKLLPHCISRFPLSRE

SEQ ID NO: 603 - DNA, 1371 bp, Neisseria gonorrhoeae
ttgcatcctgattgggtgtatcgctttttttcctttataatgccgccatttatatttgccactttcccgatgaagccgtttgccgaaaatatcccccacagccttcgcggcaactgccgcgacgaagccctgccgccgcatacggtagattgcccggaatgcggctgccgtacagacgtgccccagttggacaagggagaggcggcgttctgtccccgttgcggacacaaactcttcagggtgggcagccaccctttttccggtccgcccgcctatgcggcggcttcgctgattttgatggcgtttgcttacagtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgaggcaggcgatgatggtggatgtgttttttgtttccactctggtggcgtatatcaagctctcgtctgtggcaaaggttcgcttcgggccggcgttttatctgatgttcgcgctgtcggttatgctgattcggacttcggtatcggttccccagcattgggtgtatttccaaatcgggcggctgacggggaataatgcggttcagacggcatcggaaggcaaaacctgttgcagccgctgcctgtatttccgcgacagtgccgaatccccctgcggggtgtgcggcgcggaactgtaccgccgacggccgaaaagtctgagtatttcgtcggcgtttctgacggcggcggttgttttgtatttccctgccaatatcctgccgattatgatttcgtccaatcctgccgccacggaggccaacaccatctttagcggcatcgcttatatgtgggacgagggcgacaggctgattgcggcggttattttcagcgcgagtattttggtgccggtgctgaagattgcggcaatgtcggttttgattgcggcggcacggttcgctttgccggcgggcgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattttgacgatgctgtccgcctattatttcgacccgcgcctgctttgggacaaacgcgcttcagacggcattgctttcaacgaaacggaaaaatatgac

SEQ ID NO: 604 - protein, 457 aa, Neisseria gonorrhoeae
LHPDWVYRFFSFIMPPFIFATFPMKPFAENIPHSLRGNCRDEALPPHTVDCPECGCRTDVPQLDKGEAAFCPRCGHKLFRVGSHPFSGPPAYAAASLILMAFAYSMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAKVRFGPAFYLMFALSVMLIRTSVSVPQHWVYFQIGRLTGNNAVQTASEGKTCCSRCLYFRDSAESPCGVCGAELYRRRPKSLSISSAFLTAAVVLYFPANILPIMISSNPAATEANTIFSGIAYMWDEGDRLIAAVIFSASILVPVLKIAAMSVLIAAARFALPAGAKKLSHLYRITEAVGRWSMIDIFVIIILMCSFHTYAARVIPGSAAVYFCLVVILTMLSAYYFDPRLLWDKRASDGIAFNETEKYD

SEQ ID NO: 605 - DNA, 366 bp, Neisseria gonorrhoeae
ttgtgcggcagaacctgcatctttggcgcgtttggccagctcgtgtttttcggtcgaagtatgatcgacggcggcttcgacggcggtgttgaacagttcgacaatgaccgacacaaaagacgcgataatcaacggcaggcggacggcggtttcggaaacccaaaaaaatgccgcgcacaccagcagcgcgttcagccacaaaacctgacggaatgccacttcgtaacggtaggcggcggcgatgccgtctatcgaatagccgaatgcgttgatgacgcgcctgatgccgcttttgccttttttttctgccgcgtaggaggaaggttccatcggtatcctttcaaaatgtcctcaatatatgccgtc

SEQ ID NO: 606 - protein, 122 aa, Neisseria gonorrhoeae
LCGRTCIFGAFGQLVFFGRSMIDGGFDGGVEQFDNDRHKRRDNQRQADGGFGNPKKCRAHQQRVQPQNLTECHFVTVGGGDAVYRIAECVDDAPDAAFAFFFCRVGGRFHRYPFKMSSIYAV

SEQ ID NO: 607 - DNA, 753 bp, Neisseria gonorrhoeae; identical to SEQ ID NO: 309

SEQ ID NO: 608 - protein, 251 aa, Neisseria gonorrhoeae
LNKNGNTDMALLSIRKLHKQYGSVTAIQSLDLDLEKGEVIVLLGPSGCGKSTLLRCVNGLEPHQGGSIVMDGVGEFGKDVSWQTARQKVGMVFQSYELFAHMTVIENILLGPVKVQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 609 - DNA, 90 bp, Neisseria gonorrhoeae
atgtttgcttgggatgtttcaacacacaggacgacacataaagcactgccctatgaaatgccgtctgaaaagggttcggacggtttgcgg

SEQ ID NO: 610 - protein, 30 aa, Neisseria gonorrhoeae
MFAWDVSTHRTTHKALPYEMPSEKGSDGLR

SEQ ID NO: 611 - DNA, 852 bp, Neisseria gonorrhoeae; identical to SEQ ID NO: 229

SEQ ID NO: 612 - protein, 284 aa, Neisseria gonorrhoeae; identical to SEQ ID NO: 230

SEQ ID NO: 613 - DNA, 126 bp, Neisseria gonorrhoeae
gtgcggatttttttcagccgccgaaaatattgcaaattcaaaggaaaaatcaactatctcatcgttttatttattttattattcttgcgcgtgcggaaatcaagttcgtccggttttgcctgtttt

SEQ ID NO: 614 - protein, 42 aa, Neisseria gonorrhoeae
VRIFFSRRKYCKFKGKINYLIVLFILLFLRVRKSSSSGFACF

SEQ ID NO: 615 - DNA, 99 bp, Neisseria gonorrhoeae
atgacgatttggaagtttcccgaaattcaaaaacaggcaaaaccggacgaacttgatttccgcacgcgcaagaataataaaataaataaaacgatgaga

SEQ ID NO: 616 - protein, 33 aa, Neisseria gonorrhoeae
MTIWKFPEIQKQAKPDELDFRTRKNNKINKTMR

SEQ ID NO: 617 - DNA, 240 bp, Neisseria gonorrhoeae
ttgacaagaaaatccgtatccgcatttgaaggcgggtgcggatttttttcagccgccgaaaatattgcaaattcaaaggaaaaatcaactatctcatcgttttatttattttattattcttgcgcgtgcggaaatcaagttcgtccggttttgcctgtttttgaatttcgggaaacttccaaatcgtcattccagataaaacgcttcagccttatgtttccgatgaccgttttcgcggga

SEQ ID NO: 618 - protein, 80 aa, Neisseria gonorrhoeae
LTRKSVSAFEGGCGFFSAAENIANSKEKSTISSFYLFYYSCACGNQVRPVLPVFEFRETSKSSFQIKRFSLMFPMTVFAG

SEQ ID NO: 619 - DNA, 885 bp, Neisseria gonorrhoeae
ttgaacaagcgtgccgcaaagccggaaaaaatgttcaagccgcatcggcggcagacgggacgaaaaatgacgtttgacgaatggttgggcttgtcaaaactgcctaaaattgaagcaaggatgctgctgcaatatgtttcggaatatacgcgcgtgcagttgttgacgcggggcggggaagaaatgccggacgaaatccgacagcgggcggacaggctggcgcaacgccgtctgaacggcgagccggttgcctatattttaggtgtgcgcgaattttatggcagacgctttacagtcaacccgaacgtgctgattccgcgccccgaaaccgaacacttggtcgaagccgtattggcgcgcctgcccgaaaacgggcgcgtgtgggatttggggacgggcagcggcgcagttgccgtaaccgttgcgctcgaacgccccgatgcgtttgtgcgcgcatccgacatcagcacgcccgcccttgaaacggcgcggaaaaatgcggcggatttgggcgcgcgggtcgaatttgcacacggttcgtggttcgacaccgatatgccgtctgaaaggcaatgggacatcatcgtgtccaacccgccctatatcgaaaacggcgataaacatttgtcgcaaggcgatttgcggtttgagccgcaaatcgcgctgaccgacttttcagacggcctaagctgcatccgaaccttggcgcaaggcgcgcccgaccgtttggcggaaggcggttttttgttgttggaacacggtttcgatcagggcgcggcggtgcgcggcgtgttggcggagaatggtttttcgggagtggaaatcctgccggatttggccggtttggacagggttacgctggggaagtatatgaagcatttgaaa

SEQ ID NO: 620 - protein, 295 aa, Neisseria gonorrhoeae
LNKRAAKPEKMFKPHRRQTGRKMTFDEWLGLSKLPKIEARMLLQYVSEYTRVQLLTRGGEEMPDEIRQRADRLAQRRLNGEPVAYILGVREFYGRRFTVNPNVLIPRPETEHLVEAVLARLPENGRVWDLGTGSGAVAVTVALERPDAFVRASDISTPALETARKNAADLGARVEFAHGSWFDTDMPSERQWDIIVSNPPYIENGDKHLSQGDLRFEPQIALTDFSDGLSCIRTLAQGAPDRLAEGGFLLLEHGFDQGAAVRGVLAENGFSGVEILPDLAGLDRVTLGKYMKHLK

SEQ ID NO: 621 - DNA, 1386 bp, Neisseria gonorrhoeae
atgaatgcagtcgtagttgccgtaatcgttatgctggtgctgtcgctgtcgcgcgtgcacgtggtattgagcctgacggtcggcgcgtttgtcggcggcgcggtggcgggtatgccgctgcaaaacattgccgatgcggcgggacaggtcagtcaggcggggattatccccgtgttcaacaaaggtttggaaggcggcgcgaagattgcgctttcttatgcgatgcttggtgcgtttgcgatggcgattacccattccggcctgccgcagcagcttgccggcgcggtcgtccgcaagctgaaccggggcggtatgcccgacagcgtgcgttcgggcgagggcgcggtcaaatggctgctgctttccatcatccttgtgatgggcattatgagtcagaacgtcatacccatccacatcgcctttatcccgatgattgttccgccgctgcttttggtgtttaaccgcctgaaaatcgaccgccgcctgattgcgtgcgtcatcactttcgggctggttacgacttatatgttcctgccttacggcttcggcgcgatttttttgaacgaaatcctgttgggcaacatccattccgccgcgccgcagcttgatgtgaaaaacatcaacgtgatggcggcaatggcgattcccgcattgggaatgctggccggactcctgctggcgtttgtccactaccgcaaaccgcgactgtaccaaagcaacaatgccgatacggcgggcaacgccgatgcggcaaaccgtccgcagccgtccgcctaccgcagcctggttgccgccgccgccatcgccgtatgctttgccatacagttgatgtatgaagattcgctggtgttgggcgcgatgctcggtttcgccgtatttatgatgttgggggtcattaaccgcgacaaggcaaacgacgtattcggcgaaggcatcaagatgatggcgatggtcggcttcattatgattgccgcgcagggttttgccgccgtgatgaatgcgaccgggcatattcagccgctggtggaaagcagtatggcgatattcggcaacagcaaaggtatggcggcgttggcgatgctggtggtggggcttttggtaacgatgggcatcggttcgtccttttccactttgccgattattgccgcgatttatgtgccgctgtgtaccggtttgggcttttcgccgcttgccaccgccgccattgtcggcacggcgggggcgttgggcgatgccggttcgcccgcgtccgattccacgctgggcccgacgatggggctgaacgccgacgggcggcacgaccatatccgcgattccgtcatcccgaccttcatccactacaacatcccgcttctgattgccggctggattgccgcgatggtgctg

SEQ ID NO: 622 - protein, 462 aa, Neisseria gonorrhoeae
MNAVVVAVIVMLVLSLSRVHVVLSLTVGAFVGGAVAGMPLQNIADAAGQVSQAGIIPVFNKGLEGGAKIALSYAMLGAFAMAITHSGLPQQLAGAVVRKLNRGGMPDSVRSGEGAVKWLLLSIILVMGIMSQNVIPIHIAFIPMIVPPLLLVFNRLKIDRRLIACVITFGLVTTYMFLPYGFGAIFLNEILLGNIHSAAPQLDVKNINVMAAMAIPALGMLAGLLLAFVHYRKPRLYQSNNADTAGNADAANRPQPSAYRSLVAAAAIAVCFAIQLMYEDSLVLGAMLGFAVFMMLGVINRDKANDVFGEGIKMMAMVGFIMIAAQGFAAVMNATGHIQPLVESSMAIFGNSKGMAALAMLVVGLLVTMGIGSSFSTLPIIAAIYVPLCTGLGFSPLATAAIVGTAGALGDAGSPASDSTLGPTMGLNADGRHDHIRDSVIPTFIHYNIPLLIAGWIAAMVL

SEQ ID NO: 623 - DNA, 1683 bp, Neisseria gonorrhoeae
ttgctttcaacgaaacggaaaaatatgactgacaacagccctcctccaaacggacacgctcaagcacgcgtccgcaaaaacaacaccttcctctccgccgtctggctggtcccgctgatcgcgctgattgccggcggctggctttgggttaaggaaatccgcaacagggggcctgtggttacgctcttgatggacagcgcggaaggcatcgaagtcaacaatacggtcattaaggtattgagcatcgatgtcggacgcgttacccgaatcaaactgcgcgacgaccaaaaaggcgtggaagttactgcccaactcaatgcggacgtatccggcctcatccgcagcgatacccagttttgggtggtcaagccgcgtatcgaccaaagcggcgtaaccggtttgggtacgctgctttcgggttcgtacatcgcttttacacccggcaaaagcggcgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaactttatggtcgggcaaatcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcaggcgcgatttcatttgattcgccgaaaaccaaaaacagtaaaaacgtcaaaagcgaggacagcttcacgctttacgacagccgcagcgaaatcgccaacctgcctgacgaccgctcgctgtactacaccgcgtttttcaaacaatccgtgcgcggactgaccgtcggttcgcctgtcgaatacaaagggctgaatgtcggcatggtttccgatgtcccttattttgaccgcaatgacagcctgcacctgtttgaaaacggctggattcccgtacgcatccgcatcgagccttcccgtttggaaatcaatgccgacgagcaaagcaaagagcattggaaacaacaattccagacggccttaaacaaaggcctgaccgccaccatctccagcaacaacctgctgaccggcggcaaaatgattgagttgaacgatcagccttccgcctcgcccaagctgcgaccgcataccgtttatgcaggcgataccgtcatcgccacacggggcggcggtttggatgacttgcaggtcaaattggcggatttgctggacaaattcaacaatctgccattggataaaaccgttgccgaattgaacggctcgctcgccgaactcaagtccgcactcaaatccgccaatgccgccctaagctccattgacaaactggtcggcaatccgcagacgcaaaacatcccgaacgaactgaaccaaactctgaaagagttgcgcataaccctgcaaggcgtatcgcctcaatcgcctatctacggagacgtacaaaatacgctgcaaagtttggacaaaaccttaaaagacgttcaacccgtcattaacactttgaaagaaaaacccaacgcactgattttcaacaacagcagcaaagaccctatcccgaaaggaagccga

SEQ ID NO: 624 - protein, 561 aa, Neisseria gonorrhoeae
LLSTKRKNMTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSGEAKDVFQVQDIPPVTAIGQSGLRLNLIGKNDRILNVNSPVLYENFMVGQIESAHFDPSDQSVHYTIFIQSPNDKLIHSASRFWLESGINIETTGSGIKLNSAPLPALLSGAISFDSPKTKNSKNVKSEDSFTLYDSRSEIANLPDDRSLYYTAFFKQSVRGLTVGSPVEYKGLNVGMVSDVPYFDRNDSLHLFENGWIPVRIRIEPSRLEINADEQSKEHWKQQFQTALNKGLTATISSNNLLTGGKMIELNDQPSASPKLRPHTVYAGDTVIATRGGGLDDLQVKLADLLDKFNNLPLDKTVAELNGSLAELKSALKSANAALSSIDKLVGNPQTQNIPNELNQTLKELRITLQGVSPQSPIYGDVQNTLQSLDKTLKDVQPVINTLKEKPNALIFNNSSKDPIPKGSR

SEQ ID NO: 625 - DNA, 150 bp, Neisseria gonorrhoeae
gtggtcggtacgttaaaccgatgccgtctgaaaggcttttgcttcgtaaccgcttggtttgttcgggcaggcagggttttccctcagccggcagggatgcgcttaatgccgtacggacacccctccgccccgttttcagacggcatatat

SEQ ID NO: 626 - protein, 50 aa, Neisseria gonorrhoeae
VVGTLNRCRLKGFCFVTAWFVRAGRVFPQPAGMRLMPYGHPSAPFSDGIY

SEQ ID NO: 627 - DNA, 204 bp, Neisseria gonorrhoeae
ttggaacgccgtattgtcgaactggaaatccaaaccgcgcttcaggaggacgtaatctccggtctgaacgcgatggtggcggaattgcggcagacgttggatttgcagcaggctcagttgaggctgctgtatcaaaaaatgcaggacaggaatcccgacgcgcaagagccgtattccctgcgcgacgagattccgccgcattat

SEQ ID NO: 628 - protein, 68 aa, Neisseria gonorrhoeae
LERRIVELEIQTALQEDVISGLNAMVAELRQTLDLQQAQLRLLYQKMQDRNPDAQEPYSLRDEIPPHY

SEQ ID NO: 629 - DNA, 1521 bp, Neisseria gonorrhoeae
ttgaaccgcgtccatttacagcaccatcgcggcaatccagccggcaatcagaagcgggatgttgtagtggatgaaggtcgggatgacggaatcgcggatatggtcgtgccgcccgtcggcgttcagccccatcgtcgggcccagcgtggaatcggacgcgggcgaaccggcatcgcccaacgcccccgccgtgccgacaatggcggcggtggcaagcggcgaaaagcccaaaccggtacacagcggcacataaatcgcggcaataatcggcaaagtggaaaaggacgaaccgatgcccatcgttaccaaaagccccaccaccagcatcgccaacgccgccatacctttgctgttgccgaatatcgccatactgctttccaccagcggctgaatatgcccggtcgcattcatcacggcggcaaaaccctgcgcggcaatcataatgaagccgaccatcgccatcatcttgatgccttcgccgaatacgtcgtttgccttgtcgcggttaatgacccccaacatcataaatacggcgaaaccgagcatcgcgcccaacaccagcgaatcttcatacatcaactgtatggcaaagcatacggcgatggcggcggcggcaaccaggctgcggtaggcggacggctgcggacggtttgccgcatcggcgttgcccgccgtatcggcattgttgctttggtacagtcgcggtttgcggtagtggacaaacgccagcaggagtccggccagcattcccaatgcgggaatcgccattgccgccatcacgttgatgtttttcacatcaagctgcggcgcggcggaatggatgttgcccaacaggatttcgttcaaaaaaatcgcgccgaagccgtaaggcaggaacatataagtcgtaaccagcccgaaagtgatgacgcacgcaatcaggcggcggtcgattttcaggcggttaaacaccaaaagcagcggcggaacaatcatcgggataaaggcgatgtggatgggtatgacgttctgactcataatgcccatcacaaggatgatggaaagcagcagccatttgaccgcgccctcgcccgaacgcacgctgtcgggcataccgccccggttcagcttgcggacgaccgcgccggcaagctgctgcggcaggccggaatgggtaatcgccatcgcaaacgcaccaagcatcgcataagaaagcgcaatcttcgcgccgccttccaaacctttgttgaacacggggataatccccgcctgactgacctgtcccgccgcatcggcaatgttttgcagcggcatacccgccaccgcgccgccgacaaacgcgccgaccgtcaggctcaataccacgtgcacgcgcgacagcgacagcaccagcataacgattacggcaactacgactgcattcattgtttatcgctccaaacctataaatgtttacatatcaaaacacatcataacccaataacggaaaatccgccaattttgcaaacaattatttcaaatgcttcatatacttccccagcg

SEQ ID NO: 630 - protein, 507 aa, Neisseria gonorrhoeae
LNRVHLQHHRGNPAGNQKRDVVVDEGRDDGIADMVVPPVGVQPHRRAQRGIGRGRTGIAQRPRRADNGGGGKRRKAQTGTQRHINRGNNRQSGKGRTDAHRYQKPHHQHRQRRHTFAVAEYRHTAFHQRLNMPGRIHHGGKTLRGNHNEADHRHHLDAFAEYVVCLVAVNDPQHHKYGETEHRAQHQRIFIHQLYGKAYGDGGGGNQAAVGGRLRTVCRIGVARRIGIVALVQSRFAVVDKRQQESGQHSQCGNRHCRHHVDVFHIKLRRGGMDVAQQDFVQKNRAEAVRQEHISRNQPESDDARNQAAVDFQAVKHQKQRRNNHRDKGDVDGYDVLTHNAHHKDDGKQQPFDRALARTHAVGHTAPVQLADDRAGKLLRQAGMGNRHRKRTKHRIRKRNLRAAFQTFVEHGDNPRLTDLSRRIGNVLQRHTRHRAADKRADRQAQYHVHARQRQHQHNDYGNYDCIHCLSLQTYKCLHIKTHHNPITENPPILQTIISNASYTSPA

SEQ ID NO: 631 - DNA, 192 bp, Neisseria gonorrhoeae
atgaaaccggttcttgtccgaacggcgatgagcggcttcccccgctgcaaacagataaaaccaaccgggtattcaaacacagccaaaaaaagccgtccgaacccaaaggggacagacggccaaacacattacggggaaaacgtcttactcaatgagtctgcgaaacagacattgctaaaacaactgcaatta

SEQ ID NO: 632 - protein, 64 aa, Neisseria gonorrhoeae
MKPVLVRTAMSGFPRCKQIKPTGYSNTAKKSRPNPKGTDGQTHYGENVLLNESAKQTLLKQLQL

SEQ ID NO: 633 - DNA, 705 bp, Neisseria gonorrhoeae
ttggacgaaatcggcatcgaagggcagcagaagctttccgccgcgcatattttggtcgtcggctgcggcggattgggcgccgccgccctgccctatctcgccgcctcgggcgtcggcacgctgaccatagccgattccgacacggtcgagctgcacaacctgcaacgccaagtcgcatttgacgagggcgatgtcggcaagcctaaagccgaaaccttggcaggccgcctgaaacgcatcaaccatactgtcgatgtccgcgccgtcaacgaaaaactcgacggctgccgcctgaccggtttggttcaaaccgccgacatcgttttagactgctgcgacaactacgccacgcggcaggcggtcaaccgtgcctgcgtgcaaacgaaaacaccgctggtttcaggggcggcggtacgttttgaaggacagcttgccgcataccgtcccgacttgcccgactcgccgtgttacgcctgcctgttcgacggcggatcggcttcagacggcatctgttccctcttcggcgtgctctcgccgctggtcggcatcgtcggctgcacacaggcggcggaggctctgaaaatcctgctggaagcgggcgaaccgtcgcacggcaggctggcggtttaccgtgccttggaagggggctggcaatatttcgacctgccgcgcaaccccgaatgcccggtttgcggcgcggcacgg

SEQ ID NO: 634 - protein, 235 aa, Neisseria gonorrhoeae
LDEIGIEGQQKLSAAHILVVGCGGLGAAALPYLAASGVGTLTIADSDTVELHNLQRQVAFDEGDVGKPKAETLAGRLKRINHTVDVRAVNEKLDGCRLTGLVQTADIVLDCCDNYATRQAVNRACVQTKTPLVSGAAVRFEGQLAAYRPDLPDSPCYACLFDGGSASDGICSLFGVLSPLVGIVGCTQAAEALKILLEAGEPSHGRLAVYRALEGGWQYFDLPRNPECPVCGAAR

SEQ ID NO: 635 - DNA, 210 bp, Neisseria gonorrhoeae
gtggcggctgtaccgcagcaggagtgcgtcgtcgttgtcgtgttcggtcgcggtcatgatgatgttcggaaaaaaacagttgcgggcgattgtaacgccgccgtcgggcggcgttcaacttcagacggcatttcgggacatgagtggttaaagtgtgaacggtttggcacggatgcggcatttgaggtacatttacagtatttacggcaa

SEQ ID NO: 636 - protein, 70 aa, Neisseria gonorrhoeae
VAAVPQQECVVVVVFGRGHDDVRKKTVAGDCNAAVGRRSTSDGISGHEWLKCERFGTDAAFEVHLQYLRQ

SEQ ID NO: 637 - DNA, 2742 bp, Neisseria gonorrhoeae
ttgaggtacatttacagtatttacggcaatgagaggaaaatcatgcaactgcatatcctgaacaatccgaaggacgcggctttggcggcggacgcggaatttttgaaacagtccctgttcaacctcctgcacgaagaagcctcgccgttggttgtcgaaacggtcaaactcttgtccacttccgacgacagcgcggcattgattgaaaaagtattgccgcaattggacgaacggcagacctacgatctgacgcttgcctgcgggctgttcgcccagattctgaatatcgccgaagacgtgcaccacgaacgccgccgccaaatccacgaagatgccggccacaacgcagcagaaggcagcctgacggaaaccgtccgcaggctcaaagcggggaaagccgacggcaaatcggtgcagcggcagttggacaatacgtccgttaccgccgttttgaccgcgcacccgaccgaagtgcaacgccaaaccgttttgaatttcaaccgccgcatccgcgcgctgctgccgcaacgcgaacgctgcaccaatgccgacgcgctggcacggctgcgccgcgaaatcgacaccgtgcttctgggcttgtggcagaccagcgaaacgcgccgccacaaactcagcgtcaacgacgaaatcaacaacggcgtgtccatcttcccgatgagcttttttgaagccctgcccaaactctaccgcaagatggaacacgactttcagacggcctatcccgatgtccgcgttccgaatatccttaaaatcggcggctggatcggcggcgaccgcgacggcaatccgtttgtttctggcgaaaccctgcgctttgccttccgccgccacgccgatgccgtgttccgtttttaccgcagcgaactcgacaaactttaccgcgaactgccgctttccatccgccgcgtcaaagtcaacgacgacgtaatggcactggcagccctctcgcctgacgaagaaatcgcccgcaccgaagaaccttaccgccgcgccattgcctacattatggcgcgcgctatgggcaaagcgcgctcgctcggtttgggcatgggctgcaaattcggctttctcgagccttatgcttcggcccaaaaatttctcgatgatttgaaaaaattgcaacgttcccttatcgacaacggcagccgcctgcttgccgaaggccgtttggcagacctcatccgttccgtgtccgtgttcggcttccacatgatgccgctcgacctgcgccaacacgcaggcaaacacgccgatgtggttgccgagcttttccaacacgcaggcttggaagactacaacagcctgaacgaagagcaaaaacaagccgccttgttgcgcgaattgggccaccaacgtccgctgtacagcccgttcatcacatacagcgaccatacccgccgcgaattggcgattttcaacgaagcgcgcaaaatcaaagacgaatttggcgaagatgccgtaacacaaagcattatttccaactgcgaacaacccggcgacctgctcgccttggcattgctgctgaaagaaagcggcctgttggcggtggaaaacggcaaaccgcacagccgcatcaacatcgtgcctctgtttgaaaccatcgaagcgctcgaaaatgcctgtccggtcatggaaaccatgttccgcctcgactggtatgatgccctgctcgaaagccgcggcaacatccaagaaatcatgctcggctattccgactccaacaaagacggcggctacgttaccagctcatggtgtctgcatcaggcggaattgggcttggtcgaactcttcaaaaaatacgatgtccgcatgcgcttgttccacggtcgaggcggcagcgtcggacgcggcggcggcccgtcttaccaagccatcttggcgcaacccgcaggcagcgttgccggacaaatccgcattaccgagcaaggcgaagtcatcaccgccaaatacgccgaccccggcaacgcccaacgcaacttggaaaccttggttgccgcgactttggaagccagcatcctgccggataaaaaagaccctgatgccaaactgatgcaggcattgtcggacgtatcgttcaaatactaccgcgaactgattacccaccccgacttcatcgactacttcctgcaaaccagcccgattcaggaaatcgccaccctcaacctcggcagccgtcccgccagccgcaaaaccctggcgcgaattcaggatttacgcgcgattccgtgggtattctcctggatgcaaaaccgcctcatgctgccggcttggtacggtttcggcagcgcggtggaaaccttgtgcgaaggcagccccgaaaccctcgccgccctgcgcggacacgcccaaaacaaccccttcttccaagcgatgctctccaatatggaacaagtgatggcgaaaaccgacatcaccttggcggaaaactacgccggtttgagcgaatcacccgaaaaggcaaaagtcatcttcggcatgattaaggaagaataccgacgcagccgcaaagccctgctcgacctgctgcaaaccgaagaacttttgcgcgacaaccgcagcctcgcccgttcgctcgctttgaggattccatacctgaacgcgctcaacggtttgcaagtcgccatgctcaaacgcctgcgcaaagaacccgacaatccgcacgccctgctgatggtgcacctgaccatcaacggcgtggcgcaaggtttgcgcaataccggc

SEQ ID NO: 638 - protein, 914 aa, Neisseria gonorrhoeae
LRYIYSIYGNERKIMQLHILNNPKDAALAADAEFLKQSLFNLLHEEASPLVVETVKLLSTSDDSAALIEKVLPQLDERQTYDLTLACGLFAQILNIAEDVHHERRRQIHEDAGHNAAEGSLTETVRRLKAGKADGKSVQRQLDNTSVTAVLTAHPTEVQRQTVLNFNRRIRALLPQRERCTNADALARLRREIDTVLLGLWQTSETRRHKLSVNDEINNGVSIFPMSFFEALPKLYRKMEHDFQTAYPDVRVPNILKIGGWIGGDRDGNPFVSGETLRFAFRRHADAVFRFYRSELDKLYRELPLSIRRVKVNDDVMALAALSPDEEIARTEEPYRRAIAYIMARAMGKARSLGLGMGCKFGFLEPYASAQKFLDDLKKLQRSLIDNGSRLLAEGRLADLIRSVSVFGFHMMPLDLRQHAGKHADVVAELFQHAGLEDYNSLNEEQKQAALLRELGHQRPLYSPFITYSDHTRRELAIFNEARKIKDEFGEDAVTQSIISNCEQPGDLLALALLLKESGLLAVENGKPHSRINIVPLFETIEALENACPVMETMFRLDWYDALLESRGNIQEIMLGYSDSNKDGGYVTSSWCLHQAELGLVELFKKYDVRMRLFHGRGGSVGRGGGPSYQAILAQPAGSVAGQIRITEQGEVITAKYADPGNAQRNLETLVAATLEASILPDKKDPDAKLMQALSDVSFKYYRELITHPDFIDYFLQTSPIQEIATLNLGSRPASRKTLARIQDLRAIPWVFSWMQNRLMLPAWYGFGSAVETLCEGSPETLAALRGHAQNNPFFQAMLSNMEQVMAKTDITLAENYAGLSESPEKAKVIFGMIKEEYRRSRKALLDLLQTEELLRDNRSLARSLALRIPYLNALNGLQVAMLKRLRKEPDNPHALLMVHLTINGVAQGLRNTG

SEQ ID NO: 639 - DNA, 957 bp, Neisseria gonorrhoeae
atgatgaaagtcctctttatcgccgacccgatggcaagtttcaaaacctacaaagacaccacctacgcgatgatgcgggaaatggcaaaacgcggctggcggctgtttcataccttgagcggggaattgtctgtaaacggcggtttggtaacggcacaggcatcggcatttgaattttcgggtgcaaaaaacgatgatgaccatgaatggtttaaagcggcggacaaagttcagacggcattaaaagaatttgatgccgtgattatgcgtaccgatccgccgttcgatatgcaatacctttactccacccaattactgacgctggcggaacagcagggcgcgaaagtgttcaacagcggacgggcgatgcgcgactttaacgaaaaactggcgattttgaatttcagccgctttaccgcgcccacgctggtaacgacccgttccgccgatgtccgcgcatttttgaaagaacacggcgacatcatcgtcaaaccgctcgacggcatgggcggcatgggcatcttccgcctgaccgaaaaagaccccaacatcggcagcatcctcgaaaccctgatgcggtttgattcccgcaccattatggcgcaacgctacattcccgaaatcgtacacggtgacaaacgcatcttgattatcggcggcgaagtcgtcccctatgctttggcgcgtatcccgcaaaacggcgaaacacgcggcaatctggcggcaggcgggcgcggtgtggcgcaggaattggacggacgcgaccgggaaattgcagagactctggctcccgagcttaaacggagcggcatcctgctggccggtttggacgttatcggcagcaacctgaccgaagtcaacgtaaccagcccgaccggattccaagaaattatgaaacaaaaaagtttcgacgtggcggcaatgtttgccgatgccgttgccgcgtggtcggtacgt

SEQ ID NO: 640 - protein, 319 aa, Neisseria gonorrhoeae
MMKVLFIADPMASFKTYKDTTYAMMREMAKRGWRLFHTLSGELSVNGGLVTAQASAFEFSGAKNDDDHEWFKAADKVQTALKEFDAVIMRTDPPFDMQYLYSTQLLTLAEQQGAKVFNSGRAMRDFNEKLAILNFSRFTAPTLVTTRSADVRAFLKEHGDIIVKPLDGMGGMGIFRLTEKDPNIGSILETLMRFDSRTIMAQRYIPEIVHGDKRILIIGGEVVPYALARIPQNGETRGNLAAGGRGVAQELDGRDREIAETLAPELKRSGILLAGLDVIGSNLTEVNVTSPTGFQEIMKQKSFDVAAMFADAVAAWSVR

SEQ ID NO: 641 - DNA, 135 bp, Neisseria gonorrhoeae
atgcagggcgagcgccgtaccccacgaacctgcgccgataacggtaattttcattggtcgtctttcaacatatcactgccgttcactttaaaacaatcggtgtttctctgcaagtgcggtcaggtaaatgccgtc

SEQ ID NO: 642 - protein, 45 aa, Neisseria gonorrhoeae
MQGERRTPRTCADNGNFHWSSFNISLPFTLKQSVFLCKCGQVNAV

SEQ ID NO: 643 - DNA, 873 bp, Neisseria gonorrhoeae
atgcaggaagcgcgtgaaaacaaacgcggactgcccggcttttcctttcccgaaaccttggaagtgtgtgcggatttggcagaggcgctcaaagacagcggacttgtccttatcgtaacctccgttgccggattgagaagcagcgcagagctgctcaaacagtacggcgcgggacacctccccgtcctcgccgcctgcaaaggcttcgagcaggatacagggctgctgaccttccaagtcttgaaagaagtattgcccgacaataagaaaatcggcgtactttccggtccgagttttgcacaggaactcgccaaacaactgccctgcgccgtcgtcctcgcctccgaaaaccaagagtggattgaagaactcgtaccgcagctcaacacgaccgtcatgaggctttacggcagtaccgacgttatcggcgtggcagtaggcggttcagtcaaaaacgtcatggcaatcgctaccggactctccgacggactcgaatacggactcaacgcccgtgccgcactggttacgcgcggactggccgaaatcacccgccttgcctccgcaatgggcgcgcagcccaaaaccatgatggggcttgccggcatcggcgatctcatcttgacctgtaccggtgcactttcgcgcaaccgccgcgtcggcttgggtttggcagaaggcaaggaactgcatcaggtgctggtcgaaatcgggcacgtttccgaaggggtcagcaccatagaagaagtcttcaataccgcctgcaaataccaaatcgatatgccgattacccaaaccctgctgcaactcatccgcaaagaaatgacccctcagcaggtcgtcgaaaggctgatggaacgcagcgcgcgtttcgaa

SEQ ID NO: 644 - protein, 291 aa, Neisseria gonorrhoeae
MQEARENKRGLPGFSFPETLEVCADLAEALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGSVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 645 - DNA, 369 bp, Neisseria gonorrhoeae
atgccgtctgaacccccagacggcatacagacaggtaaggtcatgaaacaaaatatcgaaaaactcgaaagcagcgtttatacgttggtacaaaaattcgaaaccctcgtcagcgaaaaccgccgcctcaaagaaaccgtcgccgaactcgaacgggcgcacgagcggcaaaaactcgaacacgagaccgccgtcgacgaactcagcgaagccctgctcgtccaagtcggcaaactcaaagaagacctgcaaaacaaaatcgacagcctgacggaagaaaatgcacgataccgcgccctgctcgaacagagcagggagaaaatcagcgcactggcagcgcgcctcccccaacggcaggaaacgcagcaa

SEQ ID NO: 646 - protein, 123 aa, Neisseria gonorrhoeae
MPSEPPDGIQTGKVMKQNIEKLESSVYTLVQKFETLVSENRRLKETVAELERAHERQKLEHETAVDELSEALLVQVGKLKEDLQNKIDSLTEENARYRALLEQSREKISALAARLPQRQETQQ

SEQ ID NO: 647 - DNA, 303 bp, Neisseria gonorrhoeae
atgaacatcgaacaagtctacatcgaagtcatgcacgcccggctgaccgtcaacacgccggcagaagaaaaagacacactgttgcaggcagtcggaatgctcaacggcaaagccgaagccatccgcgaaggcggccgcgtcgcggacagcgaaaaaatcgtcattatggccgcgctcaacgtcgtccacgacctattgaaaacctccctgaacggcggcgatttggcaatcggcgattttgcgcgtaaaataaccgatatggacaacgcctgccaaaaggcactatcccgcttggggcaggaa

SEQ ID NO: 648 - protein, 101 aa, Neisseria gonorrhoeae
MNIEQVYIEVMHARLTVNTPAEEKDTLLQAVGMLNGKAEAIREGGRVADSEKIVIMAALNVVHDLLKTSLNGGDLAIGDFARKITDMDNACQKALSRLGQE

SEQ ID NO: 649 - DNA, 429 bp, Neisseria gonorrhoeae
ttgctgacaaggcggctgccccgggtagtttcgggtgcgtccgcaaaaggacgctcgcgcccactactgctcccggcaaccttaagcgaacttattggttcaaaggaatatatgccttcgcggacaccgcagggaaaaaggggttattcctgccccaagcgggatagtgccttttggcaggcgttgtccatatcggttattttacgcgcaaaatcgccgattgccaaatcgccgccgttcagggaggttttcaataggtcgtggacgacgttgagcgcggccataatgacgattttttcgctgtccgcgacgcggccgccttcgcggatggcttcggctttgccgttgagcattccgactgcctgcaacagtgtgtctttttcttctgccggcgtgttgacggtcagccgggcgtgcatgacttcgatg

SEQ ID NO: 650 - protein, 143 aa, Neisseria gonorrhoeae
LLTRRLPRVVSGASAKGRSRPLLLPATLSELIGSKEYMPSRTPQGKRGYSCPKRDSAFWQALSISVILRAKSPIAKSPPFREVFNRSWTTLSAAIMTIFSLSATRPPSRMASALPLSIPTACNSVSFSSAGVLTVSRACMTSM

SEQ ID NO: 651 - DNA, 429 bp, Neisseria gonorrhoeae
atgaaaaccttttcagcgaaaccccacgaggtgaagcgcgaatggttcgtcatcgatgcccaagacaaagtcttgggtcgcgttgcaaccgaagtcgccagccgtctgcgtggcaaacacaaacctgaatacaccccccacgtcgataccggcgattacatcatcgtcatcaatgcggacaaactgcgtgtaaccggtgccaaattcgaagataaaaaatacttccgccattccggttttccaggcggcatctacgagcgcactttccgcgaaatgcaagatcaattcccgggccgcgctttggagcaggctgtaaaaggtatgctgcccaaaggtccgctgggttacgccatgattaaaaaactgaaagtgtacgctggtgcggagcatgcccatgctgcgcaacaacccaaagttttggaactgaaa

SEQ ID NO: 652 - protein, 143 aa, Neisseria gonorrhoeae
MKTFSAKPHEVKREWFVIDAQDKVLGRVATEVASRLRGKHKPEYTPHVDTGDYIIVINADKLRVTGAKFEDKKYFRHSGFPGGIYERTFREMQDQFPGRALEQAVKGMLPKGPLGYAMIKKLKVYAGAEHAHAAQQPKVLELK

SEQ ID NO: 653 - DNA, 426 bp, Neisseria gonorrhoeae
gtgtccttattatttcagttccaaaactttgggttgttgcgcagcatgggcatgctccgcaccagcgtacactttcagttttttaatcatggcgtaacccagcggacctttgggcagcataccttttacagcctgctccaaagcgcggcccgggaattgatcttgcatttcgcggaaagtgcgctcgtagatgccgcctggaaaaccggaatggcggaagtattttttatcttcgaatttggcaccggttacacgcagtttgtccgcattgatgacgatgatgtaatcgccggtatcgacgtggggggtgtattcaggtttgtgtttgccacgcagacggctggcgacttcggttgcaacgcgacccaagactttgtcttgggcatcgatgacgaaccattcgcgcttcacctcgtggggtttcgc

SEQ ID NO: 654 - protein, 142 aa, Neisseria gonorrhoeae
VSLLFQFQNFGLLRSMGMLRTSVHFQFFNHGVTQRTFGQHTFYSLLQSAARELILHFAESALVDAAWKTGMAEVFFIFEFGTGYTQFVRIDDDDVIAGIDVGGVFRFVFATQTAGDFGCNATQDFVLGIDDEPFALHLVGFR

SEQ ID NO: 655 - DNA, 390 bp, Neisseria gonorrhoeae
atgaacggtaaatactactacggcacaggccgccgcaaaagttcagtggctcgtgtattcctgactaaaggtacgggtcaaatcatcgtaaacggccgtcccgttgacgaattcttcgcacgcgaaaccagccgtatggttgtccgccaacctctggttctgactgaaaacgccgaatctctcgacatcaaagtaaatgttgtcggcggcggcgaaaccggccagtccggcgcaatccgccacggtattacccgtgccctgattgattttgacgctgctttgaaacctgccttgtctcaagccggtttcgttacccgcgatgcgcgcgaagtcgaacgtaaaaaaccgggtctgcgcaaagcacgccgtgcaaaacaattctccaaacgt

SEQ ID NO: 656 - protein, 130 aa, Neisseria gonorrhoeae
MNGKYYYGTGRRKSSVARVFLTKGTGQIIVNGRPVDEFFARETSRMVVRQPLVLTENAESLDIKVNVVGGGETGQSGAIRHGITRALIDFDAALKPALSQAGFVTRDAREVERKKPGLRKARRAKQFSKR

SEQ ID NO: 657 - DNA, 186 bp, Neisseria gonorrhoeae
ttgattttggaaattcaaaaaaccctgcttatcgcagggttttttatttgtaacaggcggtttcccattggtaatctaaagattacggattgggcaaaaatcaaaaacagcaccggtatcgactacacggacgaactgaccgtcagggatggctgttactggagaggacatcgtatttctactttg

SEQ ID NO: 658 - protein, 62 aa, Neisseria gonorrhoeae
LILEIQKTLLIAGFFICNRRFPIGNLKITDWAKIKNSTGIDYTDELTVRDGCYWRGHRISTL

SEQ ID NO: 659 - DNA, 516 bp, Neisseria gonorrhoeae
atgcgccttttccccatcgccgccgccctgacgcttgccgcctgcggtactgtgcaaagcacacaatatttcgtgttgcccgacagccgctacatccgtcctgcaacgcaaggcggcgaaaccgccgtcgaagtccgtcttgccgaaccgctcaaacgcggcggactggtctatcaaaccgacccctaccgcatcaacaccgcacaaaaccatgtttgggcagacaccttggacgatatgctcgaagcggcgttgagcaatgcattcaaccgtttggacagcacacgcacctttgttcctgcctcacgcagcggcagtaccgacaaatggacggtctatatcgacgcattccaaggcagctacacgggcaaaaccctcatcagcggctacgccgtcctacccgacggtacgaacagacccttccatatcgaaaccgaacagcagggtgacggctacgccgccatgaccgccgcactcgaacagggactgaaacaggcggcgcaacagatggtcgag

SEQ ID NO: 660 - protein, 172 aa, Neisseria gonorrhoeae
MRLFPIAAALTLAACGTVQSTQYFVLPDSRYIRPATQGGETAVEVRLAEPLKRGGLVYQTDPYRINTAQNHVWADTLDDMLEAALSNAFNRLDSTRTFVPASRSGSTDKWTVYIDAFQGSYTGKTLISGYAVLPDGTNRPFHIETEQQGDGYAAMTAALEQGLKQAAQQMVE

SEQ ID NO: 661 - DNA, 1290 bp, Neisseria gonorrhoeae
atccgattgcgacacggtaaccggtatgccgcgcaagcgcgcaagcagcgcgtccgccttctgtttctgcgcggcaaacgccgccttgtccgcctgcgtcaattcgggtgtcggcaatgcgaccgaaacaggattgacgggctgcccgttgatgcgcgcctcgtaatgcaggtgcggcccggtcgaacgccctgtcgaaccgacaaaaccgatgacctcgccgccgcgcacattgccttgtgcctgcgaaaacgcgctcaagtgcgcgtacagcgtttccacaccgttggcgtggcgtatcatcaccgcgttgccgtatccgcccttccggcctttaaaggtaatcacgccgtcggcggaagccctgaccggcgttccctgcggtgcggcataatcgatgcccgtgtgcagccgccatgtgtgcaggatggggtgcatacggtagccgaacggcgaagaaatgcgcgtatagaccagcggctcgatgttgaagccgcctttttcctgcaacaccctgccgtcttcatcgtaataattgccgccccctccgccttccttgtccgaacggtaatagaacgcctgatgggttgtgccgcccttgacaacttccgccgccaaaatatcgcccgccgccacctgctgcccgtggaaatacaggctgtcgtaaagcaggcgcacggcatcgccttccttcaaaccgtcaaggctgaagcggccggcaaaaatcccgcttaaggattcgcggatttcgacgggcacttccgcccgcgccagcgaaccgcgcgccgacgttttgaccacgaccgaacgcagtgtcggcaaaaccttcatatccgcatcagaagccgaccgccgccatatgccgccttttttttccaaagcgaccagattgcgctcgccgtcttcgtcggtaaaaaactgcacttcgcgcgcactgccgtcgccgccgaccaaaacatgaaccgactggtcggcacgcaaatgccgcaaatcggcttcgccgccatatttttccgtgattcgggcaatctcgtcccgcgccatacccgaacgcgccagcacgtccgccagcgagtcgcccggctgcaccgcctcctgcacccaatatgccgtctgaacgccgctgccgccccaagacagcggcggcagtttttgttccacgcgctgcggtctgacgcgctccgtcccctctgtcgaagcaatgtatgccgccgacaccagaataatcgaaacggcaagcgcgcgcagcgcgtatttccgatgttttgccgaaagtgggaagacagccat

SEQ ID NO: 662 - protein, 244 aa, Neisseria gonorrhoeae
IRLRHGNRYAAQARKQRVRLLFLRGKRRLVRLRQFGCRQCDRNRIDGLPVDARLVMQVRPGRTPCRTDKTDDLAAAHIALCLRKRAQVRVQRFHTVGVAYHHRVAVSALPAFKGNHAVGGSPDRRSLRCGIIDARVQPPCVQDGVHTVAERRRNARIDQRLDVEAAFFLQHPAVFIVIIAAPSAFLVRTVIERLMGCAALDNFRRQNIARRHLLPVEIQAVVKQAHGIAFLQTVKAEAAGKNPA

SEQ ID NO: 663 - DNA, 492 bp, Neisseria gonorrhoeae; identical to SEQ ID NO: 231

SEQ ID NO: 664 - protein, 164 aa, Neisseria gonorrhoeae; identical to SEQ ID NO: 232

SEQ ID NO: 665 - DNA, 927 bp, Neisseria gonorrhoeae
atggattccattatcgaattgcgccacctcaaaaccctgctggcacttgaagaaaccggcagcgtctcccttgccgccaaacgggttttccttacccaatccgccctttcccaccagatccgtatgctcgaaaaccactacggcacgccgctgttcgaacgcaaatccacgcccctgcgctttaccccggtgggcgaaaggctgctgcgcctcgcccacgaactgatacctcaagttgctgttgcagaacgagatttggcgcgaatcacggaaggggaggcgggagagctgcggattgccgtcgaatgccatacctgtttcgactggctgatgcccgccatgggcgaattccgcccgatgtggccccaagtcgaactggatatcgtatcaggattccaagcggatcccgtcgggctgctgctgcaacaccgcgccgacctcgccattgtctccgaagccgaaaaacaaagcagcatcagcttccacccactgtttgcctacgaaatggtcggcatttgcgccccggaccatccgcttgccgccaaaaacgtttggacggcggaagactttatcggggaaaccctgattacctatcccgttcccgacgagatgctggatttacccaaaaaaatcctgattccgaaaaacatcaacccgccgcgccggcacagcgagctgaccatcgccattatccaactggttgccagcagacgtggcattgccgcccttccctattggacagtcatgccctaccttgaaaaaggctatgtcgtccaccgccaaattactgccgacggactgcaaagcaaactgtatgccgccatccgcactgaagacacagataaaagttatctgaacaacttttgccaaatcatacgtgaacgcggcttcgcggacttgcccggattaagtgagttggaaccggtc

SEQ ID NO: 666 - protein, 309 aa, Neisseria gonorrhoeae
MDSIIELRHLKTLLALEETGSVSLAAKRVFLTQSALSHQIRMLENHYGTPLFERKSTPLRFTPVGERLLRLAHELIPQVAVAERDLARITEGEAGELRIAVECHTCFDWLMPAMGEFRPMWPQVELDIVSGFQADPVGLLLQHRADLAIVSEAEKQSSISFHPLFAYEMVGICAPDHPLAAKNVWTAEDFIGETLITYPVPDEMLDLPKKILIPKNINPPRRHSELTIAIIQLVASRRGIAALPYWTVMPYLEKGYVVHRQITADGLQSKLYAAIRTEDTDKSYLNNFCQIIRERGFADLPGLSELEPV

SEQ ID NO: 667 - DNA, 771 bp, Neisseria gonorrhoeae
ttgtttggaaatgacaggaaaaatatggttttgcgcagagattttttagcctggtgcgacgaaacgttgcagacggcatcgtttaaagattacgcccccaatggtttgcaggttgaagggagggaatatatcgggaaaatcgttacgtcggtaacggcaagcagggcagcgattgattttgctgtggagcagaaggcagatttgcttttggtgcatcacggtatgttctggaaaagcgagctgccgaccgttaccggttggaaaaaagaacggattgccgcactgttacggcacgacatcaatatggcaggctaccatctgcccctggatgtgcatcccatactgggcaacaatgcccaactcgccgacagattgggttttgcgacagaaaaacggttcggcgaacaaaacctgctcaactcgggcagcctgaaacaagccaagacactcggcgcattggcggcgcatattgaaacagttttgcaacgtaagcctgtcgccatcggcaatcccgaacgcgaaatccgacgggtcgcatggtgtaccggcggtgcacagggcttttttcagacggcaatagatgaaggcgtcgatctgtatctgacgggtgaaatttccgaagcccaataccacctcgccaatgaaacgggtacggctttcatttcggcagggcatcacgcgacggaacgttacggcgtacgcgcgctggcagaatcggcggcagaggttttcgggttggaagtgtgccattttgacgaaaacaacccggct

SEQ ID NO: 668 - protein, 257 aa, Neisseria gonorrhoeae
LFGNDRKNMVLRRDFLAWCDETLQTASFKDYAPNGLQVEGREYIGKIVTSVTASRAAIDFAVEQKADLLLVHHGMFWKSELPTVTGWKKERIAALLRHDINMAGYHLPLDVHPILGNNAQLADRLGFATEKRFGEQNLLNSGSLKQAKTLGALAAHIETVLQRKPVAIGNPEREIRRVAWCTGGAQGFFQTAIDEGVDLYLTGEISEAQYHLANETGTAFISAGHHATERYGVRALAESAAEVFGLEVCHFDENNPA

SEQ ID NO: 669 - DNA, 462 bp, Neisseria gonorrhoeae
atggcacacttccaacccgaaaacctctgccgccgattctgccagcgcgcgtacgccgtaacgttccgtcgcgtgatgccctgccgaaatgaaagccgtacccgtttcattggcgaggtggtattgggcttcggaaatttcacccgtcagatacagatcgacgccttcatctattgccgtctgaaaaaagccctgtgcaccgccggtacaccatgcgacccgtcggatttcgcgttcgggattgccgatggcgacaggcttacgttgcaaaactgtttcaatatgcgccgccaatgcgccgagtgtcttggcttgtttcaggctgcccgagttgagcaggttttgttcgccgaaccgtttttctgtcgcaaaacccaatctgtcggcgagttgggcattgttgcccagtatgggatgcacatccaggggcagatggtagcctgccatattgatgtcgtgccg

SEQ ID NO: 670 - protein, 154 aa, Neisseria gonorrhoeae
MAHFQPENLCRRFCQRAYAVTFRRVMPCRNESRTRFIGEVVLGFGNFTRQIQIDAFIYCRLKKALCTAGTPCDPSDFAFGIADGDRLTLQNCFNMRRQCAECLGLFQAARVEQVLFAEPFFCRKTQSVGELGIVAQYGMHIQGQMVACHIDVVP

SEQ ID NO: 671 - DNA, 117 bp, Neisseria gonorrhoeae
ttgagaaatatcataaaactttaccttattttaaataatgctttgagtatcactgcaaactgggtaaaattgcaatgtttaatggctcggcattcccaaaatattaggacgactgaa

SEQ ID NO: 672 - protein, 39 aa, Neisseria gonorrhoeae
LRNIIKLYLILNNALSITANWVKLQCLMARHSQNIRTTE

SEQ ID NO: 673 - DNA, 579 bp, Neisseria gonorrhoeae
atggataatcaagaaatcaacaacggccgccgccgtttcctgacacttgcgacctgcggcgcgggcggagtggcagcattgggtgtggcaacgccgtttgtggccagttttttcccttcggaaaaagccaaggcctccggtgctgccgtcgaggtggatgtcagtaaaatcgaagcgggtcagctgctgaccgccgagtggcaaggcaaaccgatttgggtgctcaaccgtacagatcagcagcttaaagacctgaaaggcctgaacggcgaacttaccgatcccaattccgatgcggaacagcagccggagtatgctaaaaacgagacccgttcgattaagccgaacatccttgtcgccatcggtatctgcacccatttgggctgctcgcccaccttccgtcccgacattgcccccgccgatttgggcgcagactggaagggcggcttcttctgcccgtgccacggttcgaaattcgacttggccggccgcgtatataaaggtgttcctgccccgaccaacctggttgtcccgccatataaatacttgagcgacacaactatcttggtgggcgaagac

SEQ ID NO: 674 - protein, 193 aa, Neisseria gonorrhoeae
MDNQEINNGRRRFLTLATCGAGGVAALGVATPFVASFFPSEKAKASGAAVEVDVSKIEAGQLLTAEWQGKPIWVLNRTDQQLKDLKGLNGELTDPNSDAEQQPEYAKNETRSIKPNILVAIGICTHLGCSPTFRPDIAPADLGADWKGGFFCPCHGSKFDLAGRVYKGVPAPTNLVVPPYKYLSDTTILVGED

SEQ ID NO: 675 - DNA, 708 bp, Neisseria gonorrhoeae
ttggtttgccataattatcgttccttattcttagtcttcgcccaccaagatagttgtgtcgctcaagtatttatatggcgggacaaccaggttggtcggggcaggaacacctttatatacgcggccggccaagtcgaatttcgaaccgtggcacgggcagaagaagccgcccttccagtctgcgcccaaatcggcgggggcaatgtcgggacggaaggtgggcgagcagcccaaatgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggaggccttggctttttccgaagggaaaaaactggccacaaacggcgttgccacacccaatgctgccactccgcccgcgccgcaggtcgcaagtgtcaggaaacggcggcggccgttgttgatttcttgattatccattattcagtcgtcctaatattttgggaatgccgagccattaaacattgcaattttacccagtttgcagtgatactcaaagcattatttaaaataagg

SEQ ID NO: 676 - protein, 236 aa, Neisseria gonorrhoeae
LVCHNYRSLFLVFAHQDSCVAQVFIWRDNQVGRGRNTFIYAAGQVEFRTVARAEEAALPVCAQIGGGNVGTEGGRAAQMGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRKCQETAAAVVDFLIIHYSVVLIFWECRAIKHCNFTQFAVILKALFKIR

SEQ ID NO: 677 - DNA, 1347 bp, Neisseria gonorrhoeae
atggcaaaccaaaccaatagcaaagcaaaagcattgttaggctggatggacgctcgcttccccctgtctaaaatgtggaatgagcatttggcgcaatactatgcgccgaaaaactttaatttttggtactatttcggctctttagccctgctcgtcctcgtgattcaaatcgtcagcggtattttcctgacgatgaactacaaaccggacggcaacctgaatgcctaccatctgcctgctgcctttaccgcagtagagtacatcatgcgcgacgtgtccggcggttggattatccgctacatgcactccaccggcgcatctttcttcttcattgttgtttatctgcacatgttccgtggtttgatttacggttcatataaaaaaccgcgcgaattggtgtggattttcggttctttgatcttcttggcattgatggcggaagcctttatgggctacctgctgccttggggtcagatgtccttttggggtgcgcaggtgattatcaacctgttctccgccattcccgtcatcggtcctgatttgtccacttggattcgcggcgacttcaacgtttccgacgttaccctgaaccgcttcttcgccctgcacgttatcgccgtaccgctggtattgctcggtttagtcgtggcacacatcatcgcactgcacgaagtgggctctaacaaccccgacggtgtggaaatcaagaaaaacaaagatgaaaacggcattccgcgcgacggcatcccgttccacccttactacactgttaaagacatcctgggcgtcgttgtattcctgattgtcttctgtgccgtattgttctttgcccctgaaggcggcggctacttcctcgaagcgccgaacttcgatgcggcaaatgcgctgaaaacacccccgcacattgcgccggtatggtatttcacaccgttctacgccattttgcgtgcgattccttccttcttgggaacgcaggtttggggtgtaatcggtatgggcgcggcggtcgtgttgattgccctgctgccttggctggacaggggcgaggtgaaatccgtccgttaccgcggtccgattttcaaaaccgcattggtcttgttcatcatttcctttatcggtttgggtattttgggcgcgatggtggcaaccgatacgcgtactttggtcgcgcgcatcctgtccttcgtctatttcgcattcttcctgggtatgccgttctataccaagctggataaaaacaaaccggttcccgaacgcgtaaccatgagcaccgccaaacaaaaaatcatgttctttgtttacgtcggcattactgccgtgggtgcttacctgtttgcaaccaacatc

SEQ ID NO: 678 - protein, 449 aa, Neisseria gonorrhoeae
MANQTNSKAKALLGWMDARFPLSKMWNEHLAQYYAPKNFNFWYYFGSLALLVLVIQIVSGIFLTMNYKPDGNLNAYHLPAAFTAVEYIMRDVSGGWIIRYMHSTGASFFFIVVYLHMFRGLIYGSYKKPRELVWIFGSLIFLALMAEAFMGYLLPWGQMSFWGAQVIINLFSAIPVIGPDLSTWIRGDFNVSDVTLNRFFALHVIAVPLVLLGLVVAHIIALHEVGSNNPDGVEIKKNKDENGIPRDGIPFHPYYTVKDILGVVVFLIVFCAVLFFAPEGGGYFLEAPNFDAANALKTPPHIAPVWYFTPFYAILRAIPSFLGTQVWGVIGMGAAVVLIALLPWLDRGEVKSVRYRGPIFKTALVLFIISFIGLGILGAMVATDTRTLVARILSFVYFAFFLGMPFYTKLDKNKPVPERVTMSTAKQKIMFFVYVGITAVGAYLFATNI

SEQ ID NO: 679 - DNA, 1131 bp, Neisseria gonorrhoeae
atgtatgccgccgacaccagaataatcgaaacggcaagcgcgcgcagcgcgtatttccgatgttttgccgaaagtgggaagacagccatattgttcctttttgacggcgtttgcgccgaatcctctataatatccgcccgatcctcatttgtcaggcatcaaacgatgaaactcaccctcgccctcccctcgctcaatttggatgaagacgaaatccgaatacctctatgcctgcccgccttcaacaaaatcctgcaatacggctcgccgcaccgccaaagctgcacggcttcggcattttacgcacgttatttgtggtgcggaagactggcacaacgcccggcgcaaagcctgaatatgccgtctgaaaccgtcgcgctcgccacgcccgtctggcaaaaaatggggctgcatcaggcaaatgtgctgacggcggaatatttggatgtcggtacggatgaagcggaacggctctgccgcgatctgtcggcgttttacggcgacattccgtggcgtttcgttcccgtcctgcccgaattatggctggtttcccttccccgcgcgtaccgctggggcgcgaagcccgttttggacttgggcggactgttgggcgcggacgatcagccggacggggaagacgcgttggaatggctgcgcgtccaaaccgaaatccaaatgtggctgaacgctcaccccgtcaaccacaaccgcaaaaaacgcgggctgcccgaattgaacggcttatggctttgggacagtctgcacggaagcgcacaaggcggcacgcttttcgccgatacggtttggagccgttttcacccgaaccgccgagcattgcccgacagcttccgagcttatgcggaaacggcggcacacctgcccgatacgcaccacatcctgtttatggacgatttgcgcctgaccgccctgacaggggacagggagcggtatgcggcaatattgcagcagtgggaagaacgctggttcgcaccgctttacgaagccgtccgcaccggcaaaatcaaacggctggacatcgccacggacggacaacacggcggtacgctgaccttcaaacccacagacaggcggaagttttggcgctgcacgaaaacctttgacggaatctgg

SEQ ID NO: 680 - protein, 377 aa, Neisseria gonorrhoeae
MYAADTRIIETASARSAYFRCFAESGKTAILFLFDGVCAESSIISARSSFVRHQTMKLTLALPSLNLDEDEIRIPLCLPAFNKILQYGSPHRQSCTASAFYARYLWCGRLAQRPAQSLNMPSETVALATPVWQKMGLHQANVLTAEYLDVGTDEAERLCRDLSAFYGDIPWRFVPVLPELWLVSLPRAYRWGAKPVLDLGGLLGADDQPDGEDALEWLRVQTEIQMWLNAHPVNHNRKKRGLPELNGLWLWDSLHGSAQGGTLFADTVWSRFHPNRRALPDSFRAYAETAAHLPDTHHILFMDDLRLTALTGDRERYAAILQQWEERWFAPLYEAVRTGKIKRLDIATDGQHGGTLTFKPTDRRKFWRCTKTFDGIW

SEQ ID NO: 681 - DNA, 429 bp, Neisseria gonorrhoeae
gtgttggaaatcaatcaggcaggattaagttggacgctgatgctgaagaagcggcaggcgtttcagacggcatttgaaggtttcgacatcgatacggtcgccgcatttggcgaagccgatattgaacggctgcttaccgatgcgggtattgtccgcaaccgtctgaaaatcgatgccgccattttcaatgcacggcaaatccaagcgttgcaacaagaacacggttcgttcaagaactggctcgacgcgcaccatccgcgaagcaaagacgaatgggtcaaactctttaaaaaacatttcaaattcgtcggcggcgaaatcgtcggcgaatttctgatgagtaccggctacctcaaaggcgcgcacgccgaaagctgtccggtttaccgtaaaaccctgaaataccacccgaaatggctcgatgccgtc

SEQ ID NO: 682 - protein, 143 aa, Neisseria gonorrhoeae
VLEINQAGLSWTLMLKKRQAFQTAFEGFDIDTVAAFGEADIERLLTDAGIVRNRLKIDAAIFNARQIQALQQEHGSFKNWLDAHHPRSKDEWVKLFKKHFKFVGGEIVGEFLMSTGYLKGAHAESCPVYRKTLKYHPKWLDAV

SEQ ID NO: 683 - DNA, 1719 bp, Neisseria gonorrhoeae
atgccgtctgaagccatctgtttaaagaaaaccatgctcaataaagaccaattcgcggacaaccatttcatccgcaccatcatcgaagacgacctcaaaagcggcaaacacgaagccgtccaaacccgttttccgcccgaacccaacggctatttacatatcggacacgccaaatccatctgcctgaacttcggtttggcgtatatttacgacggtttgtgcaacctgcgtttcgacgacaccaaccccgaaaaagaaaacgacgaatacgtcaacgccatcaaagaagatgtcgagtggctcggtttccattgggcgggcgagccgcgtttcgcttccgactatttcgaccggctttatgactacgccgtcggtttaatcaaagacggcaaagcgtatgtcgatgatttgacgcccgaagaaatgcgagaataccgcggtacgctgaccgaagcgggtaaaaacagcccttaccgcgaccgcagtatcgaagaaaacctcgacctgttcacgcgtatgaaaaacggcgagttccccgacggcagcaaaaccctgcgcctgaaaatcgacatggcggcaggcaacatcaatatgcgcgatcccgtcatctaccgcatccgccgcgcccatcaccataacaccggcgacaaatggtgcatctacccgatgtacgattacacgcattgcatttccgatgccatcgaaggcatcacgcattccttgtgcacgctcgaatttgaagcgcaccgtccgctttacgactgggtgttggacaacatccccgcgctgcacgccacccgtccgcgccaatacgagttttcccgtttggagcttttgtacaccattacctccaaacggaaattgaatcagttggttgtggaaaaacacgtttccggctgggatgatccgcgtatgccgaccatttccggtatgcgccgccgcggctacacgcccgaaggggtgcgcctgtttgccaaacgcgccggtatttccaaatctgaaaacatcgtcgacatgagcgtgttggagggtgcgattcgcgaagagctggaaaactccgccccgcgcctgatggcggttttgaacccgctcaaagtgaccctgaccaactttcaagccggcaaaacccaaagccgccgtgccgcgttccatccgaaccacgaagaaatgggcgatcgcgaagtacctgtttcacaaaccatctacatcgaagccgacgactttgccgaaaatccgcccaaaggcttcaagcgtctgattcccggcggcgaagtacgcttgcgccacggctatgtcatcaagtgcggtgaagtcgtcaaagacgaagcaggcaatgtggttgaactcaaatgcagcatcgaccacgacaccttgggcaaaaatccagaaggccgcaaagttaaaggcgtgattcactgggtttccgccgaacacgccgccgaaatcaaagtccgtctgtacgaccgcctctttaccgtcgagcgtcccggtgccgtgcgcggcgaagacggcgaatacctgccgtttaccgatttcctcaatccggaatccgttaaggaaatcactgcttacgccgaacctgccgcgaaagatttgccggcggaaagccgttggcagttcgagcgtatcggctattttgtgaccgaccgccaagaccacggcaaagacacgccggtgtttaaccgcacggtgacgttgaaagattcttggcagcctaag

SEQ ID NO: 684 - protein, 573 aa, Neisseria gonorrhoeae
MPSEAICLKKTMLNKDQFADNHFIRTIIEDDLKSGKHEAVQTRFPPEPNGYLHIGHAKSICLNFGLAYIYDGLCNLRFDDTNPEKENDEYVNAIKEDVEWLGFHWAGEPRFASDYFDRLYDYAVGLIKDGKAYVDDLTPEEMREYRGTLTEAGKNSPYRDRSIEENLDLFTRMKNGEFPDGSKTLRLKIDMAAGNINMRDPVIYRIRRAHHHNTGDKWCIYPMYDYTHCISDAIEGITHSLCTLEFEAHRPLYDWVLDNIPALHATRPRQYEFSRLELLYTITSKRKLNQLVVEKHVSGWDDPRMPTISGMRRRGYTPEGVRLFAKRAGISKSENIVDMSVLEGAIREELENSAPRLMAVLNPLKVTLTNFQAGKTQSRRAAFHPNHEEMGDREVPVSQTIYIEADDFAENPPKGFKRLIPGGEVRLRHGYVIKCGEVVKDEAGNVVELKCSIDHDTLGKNPEGRKVKGVIHWVSAEHAAEIKVRLYDRLFTVERPGAVRGEDGEYLPFTDFLNPESVKEITAYAEPAAKDLPAESRWQFERIGYFVTDRQDHGKDTPVFNRTVTLKDSWQPK

SEQ ID NO: 685 - DNA, 354 bp, Neisseria gonorrhoeae
ttgctgcaaacccccaagctgcgcgtcatcgccgtccataacgacagcggttcgccggcattctgccgcgtcatttggcacggacacattgccgaaattaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgactttccctgcgccgatttgggcaaaccccgttcgaaaacacggtatgaccctgccgcaaaattggacggaacagcttaaaaagctgctt

SEQ ID NO: 686 - protein, 118 aa, Neisseria gonorrhoeae
LLQTPKLRVIAVHNDSGSPAFCRVIWHGHIAEITDLSAAERGELMEMVYKVEAAMRQVFRPAKINLASLGNVVPHLHWHIIARFENDATFPAPIWANPVRKHGMTLPQNWTEQLKKLL

SEQ ID NO: 687 - DNA, 447 bp, Neisseria gonorrhoeae
atgactgataatcgggggtttacactggttgaattaatatcagtggtcttgatattgtctgtacttgctttaattgtttatccgagctatcgcaattatgttgagaaagcaaagataaatgcagtgcgggcagccttgttagaaaatgcacattttatggaaaagttttatctgcagaatgggagatttaaacaaacatctaccaaatggccaagtttgccgattaaagaggcagaaggcttttgtatccgtttgaatggaatcgcgcgcggggctttagacagtaaattcatgttgaaggcggtagccatagataaagataaaaatccttttattattaagatgaatgaaaatctagtaacctttatttgcaagaagtccgccagttcgtgtagtgacgggctggattattttaaaggaaatgataaggactgcaagttacttaag

SEQ ID NO: 688 - protein, 149 aa, Neisseria gonorrhoeae
MTDNRGFTLVELISVVLILSVLALIVYPSYRNYVEKAKINAVRAALLENAHFMEKFYLQNGRFKQTSTKWPSLPIKEAEGFCIRLNGIARGALDSKFMLKAVAIDKDKNPFIIKMNENLVTFICKKSASSCSDGLDYFKGNDKDCKLLK

SEQ ID NO: 689 - DNA, 801 bp, Neisseria gonorrhoeae
atgagggcagtcgaaatgaaacaagctatgaagaattggtttgctgccttgctgtcggcagtacccatgagtgcggcatttgcttcgggcggtcatgcacactatgagaaagtcgatattgatttgcgcgaccaagtaagcttgcagcgcggcgcacaaatctttaccaactactgtttgtcctgccactcggcaagcggtatgcgtttcaaccgtttgaaagacatcggtctgactgatgaagaaatcaagaaaaacctgatgtttaccaccgataatgtcggcgatgtcatgcattcggcgatgaacccgaaagatgcggcaaaatggtttggtgctgctccgcccgatttgacattgattgcgcgttccaaaggtgcagactacctttacgcttatatgcgcggcttctataaagatccgacccgtccgagcggctggaacaatactgtattcgataaagtcggtatgccccacccgttgtgggaacagcaaggcgttcaagccgttgagttggatgccaaaggtcagccggttatggtaaaagacgaacacggcgagatgaagcctaagctgtattgggaatctaccggtttgcacagccgccgtctgcctaacggcaaagtgatccagaaagagtacgacgcatatgtacgcgatttggtcaattaccttgtgtacatgggcgaacctgcacaactgcaacgcaaacgtataggctatgtcgtgatgattttcctatttgcggttatgctgcctttggcgtatttcctgaaaaaagaatattggaaagacgtacac

SEQ ID NO: 690 - protein, 267 aa, Neisseria gonorrhoeae
MRAVEMKQAMKNWFAALLSAVPMSAAFASGGHAHYEKVDIDLRDQVSLQRGAQIFTNYCLSCHSASGMRFNRLKDIGLTDEEIKKNLMFTTDNVGDVMHSAMNPKDAAKWFGAAPPDLTLIARSKGADYLYAYMRGFYKDPTRPSGWNNTVFDKVGMPHPLWEQQGVQAVELDAKGQPVMVKDEHGEMKPKLYWESTGLHSRRLPNGKVIQKEYDAYVRDLVNYLVYMGEPAQLQRKRIGYVVMIFLFAVMLPLAYFLKKEYWKDVH

SEQ ID NO: 691 - DNA, 156 bp, Neisseria gonorrhoeae
ttgaatattaggatgattgatggagctgatgactgttttgctgcctttggcggcgttggtgtcgggcgtgttgtttacatggttgctgatgaagggcaggtttcagggcgagtttgccggtttgaacgcgcaattggcggaaaaggcggcaagatg

SEQ ID NO: 692 - protein, 52 aa, Neisseria gonorrhoeae
LNIRMIDGADDCFAAFGGVGVGRVVYMVADEGQVSGRVCRFERAIGGKGGKM

SEQ ID NO: 693 - DNA, 1674 bp, Neisseria gonorrhoeae
ttggcggaaaaggcggcaagatgtgattttattgaacaggcacacgcagaaattgcatcagaattggccgctttggatgggaaatacgagcatttgcaggacgaaaattatgctttgagcaaccgtttttccgcagccgaaaagcagattgcccatttgcaggaaaaagaggcggaatcggttcggttgaagcagtcgtatatcgatttgcaggaaaaggcgcagggtttggcggttgaaaacgaacgtttggcaacgcagctcgggcaggaacggaaggcgtttgccgagcaatatgcgctggaacgccaaatccgccaaagagtcgaaaccgatttggaagaaagccgccaaactgtccgcgacgtgcaaaacgacctttccgatgtcggcaaccgttttgccgcagccgaaaaacagattgcctatttgcaggaaaaagaggcggaagcggagcggttgaggcagtcgcataccgagttgcaggaaaaggcgcagggtttggcggttgaaaacgaacgtttggcaacgcaaatcgaacaggaacgccttgcttctgaagaaaagctgtccttgctgggcgaggcgcgcaaaagcttgagcgatcagtttcaaaatcttgccaacacgattttggaagaaaaaagccgccgttttaccgagcagaaccgcgagcagctccatcaggttttgaacccgttgaacgaacgcatccacggtttcggcgagttggtcaggcaaacttatgataaagaatcgcgcgagcggctgactttggaaaacgaattgaaacggctccaagggttgaatgcgcagctgcacagcgaggcaaaggccctgaccaacgcgctgaccggcacgcagaacaaggttcagggcaattggggcgagatgattctggaaacggttttggaaaattccggccttcagaaagggcgggaatatgtggttcaggcggcatccgtccgaaaagaggaagacggcggcacgcgccgcctccagcccgacgttttggtcaacctgcccgacaacaagcagattgtcattgattccaaggtttcgctgacggcttatgtgcgctacacgcaggcggcggatgcggatgaggcggcacgcgaactggcggcgtatatcgccagcatacgcgcgcatatgaaaggcttgtcgctgaaggattacaccgatttggaaggtgtgaacacattggatttcgtctttatgtttatccctgtcgaaccggcctacctgctggcgttgcagaatgacgcgggcttgttccaagagtgtttcgacaaacggattatgctggtcggccccagtacgctgctggcgactttgcggacggtggcgaatatttggcgcaacgagcagcaaaaccaaaacgcgctggcgattgcggacgaaggcggcaagctgtacgacaagtttgtcggcttcgtacagacgctcgaaagcgtcggcaaaggcatcgatcaggcgcaaaacagctttcagacggcattcaagcaacttgccgagggacgcgggaatctggtcggacgcgccgagaaactgcgtctgttgggcgtgaaggcaggcaaacagcttcaacgggatttggtcgagcgtgccaacgaacagacggcatttgctttgggcaaaccttcggaacaggaagcggctgacgaagccgaa

SEQ ID NO: 694 - protein, 558 aa, Neisseria gonorrhoeae
LAEKAARCDFIEQAHAEIASELAALDGKYEHLQDENYALSNRFSAAEKQIAHLQEKEAESVRLKQSYIDLQEKAQGLAVENERLATQLGQERKAFAEQYALERQIRQRVETDLEESRQTVRDVQNDLSDVGNRFAAAEKQIAYLQEKEAEAERLRQSHTELQEKAQGLAVENERLATQIEQERLASEEKLSLLGEARKSLSDQFQNLANTILEEKSRRFTEQNREQLHQVLNPLNERIHGFGELVRQTYDKESRERLTLENELKRLQGLNAQLHSEAKALTNALTGTQNKVQGNWGEMILETVLENSGLQKGREYVVQAASVRKEEDGGTRRLQPDVLVNLPDNKQIVIDSKVSLTAYVRYTQAADADEAARELAAYIASIRAHMKGLSLKDYTDLEGVNTLDFVFMFIPVEPAYLLALQNDAGLFQECFDKRIMLVGPSTLLATLRTVANIWRNEQQNQNALAIADEGGKLYDKFVGFVQTLESVGKGIDQAQNSFQTAFKQLAEGRGNLVGRAEKLRLLGVKAGKQLQRDLVERANEQTAFALGKPSEQEAADEAE

SEQ ID NO: 695 - DNA, 1644 bp, Neisseria gonorrhoeae
atgccgtctgaaacgcatccgcctttcctattcggcttcgtcagccgcttcctgttccgaaggtttgcccaaagcaaatgccgtctgttcgttggcacgctcgaccaaatcccgttgaagctgtttgcctgccttcacgcccaacagacgcagtttctcggcgcgtccgaccagattcccgcgtccctcggcaagttgcttgaatgccgtctgaaagctgttttgcgcctgatcgatgcctttgccgacgctttcgagcgtctgtacgaagccgacaaacttgtcgtacagcttgccgccttcgtccgcaatcgccagcgcgttttggttttgctgctcgttgcgccaaatattcgccaccgtccgcaaagtcgccagcagcgtactggggccgaccagcataatccgtttgtcgaaacactcttggaacaagcccgcgtcattctgcaacgccagcaggtaggccggttcgacagggataaacataaagacgaaatccaatgtgttcacaccttccaaatcggtgtaatccttcagcgacaagcctttcatatgcgcgcgtatgctggcgatatacgccgccagttcgcgtgccgcctcatccgcatccgccgcctgcgtgtagcgcacataagccgtcagcgaaaccttggaatcaatgacaatctgcttgttgtcgggcaggttgaccaaaacgtcgggctggaggcggcgcgtgccgccgtcttcctcttttcggacggatgccgcctgaaccacatattcccgccctttctgaaggccggaattttccaaaaccgtttccagaatcatctcgccccaattgccctgaaccttgttctgcgtgccggtcagcgcgttggtcagggcctttgcctcgctgtgcagctgcgcattcaacccttggagccgtttcaattcgttttccaaagtcagccgctcgcgcgattctttatcataagtttgcctgaccaactcgccgaaaccgtggatgcgttcgttcaacgggttcaaaacctgatggagctgctcgcggttctgctcggtaaaacggcggcttttttcttccaaaatcgtgttggcaagattttgaaactgatcgctcaagcttttgcgcgcctcgcccagcaaggacagcttttcttcagaagcaaggcgttcctgttcgatttgcgttgccaaacgttcgttttcaaccgccaaaccctgcgccttttcctgcaactcggtatgcgactgcctcaaccgctccgcttccgcctctttttcctgcaaataggcaatctgtttttcggctgcggcaaaacggttgccgacatcggaaaggtcgttttgcacgtcgcggacagtttggcggctttcttccaaatcggtttcgactctttggcggatttggcgttccagcgcatattgctcggcaaacgccttccgttcctgcccgagctgcgttgccaaacgttcgttttcaaccgccaaaccctgcgccttttcctgcaaatcgatatacgactgcttcaaccgaaccgattccgcctctttttcctgcaaatgggcaatctgcttttcggctgcggaaaaacggttgctcaaagcataattttcgtcctgcaaatgctcgtatttcccatccaaagcggccaattc

SEQ ID NO: 696 - protein, 548 aa, Neisseria gonorrhoeae
MPSETHPPFLFGFVSRFLFRRFAQSKCRLFVGTLDQIPLKLFACLHAQQTQFLGASDQIPASLGKLLECRLKAVLRLIDAFADAFERLYEADKLVVQLAAFVRNRQRVLVLLLVAPNIRHRPQSRQQRTGADQHNPFVETLLEQARVILQRQQVGRFDRDKHKDEIQCVHTFQIGVILQRQAFHMRAYAGDIRRQFACRLIRIRRLRVAHISRQRNLGINDNLLVVGQVDQNVGLEAARAAVFLFSDGCRLNHIFPPFLKAGIFQNRFQNHLAPIALNLVLRAGQRVGQGLCLAVQLRIQPLEPFQFVFQSQPLARFFIISLPDQLAETVDAFVQRVQNLMELLAVLLGKTAAFFFQNRVGKILKLIAQAFARLAQQGQLFFRSKAFLFDLRCQTFVFNRQTLRLFLQLGMRLPQPLRFRLFFLQIGNLFFGCGKTVADIGKVVLHVADSLAAFFQIGFDSLADLAFQRILLGKRLPFLPELRCQTFVFNRQTLRLFLQIDIRLLQPNRFRLFFLQMGNLLFGCGKTVAQSIIFVLQMLVFPIQSGQF

SEQ ID NO: 697 - DNA, 630 bp, Neisseria gonorrhoeae
atgaccctacgttacgaaattctccccgttacccccttccgccaaaactgcaccctgatttgggacgacgaaagcggcgaagccgtcctgaccgatgtcggcggcgacgtgccgttcctgctgcaagcgttggcaaaccgcaaactcacgctcacggcaatctggctgacgcacggtcatctcgatcacgcgggcggcgtggtcgagatgctggaaacgcataaagtccccgtcctcggcccgcaccgcgaagatgaattcctgctccaatcgctgccgcaaaccaccgcgcaatacggattccccgtctcgcccgcctttgcgccgaaccgttggctcgaagaaggcgaaacgctcacggtcggacgctatgccttccaagtgctgcatattccggggcacacgcccggacacgtggttttctattgtgccgaagcggagctgctgattgcgggcgacgtgctgttttacgaaaccataggcaggaccgattttccgcgcggcaaccacgccgacttaatcaacaatatccgcaacaaattattcgccttccccgaaaccgtgcaagttgtcgccggacacgagcgtatgacttccatcggacacgaaaaacggcacaatccgtttttc

SEQ ID NO: 698 - protein, 210 aa, Neisseria gonorrhoeae
MTLRYEILPVTPFRQNCTLIWDDESGEAVLTDVGGDVPFLLQALANRKLTLTAIWLTHGHLDHAGGVVEMLETHKVPVLGPHREDEFLLQSLPQTTAQYGFPVSPAFAPNRWLEEGETLTVGRYAFQVLHIPGHTPGHVVFYCAEAELLIAGDVLFYETIGRTDFPRGNHADLINNIRNKLFAFPETVQVVAGHERMTSIGHEKRHNPFF

SEQ ID NO: 699 - DNA, 93 bp, Neisseria gonorrhoeae
gtgttcctaaaacggtttttcagacggcatcgggtttgccgtttgttttatggcggtttgccgcctgttttgatattgggggaatcaggtgat

SEQ ID NO: 700 - protein, 31 aa, Neisseria gonorrhoeae
VFLKRFFRRHRVCRLFYGGLPPVLILGESGD

SEQ ID NO: 701 - DNA, 495 bp, Neisseria gonorrhoeae
ttggcgtgggttcgggcggattttctgccgcaggcggtaagaagcaacgcgcctgcgccgaggaggaaggttcttctgttcattggtttttcagacggcatcgagccatttcgggtggtatttcagggttttacggtaaaccggacagctttcggcgtgcgcgcctttgaggtagccggtactcatcagaaattcgccgacgatttcgccgccgacgaatttgaaatgttttttaaagagtttgacccattcgtctttgcttcgcggatggtgcgcgtcgagccagttcttgaacgaaccgtgttcttgttgcaacgcttggatttgccgtgcattgaaaatggcggcatcgattttcagacggttgcggacaatacccgcatcggtaagcagccgttcaatatcggcttcgccaaatgcggcgaccgtatcgatgtcgaaaccttcaaatgccgtctgaaacgcctgccgcttcttcagcatcagcgtccaact

SEQ ID NO: 702 - protein, 165 aa, Neisseria gonorrhoeae
LAWVRADFLPQAVRSNAPAPRRKVLLFIGFSDGIEPFRVVFQGFTVNRTAFGVRAFEVAGTHQKFADDFAADEFEMFFKEFDPFVFASRMVRVEPVLERTVFLLQRLDLPCIENGGIDFQTVADNTRIGKQPFNIGFAKCGDRIDVETFKCRLKRLPLLQHQRPT

SEQ ID NO: 703 - DNA, 117 bp, Neisseria gonorrhoeae
ttgccgatgccgtctgaacgctatgtcaaagcgcgcaagtcgggtacaataaacacatcatcaaaccgcttcagacggcatacggaaccgccccaatgccgtctgaagccatctgtt

SEQ ID NO: 704 - protein, 39 aa, Neisseria gonorrhoeae
LPMPSERYVKARKSGTINTSSNRFRRHTEPPQCRLKPSV

SEQ ID NO: 705 - DNA, 822 bp, Neisseria gonorrhoeae
gtgattaagaagataatcggcggcatcataccgatttttacggcggttttcatccctgcatcggcaggcgcggcggatttgatgctggcgcaggaatacaaagggcaggacattgccggctgggcgatgagcgagaaactcgacggcgtgcgcgcctattgggacggaaagcacctgataagccgtcagggctacgcgtttacgccccccaaaggctttaccgcgcagtttccgccttatcctttggacggcgaattgtatagcgggcgcggtcagttcgagcagatttccgctaccgtgcgttctgtttcttcagactggcgcggcatccgcctgcacgttttcgatgtacccaaggcgcagggcaacctctaccaacgtttggcagtcgcaacgcagtggctgaaaacgcatccgaacgcgccgattaccatcatcccgcaaatcaaagtgcgcgaccggcggcacgcgatggactttttaaaacaaatcgaagtgcagggcggcgaaggcgtgatgctgcgccagcccgaatcccgttacagcggcggcaggagcagccaattattgaagctgaaaagccaatacgacgacgaatgcacggtaacgcggcactatgagggcaaagggcgaaacgccggacggctgggcgcggtcggctgcaaaaaccgacacggcgaattccgcatcggcagcggtttcaaggacaaagaccgcgacaatccgcccaaaatcggcacgctgattacctaccgttaccgtggctttacgcggaaaggcacgccgaaatttgccacatttgtgcgcgtgcgtaccgaccgc

SEQ ID NO: 706 - protein, 274 aa, Neisseria gonorrhoeae
VIKKIIGGIIPIFTAVFIPASAGAADLMLAQEYKGQDIAGWAMSEKLDGVRAYWDGKHLISRQGYAFTPPKGFTAQFPPYPLDGELYSGRGQFEQISATVRSVSSDWRGIRLHVFDVPKAQGNLYQRLAVATQWLKTHPNAPITIIPQIKVRDRRHAMDFLKQIEVQGGEGVMLRQPESRYSGGRSSQLLKLKSQYDDECTVTRHYEGKGRNAGRLGAVGCKNRHGEFRIGSGFKDKDRDNPPKIGTLITYRYRGFTRKGTPKFATFVRVRTDR

SEQ ID NO: 707 - DNA, 600 bp, Neisseria gonorrhoeae
ttggtttataattttccttttaccgaccgattccgacatatgaccgatttagaaaccaaacgccttgaaacacaggcgatgcttgaaaacgccgatcttttgttcgaccaaggccaatgccgtgccgcactgcaaaaagtggcggacgagattacgcgtgatttgggggataaatatccgttgctgctgcccgtgatgggcggcgcggtggtgtttacggggcagttgctgccgctgttgcgttttcccttagattttgattatgttcacgtttcccgttacggcgacaagctggagggcggcgcgttcaactggaagcgtatgcccgatgcggaacaaatccggggcaggcacgtggtcgtgttggacgatattttggacgaagggcatacgatgtccgccattcaagccaaacttttggaaatgggtgcggcaagctgccgtgcggcggtgttcgccaataaattaatcgacaaagaaaaaccggtcaaagccgattatgtcggactggatgtgccgaaccgttatgttttcggttacggcatggatgcggcaggctgctggcgcaatttgggcgagatttacgcattgggcggaaaa

SEQ ID NO: 708 - protein, 200 aa, Neisseria gonorrhoeae
LVYNFPFTDRFRHMTDLETKRLETQAMLENADLLFDQGQCRAALQKVADEITRDLGDKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKEKPVKADYVGLDVPNRYVFGYGMDAAGCWRNLGEIYALGGK

SEQ ID NO: 709 - DNA, 435 bp, Neisseria gonorrhoeae
atgatagggcttttaatcatcacacacgaaaccataggcgaagcctaccgcaagctggcgcatcatttttttccgggcgggctgcctgaaaacgtccgcatactcggcgtgcagccgacggaagaccaagacgacattatcaacaacgccatttccgcgctgcaagagtttcctgaaaaccacggtgtattgattatgaccgacatcttcggcgcgaccccctgcaatgccgcccgccggctcgtgcgcgaaaacaaatcggcgattttgaccgggctgaacgcgccgatgatgattaaggccgtccaatattcgccggcggcggaagaccttgccgcctttaccgaatgcgtcagagaggcggcggtaaaaggcattttcgccatcacgtccgcgcccgaagatttggtgtgccggcgcagcggcgatgccgtc

SEQ ID NO: 710 - protein, 145 aa, Neisseria gonorrhoeae
MIGLLIITHETIGEAYRKLAHHFFPGGLPENVRILGVQPTEDQDDIINNAISALQEFPENHGVLIMTDIFGATPCNAARRLVRENKSAILTGLNAPMMIKAVQYSPAAEDLAAFTECVREAAVKGIFAITSAPEDLVCRRSGDAV

SEQ ID NO: 711 - DNA, 447 bp, Neisseria gonorrhoeae
atgttttcctgccctgccgcttcttcagacggcatcgccgctgcgccggcacaccaaatcttcgggcgcggacgtgatggcgaaaatgccttttaccgccgcctctctgacgcattcggtaaaggcggcaaggtcttccgccgccggcgaatattggacggccttaatcatcatcggcgcgttcagcccggtcaaaatcgccgatttgttttcgcgcacgagccggcgggcggcattgcagggggtcgcgccgaagatgtcggtcataatcaatacaccgtggttttcaggaaactcttgcagcgcggaaatggcgttgttgataatgtcgtcttggtcttccgtcggctgcacgccgagtatgcggacgttttcaggcagcccgcccggaaaaaaatgatgcgccagcttgcggtaggcttcgcctatggtttcgtgtgtgatgat

SEQ ID NO: 712 - protein, 149 aa, Neisseria gonorrhoeae
MFSCPAASSDGIAAAPAHQIFGRGRDGENAFYRRLSDAFGKGGKVFRRRRILDGLNHHRRVQPGQNRRFVFAHEPAGGIAGGRAEDVGHNQYTVVFRKLLQRGNGVVDNVVLVFRRLHAEYADVFRQPARKKMMRQLAVGFAYGFVCDD

SEQ ID NO: 713 - DNA, 195 bp, Neisseria gonorrhoeae
gtggagtccgagtttgttgatgatttcgatggattgtttgagcatttcggttcccgtgttatgtatagtggattaacaaaaaccagtacggcgttgccccgccttggctcaaagggaacgattctccaaggtgctgaagcaccgggcgaaccggttccgtactatccgtactgtctgcggctcgccgccttgtcc

SEQ ID NO: 714 - protein, 65 aa, Neisseria gonorrhoeae
VESEFVDDFDGLFEHFGSRVMYSGLTKTSTALPRLGSKGTILQGAEAPGEPVPYYPYCLRLAALS

SEQ ID NO: 715 - DNA, 126 bp, Neisseria gonorrhoeae
atggggctgatgatgctcgcagccgccaagggtacggtcatcgaactggaaaccgacggcttggacgaagccgcagccatgaaggcattgaccgacttaatcaacgactacttcggcgagggcgaa

SEQ ID NO: 716 - protein, 42 aa, Neisseria gonorrhoeae
MGLMMLAAAKGTVIELETDGLDEAAAMKALTDLINDYFGEGE

SEQ ID NO: 717 - DNA, 1773 bp, Neisseria gonorrhoeae
atgagtatcgtgctgcacggcgtggcggcgggcaaaggcattgccgtcggttgcgcccacctgattgcgcgcggtacggaggaagtgccgcagtatgatgttgctcaggcggacaccgatgccgaagccgaacgtttcgatgccgccgtcaaagccacgcgcaaagagttggaacagctccgcagcgcgattcccgaaaacgccccgaccgagttgggcgcgttcatctcgctgcacctgatgctcttgaccgatgttaccttgtcgcgcgaacccgtcgatattttaagggaacaaaaaatcaacgccgagtgggcattgaagcagcagagcgacaaactcgccgcccaattcgacaatatggacgatgcctatttgcgcgaacgcaagcaggatatgctgcaagtcgtccgccgcatccacaacaacctgatcgggcagggcaacgagttggaggttgccgacaacctgtttgacgaaaccgttctgattgcaaacgacctttcacccgccgacacggttttgtttaaagagcagcgcattgccgccttcgttaccgatgccggcggccccaccgggcatacggcgattttgggcaggagcttggacatcccgtccgtcgtcgggctgcacaacgcgcgcaaactgattaccgaaggcgaaacggtcatcgtggacggcatcaacggcgtgttgattatttcgccggatgagtcggtgttgaacgaataccgccgccgcgcccgcgaataccgcagccacaaacgcgatttgaacaagctcaaaaaaaccgccgccgccaccgccgacggggtctgcatcgagcttgtgggcaatatagaatccgccgaagacgtgaaaccgctgcacaacctcggcgcagacggcatcgggctgttccgcagcgagtttctttacctgaaccgcgatacgatgccgtctgaagacgagcagtacgaagtgtacagcgcgattgtcaaaaaaatgaagggcaaaagcgtaacgatacggacagtcgatttgggtgtggacaaaaatccgcgctggttcgggaaaaacagcacgcccaacggcagcctcaaccccgcgctgggcatgaccggcatccgcctgtgccttgccgaaccggtcatgttccgcacgcagatgcgcgccatcctccgtgcggcggtacacggccccgtccgcatgatgtggccgatgattacctccgtatccgaagtgcgccagtgcctcatccacctcgacaccgcgcaacgccagcttgccgaacgcggcgatgccttcggcgaagtcggcatcggctgcatgattgaaattccgtctgccgcgctgaccgtcggcagtattttgaaactggtcgatttcatctccgtcggtaccaacgatttgatccaatatattctgtccgtcgatcgcggcgacgacagcgtcagccatctctaccaacccggacatccttccgtgctgaaaatgctgcaacacgtcatccgtaccgccaaccgcatggacaaagacgtgtccgtatgcggcgagatggcgggcgataccgcgtttacccgcgttttattgggtatggggctgcgccgtttttccatgaatccgaacaacatcctgcccgtcaaaaacatcattctgcacagcaatgccggacagctcgaaggcgatattgcgaaagtcatccgctgcgaagacgaagagaagtcggaaaagctgatcaaacagatcaacagcgtgtctgtcgcggaagaagccgaagtcaagggacggaaa

SEQ ID NO: 718 - protein, 591 aa, Neisseria gonorrhoeae
MSIVLHGVAAGKGIAVGCAHLIARGTEEVPQYDVAQADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIISPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGEVGIGCMIEIPSAALTVGSILKLVDFISVGTNDLIQYILSVDRGDDSVSHLYQPGHPSVLKMLQHVIRTANRMDKDVSVCGEMAGDTAFTRVLLGMGLRRFSMNPNNILPVKNIILHSNAGQLEGDIAKVIRCEDEEKSEKLIKQINSVSVAEEAEVKGRK

SEQ ID NO: 719 - DNA, 771 bp, Neisseria gonorrhoeae
atgaaaccgaaaatccaaaggcatggagagattttaagccttgtccgccggcatcagtttatgtcggtggacgagcttgccgccgcattggacgttaccccgcagacgatacgttgcgacatccgcgagttggaggagggtggcagcctgaaacgccatcacggcggcgcatcttcgggcggaaacttgccggagggtctgcccgccgaccgccaaacccggtgtcaaaacgaaaaaaacgccattgcccggctgattgcggaacacatccccgacggttcgtcgctgttcgtcagtatcggtacgaccatggaagccgcggcatcagagctggtgaagcggcgcagcagcctgcggattattaccaacaatatccacgtcgcctccgtcgtttcggcacgtacggattacacggtcatcatcacatccggcgtcgtccgccctttggacggcggtattaccggcgtggcgaccgtcgactttatcaaccagttcaaagtcgattatgccgtgatgagcacgcacggcgtggaaagcgacggttcgcttttggattacgattacaaggaagtcagcgtcatgcaggcgatgattgccaacgcgcgcgtccgttttctcggcgtggatcacagcaaattccgcagcaacgcgctggtcaggctcggcggcattacggcgtttgacaaagtatttaccgacaggttgcctgataccgcgatgcagaagatgctgaaagaggcgggggtggaatgcctgattgccgatgccgtc

SEQ ID NO: 720 - protein, 257 aa, Neisseria gonorrhoeae
MKPKIQRHGEILSLVRRHQFMSVDELAAALDVTPQTIRCDIRELEEGGSLKRHHGGASSGGNLPEGLPADRQTRCQNEKNAIARLIAEHIPDGSSLFVSIGTTMEAAASELVKRRSSLRIITNNIHVASVVSARTDYTVIITSGVVRPLDGGITGVATVDFINQFKVDYAVMSTHGVESDGSLLDYDYKEVSVMQAMIANARVRFLGVDHSKFRSNALVRLGGITAFDKVFTDRLPDTAMQKMLKEAGVECLIADAV

SEQ ID NO: 721 - DNA, 972 bp, Neisseria gonorrhoeae
gtggctggacggcatacgtttataggatgcgccatgcttgaactgaacggactctgcaaatgcttcggcggcaaaacggtcgccgacaacatctgcctgactgtcgggcgcggcaaaatactcgccgtactggggcggtcgggctgcggcaaatccaccctgctgaatatgattgcgggcatcgtccggccggacggcggcgaaattcggctgaacggggaaaacattacctgtatgccgcccgaaaaacgccgtatctcgctgatgtttcaagattacgcgctgtttccccatatgagtgcgctggaaaatacggcattcggtttgaaaatgcaaaaaatgccgaaagccgaagccgaacgcctcgccttgtcggcacttgccgaagtcgggctggaaaacgaggcgcaccgcaagcctgaaaaactttccggaggcgagaagcaacggttggcactggcgcgcgctttggttgtccgcccttccctgctgttgctggatgaatcgttttccagtttggacacgcatttgcgcgaccggctgcgccgtatgaccgccgaacgcatccgcaagggcggcatccctgccgttttggtaacgcattcgcccgaagaggcctgcacggcggcggacgaaatcgccgtcatgcacgaggggaaaatccttcaatgcggtacgcccgaaaccttgattcaaacgcctgccggcgtgcaggtcgcccgtctgatggggctgcccaataccgacgatgaccgccatattccgcaaaatgccgtgtgcttggacaatcatggaacggaatgccgtctgctgtccctcgtccgcctgcccgactcgctccggctttccgccgtccatcccgaacacggcgagctgaccttaaacctgactgtcggacaacatacggacggtatttccggaaacggtacggtccgcatccgcgtcgatgaagggcgtatcgtccgtttccga

SEQ ID NO: 722 - protein, 324 aa, Neisseria gonorrhoeae
VAGRHTFIGCAMLELNGLCKCFGGKTVADNICLTVGRGKILAVLGRSGCGKSTLLNMIAGIVRPDGGEIRLNGENITCMPPEKRRISLMFQDYALFPHMSALENTAFGLKMQKMPKAEAERLALSALAEVGLENEAHRKPEKLSGGEKQRLALARALVVRPSLLLLDESFSSLDTHLRDRLRRMTAERIRKGGIPAVLVTHSPEEACTAADEIAVMHEGKILQCGTPETLIQTPAGVQVARLMGLPNTDDDRHIPQNAVCLDNHGTECRLLSLVRLPDSLRLSAVHPEHGELTLNLTVGQHTDGISGNGTVRIRVDEGRIVRFR

SEQ ID NO: 723 - DNA, 1116 bp, Neisseria gonorrhoeae
atggtagctcgtcgggctcataacccgaaggtcgtaggttcgaatcctgctcccgcaaccaaatatcaaacccctcggttcaatgccgagggggttttgtttttcctgtttcctgccgcctccgttttttgccggattttccttcctgccgcaatatcggaacggcaggccgccgtctgtttgcggttgcaaattcaggcggtttggctacaatcttccgcattgtgttcaagaaagccggctatgccgaccgtccgttttaccgaatccgtcagcaaacaagaccttgatgccctgttcgagcgggcaaaagcaagttacggtgccgaaagttgctggaaaacgctgtatctgaaccgtcttcctttgggcaatctgtcgccggaatgggctgagcgcatcaaaaaagactgggaggcaggctgctccgagtcttcagacggcatttttctgaatgcggacggctggccggatatgggcggacgcttgcagcacctcgcccgcacatggaacaaggcggggctgcttcacggatggcgcaacgagtgtttcgacctgaccgacggcggcggcaaccccttgttcacgctcgaacgcgccgctttccgtccgttcggactactcagccgcgccgtccatctcaacggtttggtcgaatcgaacggcagatggcatttttggataggcaggcgcagtccgcacaaagcagtcgatcccggcaagctcgacaatattgccggcggcggtgtttccggcggcgaaatgccgtctgaagccgtgtgccgcgaaagcagcgaagaagccggtttggataaaacgctgtttccgctcatccgcccagtatcgcggctgcacagccttcgccccgtcagccgaggtgtgcacaatgaaatcctgtatgtgttcgatgccgtcctgcccgaaaccttcctgcctgaaaatcaggatggcgaggtagcgggttttgaaaagatggacattggcggcctattggatgccatgttgtcgaaaaacatgatgcacgacgcgcaactggttacgctggacgcgttttaccgttacggtctgattgatgccgcccatccgctgtccgagtggctggacggcatacgttta

SEQ ID NO: 724 - protein, 372 aa, Neisseria gonorrhoeae
MVARRAHNPKVVGSNPAPATKYQTPRFNAEGVLFFLFPAASVFCRIFLPAAISERQAAVCLRLQIQAVWLQSSALCSRKPAMPTVRFTESVSKQDLDALFERAKASYGAESCWKTLYLNRLPLGNLSPEWAERIKKDWEAGCSESSDGIFLNADGWPDMGGRLQHLARTWNKAGLLHGWRNECFDLTDGGGNPLFTLERAAFRPFGLLSRAVHLNGLVESNGRWHFWIGRRSPHKAVDPGKLDNIAGGGVSGGEMPSEAVCRESSEEAGLDKTLFPLIRPVSRLHSLRPVSRGVHNEILYVFDAVLPETFLPENQDGEVAGFEKMDIGGLLDAMLSKNMMHDAQLVTLDAFYRYGLIDAAHPLSEWLDGIRL

SEQ ID NO: 725 - DNA, 90 bp, Neisseria gonorrhoeae
ttgcgttttcagacggcatttgaaaaccaatgccgtctgaaagacagaatccgtgaaaactccccacgcaggtattatcccgatcgggtg

SEQ ID NO: 726 - protein, 30 aa, Neisseria gonorrhoeae
LRFQTAFENQCRLKDRIRENSPRRYYPDRV

SEQ ID NO: 727 - DNA, 171 bp, Neisseria gonorrhoeae
ttggttaacatcgaaacaggggtgctgcctgatgttcaggcggctgagaaataccctttacacccgatcgggataatacctgcgtggggagttttcacggattctgtctttcagacggcattggttttcaaatgccgtctgaaaacgcaaaacgctcctgtttctttattc

SEQ ID NO: 728 - protein, 57 aa, Neisseria gonorrhoeae
LVNIETGVLPDVQAAEKYPLHPIGIIPAWGVFTDSVFQTALVFKCRLKTQNAPVSLF

SEQ ID NO: 729 - DNA, 1899 bp, Neisseria gonorrhoeae
atgactacgccaaaaaaaaccgccaaaatttccggcaacgaagcgcgcgaactttccgacttgagcgaagacatcggcatccgcttcaaatatcagaactccgaacgcgtgtatctgcaaggcagccgcgacgacatccgcgtgcctttgcgcgaaatccgtcaggacgacacctacacggcgcaaggtacggaagccaacccgcctattccggtgtacgacaccagcggcgcatacggcgatccggcggcgcacatcgacctgaaacaaggcctgccgcacatccgcacggcgtggctggacgaacgcggcgataccgaaatcctgcccaagctctccagcgaatacggcatcgaacgtgcgcacgatccgaaaaccgcccatctgcgcttcaaccaaatcacccgcccgcgccgtgccaaagccggccgcaatgtaacccagctccattacgcccgccaaggcattatcacgcccgaaatggagttcgccgccatacgcgaacgcatgaagctggacgagcttttcagacggcctgaatacgccaagctcttgaaacagcacacagggcaaagtttcggtgcgaacatcccgacccgtcccgaccaaatcacccccgaattcgtgcgccaagaaatcgccgccggacgcgcgattatccccgccaacatcaaccaccccgaactcgaaccgatgattatcggccgcaacttccgcgtcaaaatcaacggcaacttgggcaattccgccgtaacctccagcctgaccgaagaagtcgaaaaaatggtgtggtcgctgcgttggggcgcggacacgattatggacttatccacaggcgcgcacatccacgaaacgcgcgaatggattatccgcaacgcgcccgtccccatcggcacagtgccgatttaccaaactttggaaaaaaccggcggcatcgccgaagatttgacttgggatttgttccgcgacaccttaatcgagcaggcggaacaaggcgtggactatttcaccatacacgcgggcgtgttgctgcgttatgtgccgatgaccgccaaccgcctcaccggcatcgtatcgcgcggcggttcgattatggcgaaatggtgtttggcacatcatcgggaaaacttcctctacacgcatttcgacgaaatctgcgaaatcatgaaggcgtatgacgtatcgttcagcttgggcgacggcctgcgccccggctgcattgccgatgccaacgacgaatcccaattcgccgaattgcacaccttgggcgaattgaccgataaagcgtggaaacacgacgtacaagtcatgatcgaaggccccggccatgtgccgctgcaacgcgtcaaagaaaatatgaccgaagagttgcaacactgctttgaagcaccgttttacacactcggcccgctcgttaccgacatcgcccccggctacgaccacatcacttcgggcataggcgcggccaatatcggctggtacggcacggcgatgctttgttacgttacccccaaagaacatttggggctgcccgacaaagaagacgtgcgcaccggcatcatcacctacaaactcgccgcccacgccgccgacctcgccaaaggctggccgggcgcgcaattacgcgacaacgccctgagcaaggcgcgtttcgaattccgctggcgcgaccaattccgcttaagcctcgaccccgaacgcgccgagagcttccacgacgaaaccctgcccgccgaaggcgcgaaaatcgcccatttttgctcaatgtgcggccccaaattttgctcgatgaaaatcacgcaggaagtgcgcgactacgccgacaagcaaaaagcccaacggcagggtatggaggaaaaagcggtcgagttcgtcaaaaaaggcgcgaagatttacagt

SEQ ID NO: 730 - protein, 633 aa, Neisseria gonorrhoeae
MTTPKKTAKISGNEARELSDLSEDIGIRFKYQNSERVYLQGSRDDIRVPLREIRQDDTYTAQGTEANPPIPVYDTSGAYGDPAAHIDLKQGLPHIRTAWLDERGDTEILPKLSSEYGIERAHDPKTAHLRFNQITRPRRAKAGRNVTQLHYARQGIITPEMEFAAIRERMKLDELFRRPEYAKLLKQHTGQSFGANIPTRPDQITPEFVRQEIAAGRAIIPANINHPELEPMIIGRNFRVKINGNLGNSAVTSSLTEEVEKMVWSLRWGADTIMDLSTGAHIHETREWIIRNAPVPIGTVPIYQTLEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 731 - DNA, 585 bp, Neisseria gonorrhoeae
ttgcttcttaccgcctgcggcagaaaatccgcccgaacccacgccaaaattcccgaaggaagcaccgtgcttgccttgggcgattcgctcaccttcggctacggagcaaaccccggcgaatcctaccccgcgcaactgcaaaaactgacgggttggaatattgtcaacggcggcgtatcgggcgatacgtccgcgcaagccctatcgcgcctgcccgcgctgttggcacgcaaacccaagcttgtgattgtcggcataggcggcaacgactttctgcgcaaagttcccgaggagcagacccgcgccaatatcgcgaaaatcatcgaaaccgtgcaaaaggaaaacattcccgccgtcctcgtcggcgtgccgcacatcacactgggcgcgttgttcgggcatttgagcgaccatccgctgtatgaggatttgtccgaggaatacggcattccgttgttcggcggcgcgtgggcggaaattttgggcaataataatctgaaatccgaccaaatccacgccaacggcaaaggctatcggaaattcgccgaaaatttgaatcaatttttgagaaaacatgggtttaga

SEQ ID NO: 732 - protein, 195 aa, Neisseria gonorrhoeae
LLLTACGRKSARTHAKIPEGSTVLALGDSLTFGYGANPGESYPAQLQKLTGWNIVNGGVSGDTSAQALSRLPALLARKPKLVIVGIGGNDFLRKVPEEQTRANIAKIIETVQKENIPAVLVGVPHITLGALFGHLSDHPLYEDLSEEYGIPLFGGAWAEILGNNNLKSDQIHANGKGYRKFAENLNQFLRKHGFR

SEQ ID NO: 733 - DNA, 1473 bp, Neisseria gonorrhoeae
gaacgttttgttaaactcgacaaacgccctgtttttctcgtattcgttaaacacatcgttgctccacgtttcgcggtgcgacagcgtcaggcgcggcgtgatgcctttgaaatgcaatgcccggtgccaaaggctcaaggatgtgtccgattctttatccctgcgcctttcccctttaaaactgctgaagaagccgggtttttcataatgccgtttcgccacgccgaggcggaacagcgaagacaggccgctgccgccccattcctgcccccaggcaaagcgcaggccgtaacggttgaaattgtcgccacggtcggcggggttgcgctcgcggtaaaaatccaaaccgcccgtccaatattggcgcgcattccggtaaaacaccagcgaattggaaatttgcaaatgggtattgtcggaacgcgcccggcgcgtattcttcaaacgcccccactccgccgaagacagcgtttgccatctcggggtttgccaacggttgaaataaaggcgtgcgccgttggcgtaagaataagcgtcgttgccgtaggtgcggcgttcgtggaacactgccagcccgacatctttacgccggtcggcaaaaccgatgccgccggaaacacctgccgtcatatcgttgaatttcttattccccggataaaccctgccggacacgtcgccgcccgccgtcgtgtaccagccgtttttcagcgaccattttttctccgcgccgaaccggtaattgactgccgtgccgtccacctgtttcgggaaagtccaattgccgtactgctgctgtttcggggcttggttgatattgtgttcgcgggtaacgctgaaaccgccgtttaccttccacgcatcgcgttcgcgcaatgccttgcggtacagctcgacctgctccataagctgcggcggcagatcttctgttttcaggcggtcgaactggtctgccgccgcctcgttctgcctgtcttcaaacaatgccgccgccaaacgcatacggacggcgggcgcgtcgggttgggcggcaatcaattcccggtaatgggaaaccgcctccttcaccctgccctctgcctgcgccaaaatcccttgtgcataaagtgccaacatcttatcctgccgcgcctgttgtaggtaaatcggcaaaatcacgcggataccggcaatattgtttgagaccactgcggaatacatggcacgcgacaacaattcgggatttttcagcagggtttcgccgtcaacctgcaaaacttttcctttttcccgcacctgccccggtaccttctccctgtcgatcggtttgacctccgcttcatgaagcctgaactcgggacggcttctcaaatccggttcgcacggtgtttcttcggcgtatgccgcgcttgccaataaaggcagcagcatccatctgtttcgtgcaggcataaatgtcttcccacaaaaataaaaataaaaaataaccattatcaa

SEQ ID NO: 734 - protein, 378 aa, Neisseria gonorrhoeae
ERFVKLDKRPVFLVFVKHIVAPRFAVRQRQARRDAFEMQCPVPKAQGCVRFFIPAPFPFKTAEEAGFFIMPFRHAEAEQRRQAAAAPFLPPGKAQAVTVEIVATVGGVALAVKIQTARPILARIPVKHQRIGNLQMGIVGTRPARILQTPPLRRRQRLPSRGLPTVEIKACAVGVRISVVAVGAAFVEHCQPDIFTPVGKTDAAGNTCRHIVEFLIPRINPAGHVAARRRVPAVFQRPFFLRAEPVIDCRAVHLFRESPIAVLLLFRGLVDIVFAGNAETAVYLPRIAFAQCLAVQLDLLHKLRRQIFCFQAVELVCRRLVLPVFKQCRRQTHTDGGRVGLGGNQFPVMGNRLLHPALCLRQNPLCIKCQHLILPRLL

SEQ ID NO: 735 - DNA, 153 bp, Neisseria gonorrhoeae
ttgcgcttcaaggccctgcatgtacctcattgccacccgtttaaacacggtttttatctgacaggcgcgcaatccgcccccccatttgccgaacaagcggtccggactcccgcccgcgcgggaatgacggcggaaagattctatttttcccga

SEQ ID NO: 736 - protein, 51 aa, Neisseria gonorrhoeae
LRFKALHVPHCHPFKHGFYLTGAQSAPPFAEQAVRTPARAGMTAERFYFSR

SEQ ID NO: 737 - DNA, 144 bp, Neisseria gonorrhoeae
atgcagggccttgaagcgcaatcgatatattatttccaccggaacggacgaccccgcccgccttgcaaacccttaaaagacaagccgcccgggttgatccgggcggccgtgggaaatcacttaccgcttgatttatttaaaatt

SEQ ID NO: 738 - protein, 48 aa, Neisseria gonorrhoeae
MQGLEAQSIYYFHRNGRPRPPCKPLKDKPPGLIRAAVGNHLPLDLFKI

SEQ ID NO: 739 - DNA, 678 bp, Neisseria gonorrhoeae
gtggcatccgcttcaacaatcaaaggcaaatatgttcagaaagttgaagtcacaaacggcgtcgttaccgcccaaatggcttcaaccggcgtaaacaaagaaatcaaaggcaaaaaactctccctgtgggccaggcgtcaagacggttcggtaaaatggttctgcggacagccggttaagcgcgacgacgccgccgccaaagacgacaccgtcaccgccgacgccaccggcaacgacggcaaaatcgacaccaagcacctgccgtcaacctgccgcgataaatcaactgccgtttgcacgaaacaccacgcgccgatttcaaacacttccaaaaaatcagccgttgccgggtattacctgaatcacggcgaatggccggaaaacaacacttctgccggcgtggcatcctccgacaaaatcaaaggcaaatatgttcagaaagttgaagtcgcaaaaggcgtcgttaccgcccaaatggcttcaaccggcgtaaacaaagaaatccaaggcaaaaaactctccctgtgggccaagcgtcaagacggttcggtaaaatggttctgcggacagccggttacgcgcaacgacgccaaagccgacgacgtcaaagccgacgccgccaacgccatcgaaaccaagcacctgccgtcaacctgccgcgatgaatcatctgccacc

SEQ ID NO: 740 - protein, 226 aa, Neisseria gonorrhoeae
VASASTIKGKYVQKVEVTNGVVTAQMASTGVNKEIKGKKLSLWARRQDGSVKWFCGQPVKRDDAAAKDDTVTADATGNDGKIDTKHLPSTCRDKSTAVCTKHHAPISNTSKKSAVAGYYLNHGEWPENNTSAGVASSDKIKGKYVQKVEVAKGVVTAQMASTGVNKEIQGKKLSLWAKRQDGSVKWFCGQPVTRNDAKADDVKADAANAIETKHLPSTCRDESSAT

SEQ ID NO: 741 - DNA, 360 bp, Neisseria gonorrhoeae
ttggccgaaggtcaaaaatcagccgtcaccgagtattacctgaatcacggcatatggccgaaagacaacacttctgccggcgtggcaaaccccaccgacatcaaaggcaaatatgttgaaagcgttacggtcacaaacggcgtcgttaccgccaaaatgctttcaagcggcgtaaacaaagaaatccaaggcaaaagactctccctgtgggccaagcgtgaagccggttcggtaaaatggttctgcggacagccggttaagcgcaccgaagccaacgccgacgccgccggcaaagacaccaccaacggcatcaacaccaagcacctgccgtcaacctgccgcgacccgttctctgctagc

SEQ ID NO: 742 - protein, 120 aa, Neisseria gonorrhoeae
LAEGQKSAVTEYYLNHGIWPKDNTSAGVANPTDIKGKYVESVTVTNGVVTAKMLSSGVNKEIQGKRLSLWAKREAGSVKWFCGQPVKRTEANADAAGKDTTNGINTKHLPSTCRDPFSAS

SEQ ID NO: 743 - DNA, 162 bp, Neisseria gonorrhoeae
ttgcgcttcaaggccctgcatgtacctcattgccacccgtttaaacacggtttttatctgacaggcgcgcaatccgcccccccatttgccgaacaagcggtccggactcccgcccgcgcgggaatgacggcggagcggtttctgttgctcccgataaattcc

SEQ ID NO: 744 - protein, 54 aa, Neisseria gonorrhoeae
LRFKALHVPHCHPFKHGFYLTGAQSAPPFAEQAVRTPARAGMTAERFLLLPINS

SEQ ID NO: 745 - DNA, 144 bp, Neisseria gonorrhoeae; identical to SEQ ID NO: 737

SEQ ID NO: 746 - protein, 48 aa, Neisseria gonorrhoeae; identical to SEQ ID NO: 738

SEQ ID NO: 747 - DNA, 423 bp, Neisseria gonorrhoeae
gtgccgacagacccggattcccgcctgcgcgggaatgacgaagccatccttttggccgaaggtcaaaaatcagccgttaccgggtattacctgaataacggcaaatggcccgccgacaacggcgctgccggcgtggcatcccccgccaccgacatcaaaggcaaatatgttaaggaagttaaagtcgaaaacggcgtcgtcaccgcccaaatggcttcaaccggcgtaaacaatgaaatcaaaggcaaaaaactctccctgtgggccaagcgtcaagacggttcggtaaaatggttctgcggacagccggttaagcgcgacgccggcgccaaaaccggcgccgacgacgtcaaagccgacggcaacaacggcatcaacaccaagcacctgccgtcaacctgccgcgataaacatgatgccaaa

SEQ ID NO: 748 - protein, 141 aa, Neisseria gonorrhoeae
VPTDPDSRLRGNDEAILLAEGQKSAVTGYYLNNGKWPADNGAAGVASPATDIKGKYVKEVKVENGVVTAQMASTGVNNEIKGKKLSLWAKRQDGSVKWFCGQPVKRDAGAKTGADDVKADGNNGINTKHLPSTCRDKHDAK

SEQ ID NO: 749 - DNA, 213 bp, Neisseria gonorrhoeae
gtgtgccgcctgtgtgtcaaaacatttcccggcgcatcaaaacaaccatttgaccgacaatgcggcttctttgtcgccgtccgtccttttgccgtatccgatgcgtgcggacatatggcctttccaaccggcttcaatgccaaaccgcccttcgagcgccgtcctgcctgccagcgtctgtttttcgccgtccatttccatgccgaaagattt

SEQ ID NO: 750 - protein, 71 aa, Neisseria gonorrhoeae
VCRLCVKTFPGASKQPFDRQCGFFVAVRPFAVSDACGHMAFPTGFNAKPPFERRPACQRLFFAVHFHAERF

SEQ ID NO: 751 - DNA, 1116 bp, Neisseria gonorrhoeae
ttggtttatattgtcatctctttcaggcgggctgctgtttgccgcatcggcagatggtgtgtcgtggacgaaaggtttggcgatggcttccggcttcggttggtattccctctcgggtttggtaatgaccgaggcttacggggcggtatggggcagcatcatgctgctgaacgatttggcacgagagctgtttgcactggcatttattccgctgctgatgaagcgttttccggatgcggcggtgggggtcggcggcgcgaccagtatggatttcacattgcccgtaattcagggtgcgggcggtttggaagtcgtgccggtagcggtcagcttcggcgtggtggtcaatatcgccgccccgtttctgatggtggtgttttccacgctgggctgaacgcggtaaaatcggcatcccgatgcaaggaagcagaaaacgatgaaaccgaaaatccaaaggcatggagagattttaagccttgtccgccggcatcagtttatgtcggtggacgagcttgccgccgcattggacgttaccccgcagacgatacgttgcgacatccgcgagttggaggagggtggcagcctgaaacgccatcacggcggcgcatcttcgggcggaaacttgccggagggtctgcccgccgaccgccaaacccggtgtcaaaacgaaaaaaacgccattgcccggctgattgcggaacacatccccgacggttcgtcgctgttcgtcagtatcggtacgaccatggaagccgcggcatcagagctggtgaagcggcgcagcagcctgcggattattaccaacaatatccacgtcgcctccgtcgtttcggcacgtacggattacacggtcatcatcacatccggcgtcgtccgccctttggacggcggtattaccggcgtggcgaccgtcgactttatcaaccagttcaaagtcgattatgccgtgatgagcacgcacggcgtggaaagcgacggttcgcttttggattacgattacaaggaagtcagcgtcatgcaggcgatgattgccaacgcgcgcgtccgttttctcggcgtggatcacagcaaattccgcagcaacgcgctggtcaggctcggcggcattacggcgtt

SEQ ID NO: 752 - protein, 372 aa, Neisseria gonorrhoeae
LVYIVISFRRAAVCRIGRWCVVDERFGDGFRLRLVFPLGFGNDRGLRGGMGQHHAAERFGTRAVCTGIYSAADEAFSGCGGGGRRRDQYGFHIARNSGCGRFGSRAGSGQLRRGGQYRRPVSDGGVFHAGLNAVKSASRCKEAENDETENPKAWRDFKPCPPASVYVGGRACRRIGRYPADDTLRHPRVGGGWQPETPSRRRIFGRKLAGGSARRPPNPVSKRKKRHCPADCGTHPRRFVAVRQYRYDHGSRGIRAGEAAQQPADYYQQYPRRLRRFGTYGLHGHHHIRRRPPFGRRYYRRGDRRLYQPVQSRLCRDEHARRGKRRFAFGLRLQGSQRHAGDDCQRARPFSRRGSQQIPQQRAGQARRHYGV

SEQ ID NO: 753 - DNA, 120 bp, Neisseria gonorrhoeae
atgcccgacggtctttatagcggattaacaaaaatcaggacaaggcggcgaagtcattgcggtattcgcatcataggccggaaaaatccggcctccgtcattcccgcgaaagcgggaatc

SEQ ID NO: 754 - protein, 40 aa, Neisseria gonorrhoeae
MPDGLYSGLTKIRTRRRSHCGIRIIGRKNPASVIPAKAGI

SEQ ID NO: 755 - DNA, 522 bp, Neisseria gonorrhoeae
ttgcacgaaacaccacgcgccgatttcaaacacttccaaaaaatcagccgttgccgggtattacccgaatcacggcaaatggccggaagacaacacttctgccggcgtggcatccccccctccgacatcaaaggcaaatatgttcaaagcgttacggtcgcaaacggcgtcgttaccgccgaaatgaaatcagacggcgtaaacaaagaaatcaaaggcaaaaaactctccctgtggggcaggcgtgaaaacggttcggtaaaatggttctgcggacagccggttaagcgcgacgccaacaacgccaacaacgacgccgtcaccgacgacaccaccggcaacggcaacgaaaaaatcgaaaccaagcacctgccgtcaacctgccgcgatgaatcatctgccgtttgcatagaaacaccacctacggctttctataaaaatacccaaaccgtcattcccacgaaagcgggaatccagaacgcaaaatctaaagaaaccgttttacccgataagtttccgcac

SEQ ID NO: 756 - protein, 174 aa, Neisseria gonorrhoeae
LHETPRADFKHFQKISRCRVLPESRQMAGRQHFCRRGIPPSDIKGKYVQSVTVANGVVTAEMKSDGVNKEIKGKKLSLWGRRENGSVKWFCGQPVKRDANNANNDAVTDDTTGNGNEKIETKHLPSTCRDESSAVCIETPPTAFYKNTQTVIPTKAGIQNAKSKETVLPDKFPH

SEQ ID NO: 757 - DNA, 480 bp, Neisseria gonorrhoeae
gtggcatccgcctccgacatcaaaggcaaatatgttgaaagcgttacggtcgaaaaaggcgtcgttaccgccaaaatgctttcaagcggcgtaaacaaagaaatccaaggcaaaaaactctccctgtgggccaagcgtgaagccggttcggtaaaatggttctgcggacagccggttaagcgcaacgacgccgccaacgacgacgttaccgacgacgccggcaccgacaacggcggcaaaggcaaaatcgacaccaagcacctgccgtcaacctgccgcgataaatcaactgccgtttgcacgaaacaccacgcgccgatttcaaacacttccaaaaaatcagccgttgccgggtattacccgaatcacggcaaatggccggaagacaacacttctgccggcgtggcatccccccctccgacatcaaaggcaaatatgttcaaagcgttacggtcgcaaacggcgtcgttaccgccgaaa

SEQ ID NO: 758 - protein, 160 aa, Neisseria gonorrhoeae
VASASDIKGKYVESVTVEKGVVTAKMLSSGVNKEIQGKKLSLWAKREAGSVKWFCGQPVKRNDAANDDVTDDAGTDNGGKGKIDTKHLPSTCRDKSTAVCTKHHAPISNTSKKSAVAGYYPNHGKWPEDNTSAGVASPPPTSKANMFKALRSQTASLPPK

SEQ ID NO: 759 - DNA, 312 bp, Neisseria gonorrhoeae
atgtccggcgaaaacgaattgcggcagatgaagccgggtgcggttttgatcaattgcgggcgcggcgggccggtggatgaaaacgcgctgcttgccgcactcaaatacgggcagatcggcggggcgggtgtcgatgttttgacggaggaaccgccgaggggcggcaatcccttgctgaatgcacgattacccaatctgattgttacgccgcataccgcgtgggcgagccgcgaggctttggatcggttgtttgaaatattgttggcgaacattcacgcctttgtgaaaggcgaggcgcaaaaccgcgtggtt

SEQ ID NO: 760 - protein, 104 aa, Neisseria gonorrhoeae
MSGENELRQMKPGAVLINCGRGGPVDENALLAALKYGQIGGAGVDVLTEEPPRGGNPLLNARLPNLIVTPHTAWASREALDRLFEILLANIHAFVKGEAQNRVV

SEQ ID NO: 761 - DNA, 2157 bp, Neisseria gonorrhoeae
ttggcaaaaatgccgtctgaagcccgatttttcaggcttcagacggcatttccccgtttgatttgcggtataatccgcctttacccattgtttgcaaagcacaatatgacacgcaaaatcttagttacctccgccctgccctatgccaacggcagcatccacctcggccacatggtcgaacacatccaaaccgacgtttgggtgcgctttcaaaaactgcgcggccacgaatgctactactgctgcgccgacgacacccacggcacgcccgttatgcttgccgcgcaaaaacaaggcatcgcgcccgaagacatgattgccaaagtgcgcaaagagcaccttgccgactttaccggctttttcatcggctacgacaattattacagcacccattccactgaaaacaaacagttttcccaagacatttaccgcgcgctgaaagccaacggcaaaatcgaaagccgcgtcatcgagcagcttttcgaccccgaaaaacaaatgttcctgcccgaccgcttcgtcaaaggcgaatgcccgaaatgccacgcccaagaccaatacggcgacaactgcgaagtctgcggcacgacctattccccgaccgaactgatcaacccgtattccgccgtttccggcgcgaaacccgaattgcgcgaatccgaacacttcttcttcaaactgggcgaatgcgccgacttcctcaaagcatggacttccggcaacaacccgcacgacggcaagccccatctgcaacccgaagccctcaacaaaatgaaggaatggctgggcgaaggcgaagaaaccaccctgtccgactgggacatttcccgcgacgcgccgtatttcggttttgaaatccccgacgcgccgggcaaatacttctacgtttggctggacgcgcccgtcggctatatggcgtcgtttaaaaacctgtgcgaccgcatcggcatcgatttcgacgaatacttcaaagccgacagccaaaccgagatgtaccacttcatcggcaaagacatcctctatttccacgccctgttctggcccgccatgctgcatttctccggccaccgcgccccgaccggcgtgtacgcacacggctttttgaccgtggacggacaaaaaatgtccaaatcgcgcggcaccttcatcaccgccaaatcttatctggaacaaggcctgaaccccgagtggatgcgctactacatcgccgccaagctcaacggcaaaatcgaagacaccgatttgaacctgcaagactttatttcccgcgtcaacagcgaccttgtcggcaaatacgtcaacatcgccgcccgcgcttcgggtttcatcgccaaacgctttgaaggtcgtccgaaagacgtttcaggcagcgcattgctggcaaaactcgccgccgaaagcgacaccatcgccgagcaatacgaaaaccgcgaatacgcccgcgccctgcgcgacatcatggcattggcagacattgtcaacgaatacgtcgatgccaacaagccgtgggagctcgccaaacaagaaggtcaagacgaacgcctgcacgaagtatgcagcgaactcatcaacgccttcaccatgctgaccgcctacctcgcccccgtgttgccgcaaaccgccgccaacgccgcgcgtttcctcaatctggacgcgattacctggaagaacacgcgcgaaaccctaggcgaacacgccatcaacaaatacgaacatttaatgcaacgagtggagcaaaaacaagtggacgatttgatcgaagccaacaaacaaagcattcagacggcatccgcgcccgttgaagagggtaaatacgaaaaagtcgccgaacaggcgggcttcgacgactttatgaaaatcgatatgcgcgtcgccaaagtattgaactgcgaagccgtcgaaggcagcaccaaacttttgaaattcgacctcgatttcggttttgaaaaacgcatcatcttctccggcatcgccgcgtcttacccaaatcctgccgaattgaacggtcgcatggtcatcgcagtcgccaacttcgccccacgcaaaatggcaaaattcggcgtatccgaaggtatgatcctctccgccgccacggcagacggcaaactgaagctgcttgacgtggatgcgggcgctcagccgggcgacaaagtcggt

SEQ ID NO: 762 - protein, 719 aa, Neisseria gonorrhoeae
LAKMPSEARFFRLQTAFPRLICGIIRLYPLFAKHNMTRKILVTSALPYANGSIHLGHMVEHIQTDVWVRFQKLRGHECYYCCADDTHGTPVMLAAQKQGIAPEDMIAKVRKEHLADFTGFFIGYDNYYSTHSTENKQFSQDIYRALKANGKIESRVIEQLFDPEKQMFLPDRFVKGECPKCHAQDQYGDNCEVCGTTYSPTELINPYSAVSGAKPELRESEHFFFKLGECADFLKAWTSGNNPHDGKPHLQPEALNKMKEWLGEGEETTLSDWDISRDAPYFGFEIPDAPGKYFYVWLDAPVGYMASFKNLCDRIGIDFDEYFKADSQTEMYHFIGKDILYFHALFWPAMLHFSGHRAPTGVYAHGFLTVDGQKMSKSRGTFITAKSYLEQGLNPEWMRYYIAAKLNGKIEDTDLNLQDFISRVNSDLVGKYVNIAARASGFIAKRFEGRPKDVSGSALLAKLAAESDTIAEQYENREYARALRDIMALADIVNEYVDANKPWELAKQEGQDERLHEVCSELINAFTMLTAYLAPVLPQTAANAARFLNLDAITWKNTRETLGEHAINKYEHLMQRVEQKQVDDLIEANKQSIQTASAPVEEGKYEKVAEQAGFDDFMKIDMRVAKVLNCEAVEGSTKLLKFDLDFGFEKRIIFSGIAASYPNPAELNGRMVIAVANFAPRKMAKFGVSEGMILSAATADGKLKLLDVDAGAQPGDKVG

SEQ ID NO: 763 - DNA, 1836 bp, Neisseria gonorrhoeae
atgtgcggtatcgtcggcgccatccgcgcccatcacaacgtcgtcgattttctgaccgacggcctcaaacgcctcgaataccggggttatgactcatcaggcattgctgtgtattcagacggcaaaatcaaacgcgtgcgccgcgtcggacgcgtgcagcttatggaggacgcggcacgcgaaaaaggcatcagcggcggcatcggcatcgggcatacgcgctgggcgacacacggcggcgttaccgagccgaacgcccacccgcacatcagcggcggtatgattgccgtcgtccacaacggcatcatcgaaaactttgaaagcgaacgcaaacgcttggaaggtttgggataccggtttgaatcgcaaacggataccgaagtcatcgcacacagcatcaaccacgaatacgcgcaaaacggcggcaggctgtttgaagccgtgcaggaagcggtcaaacgtttccacggcgcatacgccatcgcggttattgcccaagacaagcctgatgaattagttgtggcgcgtatgggctgcccgcttttggtcgctttgggcgacgatgaaacctttatcgcttcggacgtatccgccgtcatcgcctttacgcgccgcgtggcgtacctcgaagacggcgacatcgcgctgctggcttcagacggcatcaaacggctgaccgataaaaacggcctgcctgccgaacgcaaagtcaaggtatccgaactctcgcccgcctctttggaaccgggtccgcacagccactttatgcaaaaagaaatccacgagcagccgcgcgcgattgcggacacggcggaagttttcctcgacggcggattcatccccgaaaacttcggcaaaaatgccaaaagcgtgtttgaaagcatccgcagcgtcaaaatccttgcctgcggcacgtcctattacgccgcgctgaccgccaaatattggttggaatccatcgccaaaatcccggccgacgtcgaaatcgcaagcgaataccggtaccgcagcgtgattgccgaccccgaccaactggtcattaccatttcccaatccggcgaaacgctggacacgatggaggctttgaaatacgccaaatctttgggacaccgccacagcctctccgtctgcaacgtgatggaatccgccctgccgcgcgaaagcagccttgtgctttatacccgtgccggtgcggaaatcggcgtcgcctcgactaaagcatttaccacgcaactggtcgtgctgttcggtttggcggtaacgctggcgaaagtgcgcggcgtggtatccggcgaagatgaagcacgttacaccgaagaactccgccagcttcccggcagcgtgcagcacgctttgaacctcgaaccgcaaattgccgcttgggcgcaacagtttgccaagaaaaccagcgcgctgtttttggggcgcggcatccattacccgattgcccttgaaggtgcgttgaagctaaaggaaatcacctacatccacgccgaagcctatcctgccggcgaactgaaacacgggccgcttgccttggtggacgaaaacatgcccgtcgtcgtcatcgcgcccaacgacagcctgttggacaaagtcaaagccaatatgcaggaagtcggcgcgcgcggcggcgaacttttcgtctttgccgacctcgacagcaattttaatgccaccgaaggcgtacacgttatccgcgcacctcgccacgtcggcgaactgtcccccgtcgtgcataccgtccccgtgcagctcctcgcctaccacaccgccctcgcgcgcggcacggatgtggacaagccgcgcaacctggcgaaatccgtaaccgtcgaa

SEQ ID NO: 764 - protein, 612 aa, Neisseria gonorrhoeae
MCGIVGAIRAHHNVVDFLTDGLKRLEYRGYDSSGIAVYSDGKIKRVRRVGRVQLMEDAAREKGISGGIGIGHTRWATHGGVTEPNAHPHISGGMIAVVHNGIIENFESERKRLEGLGYRFESQTDTEVIAHSINHEYAQNGGRLFEAVQEAVKRFHGAYAIAVIAQDKPDELVVARMGCPLLVALGDDETFIASDVSAVIAFTRRVAYLEDGDIALLASDGIKRLTDKNGLPAERKVKVSELSPASLEPGPHSHFMQKEIHEQPRAIADTAEVFLDGGFIPENFGKNAKSVFESIRSVKILACGTSYYAALTAKYWLESIAKIPADVEIASEYRYRSVIADPDQLVITISQSGETLDTMEALKYAKSLGHRHSLSVCNVMESALPRESSLVLYTRAGAEIGVASTKAFTTQLVVLFGLAVTLAKVRGVVSGEDEARYTEELRQLPGSVQHALNLEPQIAAWAQQFAKKTSALFLGRGIHYPIALEGALKLKEITYIHAEAYPAGELKHGPLALVDENMPVVVIAPNDSLLDKVKANMQEVGARGGELFVFADLDSNFNATEGVHVIRAPRHVGELSPVVHTVPVQLLAYHTALARGTDVDKPRNLAKSVTVE

SEQ ID NO: 765 - DNA, 198 bp, Neisseria gonorrhoeae
ttgaaaaaaaagatgcggacggcttccgtaccgcaccttccgtttcggattataaaccgcctcccgcgccggaaaacagcaaaatgccgtctgaaggcttgggcttgctcaaaaaagggagggatttccccgcctgaccgggatgggcgttcagacggcattgcctgccgccggtttatagtttttgcaaatcaatat

SEQ ID NO: 766 - protein, 66 aa, Neisseria gonorrhoeae
LKKKMRTASVPHLPFRIINRLPRRKTAKCRLKAWACSKKGGISPPDRDGRSDGIACRRFIVFANQY

SEQ ID NO: 767 - DNA, 438 bp, Neisseria gonorrhoeae
ttgtatcagttttttatgccgctgttccaaaccctgccgcccgatgccgcgacaatgccgtctgaagccagaatcgggtttcagacggcggcaaaaaaccggcggttttccgccggtttcatcattatgccccgcccttcggggcggcagggttcggatcggtttgcggggcggcgcacggggccgtgcaggtgtgccgcctgtgtgtcaaaacatttcccggcgcatcaaaacaaccatttgaccgacaatgcggcttctttgtcgccgtccgtccttttgccgtatccgatgcgtgcggacatatggcctttccaaccggcttcaatgccaaaccgcccttcgagcgccgtcctgcctgccagcgtctgtttttcgccgtccatttccatgccgaaagattttgacctgtgcaaaacattaaaagcggcaaaaggc

SEQ ID NO: 768 - protein, 146 aa, Neisseria gonorrhoeae
LYQFFMPLFQTLPPDAATMPSEARIGFQTAAKNRRFSAGFIIMPRPSGRQGSDRFAGRRTGPCRCAACVSKHFPAHQNNHLTDNAASLSPSVLLPYPMRADIWPFQPASMPNRPSSAVLPASVCFSPSISMPKDFDLCKTLKAAKG

SEQ ID NO: 769 - DNA, 900 bp, Neisseria gonorrhoeae
atgagcagcctgatgacgttgttttcggtattggtaccgatgtttgccggattttttatccgtgttcccaagccttacctgcccgcttcggacaaggtgctgtcggttttggtgtatgccgtgctgctgctgatcggcgtatcgttgtcgcgcgtggaggatttgggttcgcggttgggcgatatggcgttgacggttctgtggctgtttgtttgtacggtaggggcgaacctgcttgccttggcagtgttgggaaagttgtccccgtggcggatagggggaaaagggaagggcgtttcggtcggcgtgtcgggcagtgtgaggcagctcggatgcgtactgctcggttttgtgtccggcaaattgatgtgcgatatttggatgccgtctgaaaacgcgggtatgtactgcctgatgctgctggtgttcctcatcggcgtacagctcaaaagtagcggcgtatcgttgcggcaggttttgcttaaccggcggggcatccggctgtcggtttggtttatattgtcatctctttcaggcgggctgctgtttgccgcatcggcagatggtgtgtcgtggacgaaaggtttggcgatggcttccggcttcggttggtattccctctcgggtttggtaatgaccgaggcttacggggcggtatggggcagcatcatgctgctgaacgatttggcacgagagctgtttgcactggcatttattccgctgctgatgaagcgttttccggatgcggcggtgggggtcggcggcgcgaccagtatggatttcacattgcccgtaattcagggtgcgggcggtttggaagtcgtgccggtagcggtcagcttcggcgtggtggtcaatatcgccgccccgtttctgatggtggtgttttccacgctgggc

SEQ ID NO: 770 - protein, 300 aa, Neisseria gonorrhoeae
MSSLMTLFSVLVPMFAGFFIRVPKPYLPASDKVLSVLVYAVLLLIGVSLSRVEDLGSRLGDMALTVLWLFVCTVGANLLALAVLGKLSPWRIGGKGKGVSVGVSGSVRQLGCVLLGFVSGKLMCDIWMPSENAGMYCLMLLVFLIGVQLKSSGVSLRQVLLNRRGIRLSVWFILSSLSGGLLFAASADGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSTLG

SEQ ID NO: 771 - DNA, 519 bp, Neisseria gonorrhoeae
atggaaatgaaacaaatgcttttggccgtcggcgtggcggcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttt

SEQ ID NO: 772 - protein, 173 aa, Neisseria gonorrhoeae
MEMKQMLLAVGVAAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 773 - DNA, 252 bp, Neisseria gonorrhoeae
ttgcgataccgcaggcacaagccggccggtcggacaaaacgcctttcttatttgacggaatggatttccgcccgaacggaaatcccccttgcaaacggacagaatcggacgggtattcaaacgcatccgaacaaaaaaaggcggacattcccgcccgcccgtaccggtatggaaaccacgcgtccgattcggacggcggcatcctcccggttgtcctacgctaaaacaacaatgtcggtttgccgttgcatt

SEQ ID NO: 774 - protein, 84 aa, Neisseria gonorrhoeae
LRYRRHKPAGRTKRLSYLTEWISARTEIPLANGQNRTGIQTHPNKKRRTFPPARTGMETTRPIRTAASSRLSYAKTTMSVCRCI

SEQ ID NO: 775 - DNA, 1404 bp, Neisseria gonorrhoeae
gtgttaaaatcccctctccccggctaccgcaacgccgcccgaaaccatctttttttattactgacgacaacattgtccattatgaaaaaacacctgctccgctccgccctgtacggcatcgccgccgccatcctcgccgcctgccaaagcaggagcatccaaacctttccgcaacccgacacatccgtcatcaacggcccggaccggccggccggcatccccgaccccgccggaacgacggttgccggcggcggggccgtctataccgttgtgccgcacctgtccatgccccactgggcggcgcaggattttgccaaaagcctgcaatccttccgcctcggctgcgccaatttgaaaaaccgccaaggctggcaggatgtgtgcgcccaagcctttcaaacccccgtgcattcctttcaggcaaagcggttttttgaacgctatttcacgccgtggcaggttgcaggcaacggaagccttgcaggtacggttaccggctattacgaaccggtgctgaagggcgacggcaggcggacggaacgggcccgcttcccgatttacggtattcccgacgattttatctccgtcccgctgcctgccggtttgcggggcggaaaaaaccttgtccgcatcaggcagacggggaaaaacagcggcacgatcgacaatgccggcggcacgcataccgccgacctctcccgattccccatcaccgcgcgcacaacggcaatcaaaggcaggtttgaaggaagccgcttcctcccttaccacacgcgcaaccaaatcaacggcggcgcgcttgacggcaaagcccccatcctcggttacgccgaagaccccgtcgaactttttttcatgcacatccaaggctcgggccgcctgaaaaccccgtccggcaaatacatccgcatcggatacgccgacaaaaacgaacatccgtatgtttccatcggacgctatatggcggacaaaggctacctcaagctcgggcagacctcgatgcagggcatcaaagcctatatgcggcaaaatccgcaacgcctcgccgaagttttgggtcaaaaccccagctatatctttttccgcgagcttgccggaagcggcaatgagggccccgtcggcgcactgggcacgccactgatgggggaatacgccggcgcaatcgaccggcactacattaccttgggcgcgcccttatttgtcgccaccgcccatccggttacccgcaaagccctcaaccgcctgattatggcgcaggatacaggcagcgcgatcaaaggcgcggtgcgcgtggattatttttggggttacggcgacgaagccggcgaacttgccggcaaacagaaaaccacgggatacgtctggcagctcctgcccaacggcatgaagcccgaataccgcccg

SEQ ID NO: 776 - protein, 468 aa, Neisseria gonorrhoeae
VLKSPLPGYRNAARNHLFLLLTTTLSIMKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 777 - DNA, 159 bp, Neisseria gonorrhoeae
gtgcaaaacattaaaagcggcaaaaggctgaagattgacaccgttacgcaaagcaaaacgggtttttgcccgaatgccggcgcggatttgccactgaccgctgccgagcagcccgaccgccgcccctcgctgtcggtaaagccgccgtttacgcccaag

SEQ ID NO: 778 - protein, 53 aa, Neisseria gonorrhoeae
VQNIKSGKRLKIDTVTQSKTGFCPNAGADLPLTAAEQPDRRPSLSVKPPFTPK

SEQ ID NO: 779 - DNA, 228 bp, Neisseria gonorrhoeae
atgatttcagcctgtccgggctttatccgcagcaggttcggacggtcggtcatgccgtctgaaccggcaggccgtctttctcaaaaaacgccataccgctgcaacttcatgcggctgtatggcgtaggttttgcacttcagacggcatatgcgtcccgaagcagtttggtgtcccagtcggttcatgattatataaacaacttgggtgcggataaacctttgtttatc

SEQ ID NO: 780 - protein, 76 aa, Neisseria gonorrhoeae
MISACPGFIRSRFGRSVMPSEPAGRLSQKTPYRCNFMRLYGVGFALQTAYASRSSLVSQSVHDYINNLGADKPLFI

SEQ ID NO: 781 - DNA, 510 bp, Neisseria gonorrhoeae
atgcctaaggtctggttcggggtcgtccttgcttctttgatgtgtttgggcatcggatacggcatccattcggcaacgggcgagattccccggaagcagcaggagttcgtcgtcggcattatcggtttggttgccgtcgcgatgctgacttgtgtggttttatggatgaaaaaggcggcgcgttcgatgaagcggcagcttcgggattctgtacaggcggctttgaaccgtggcagcggtcaaggatgggccttggtcggtatggcgtttcttgccgtggcgcgcgaaggtttggagagcgttttttttcctgcttgccgtattcaaacagagcccgacgtggcagatgccggccggcgcggtagcgggggttttggctgccgccgtgattggcgcgttgatttatcagggcgggatgcgcctgaatctggcgaagtttttccgttggacgggggcgtttctgattatcgttgccgccggtctgcttgccggctcgctgcgtgcgctgca

SEQ ID NO: 782 - protein, 170 aa, Neisseria gonorrhoeae
MPKVWFGVVLASLMCLGIGYGIHSATGEIPRKQQEFVVGIIGLVAVAMLTCVVLWMKKAARSMKRQLRDSVQAALNRGSGQGWALVGMAFLAVAREGLESVFFPACRIQTEPDVADAGRRGSGGFGCRRDWRVDLSGRDAPESGEVFPLDGGVSDYRCRRSACRLAACAA

SEQ ID NO: 783 - DNA, 507 bp, Neisseria gonorrhoeae
gtggcagcggtcaaggatgggccttggtcggtatggcgtttcttgccgtggcgcgcgaaggtttggagagcgttttttttcctgcttgccgtattcaaacagagcccgacgtggcagatgccggccggcgcggtagcgggggttttggctgccgccgtgattggcgcgttgatttatcagggcgggatgcgcctgaatctggcgaagtttttccgttggacgggggcgtttctgattatcgttgccgccggtctgcttgccggctcgctgcgtgcgctgcatgaggcaggcatttggaacgcgcttcaggacattgtgttcgacccatcaaaatatttgcacgaagacagtccgttgggtgtgctgctcggcggatttttcggctataccgaccatccggcgcagggcggggccttggtttggctgctgtaccttattcccgtcatgatttggtttttgcgcggcagcaggccgtctgaaactttaacccgtaaagaggaattgaaa

SEQ ID NO: 784 - protein, 169 aa, Neisseria gonorrhoeae
VAAVKDGPWSVWRFLPWRAKVWRAFFFLLAVFKQSPTWQMPAGAVAGVLAAAVIGALIYQGGMRLNLAKFFRWTGAFLIIVAAGLLAGSLRALHEAGIWNALQDIVFDPSKYLHEDSPLGVLLGGFFGYTDHPAQGGALVWLLYLIPVMIWFLRGSRPSETLTRKEELK

SEQ ID NO: 785 - DNA, 1164 bp, Neisseria gonorrhoeae
atgagaaaattcaatttgaccgcattgtccgtgatgcttgccttgggtttgaccgcgtgccagccgccggaggcggagaaagccgcgccggccgcgtccggtgagacccaatccgccaacgaaggcggttcggtcggtatcgccgtcaacgacaatgcctgcgaaccgatgaatctgaccgtgccgagcggacaggttgtgttcaatattaaaaacaacagcggccgcaagctcgaatgggaaatcctgaagggcgtgatggtggtggacgaacgcgaaaatatcgccccggggctttccgacaaaatgaccgtaaccctgctgccgggcgaatacgaaatgacctgcggccttttgaccaatccgcgcggcaagctggtggtagccgacagcggctttaaagacaccgccaacgaagcggatttggaaaaactgccccaaccgctcgccgactataaagcctacgttcaaggcgaggttaaagagctggcggcgaaaaccaaaacctttaccgaagccgtcaaagcaggcgacattgaaaaggcgaaatccctgtttgccgccacccgcgtccattacgaacgcatcgaaccgattgccgagcttttcagcgaactcgaccccgtcatcgatgcgtgtgaagacgacttcaaagacggtgcgaaagatgccgggtttaccggcttccaccgtatcgaacacgccctttgggtggaaaaagacgtatccggcgtgaaggaaaccgcggccaaactgatgaccgatgtcgaagccctgcaaaaagaaatcgacgcattggcgttccctccgggcaaagtggtcggcggcgcgtccgaactgattgaagaagcggcgggcagtaaaatcagcggcgaagaagaccgttacagccacaccgatttgagcgacttccaagctaatgcggacggatctaaaaaaatcgtcgatttgttccgtccgttgattgaggccaaaaacaaagccttgttggaaaaaaccgataccaacttcaaacaggtcaacgaaattctggcgaaataccgcaccaaagacggttttgaaacctacgacaagctgagcgaagccgaccgcaaagcattacaggctcctattaacgcgcttgccgaagaccttgcccaacttcgcggcatactcggcttgaaa

SEQ ID NO: 786 - protein, 388 aa, Neisseria gonorrhoeae
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMTVTLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 787 - DNA, 255 bp, Neisseria gonorrhoeae
ttgactcatggcgtttccttcaatatccgtgcagcagggtgggcatccctgcacgccgtttttccattaaccgatagcggcggtctgaaagcccgccctgcaacatatggcggatatagcggattaacgaaaatcaggacaaggcggcgggccgcaggcagtacaaatggtacggaaccggttcgcccggtgcttgggcgccttagggaaccgttccctttgagccggggcggggcaacccgtaccggtttttgt

SEQ ID NO: 788 - protein, 85 aa, Neisseria gonorrhoeae
LTHGVSFNIRAAGWASLHAVFPLTDSGGLKARPATYGGYSGLTKIRTRRRAAGSTNGTEPVRPVLGRLREPFPLSRGGATRTGFC

SEQ ID NO: 789 - DNA, 1263 bp, Neisseria gonorrhoeae
atgagtcaaaaccaacccgcacaaccgaccaaacgcaatctgttcaaaaccgcccttgccgtcggcgcaatcggcgcaatcggaggttatttcggcggcaaaaaacagggcgaaaccgccgaacgcaccgccgaaagccaacactcgccccaagcctatccctgctacggcgaacatcaggcaggtatcgttacgccgcggcaggcgttttccattatgtgcgccttcgacgtaaccgcgcaaagtgccaagcagctggaaaacctgttccgcacactgaccgcccgcatcgagtttctcacccaaggcggagaataccaagacggcgacgacaaactcccgtcagccggcagcggcattttgggtaaagccttcaaccccgacggattgaccgttaccgtgggggtgggcagcagcctgtttgacggccggttcggactcaaagacaaaaaaacggttcatttgcaggaaatgcgcgacttccccaacgataagctgcaaaaaagctggtgcgacggcgatttgagcctgcaaatctgcgccttcacccccgaaacctgccaaaccgccctgcgcgacatcatcaaacacaccgcccaaaccgccgtcatccgctggagtatcgacgggtggcagcctaaatccgaacccggcgcgatggcggcgcgcaacctgttgggcttccgagacggcacgggcaaccccaaggtttccgatcccaaaaccgccgacgaggttttatggacgggcgtggccgccaacagcctcgacgaaccggagtgggcgaaaaacggcagctatcaggcagtccgccttatccgccgctttgtcgagttttgggacaggacgccgcttcaagagcaaaccgacattttcgggcggcgaaaatacagcggggcgccgatggacggcaaaaaagaagccgaccaaccggatttcgccaaagaccccgagggtgatatcacgcccaaagacagccatatgcgcctggcgaatccgcgcgatcccgaattcctcaaaaaacactgcctcttccgccgcgcctacagctattctcgcggacccgcctcaagcggacagcttgatgtcgggctggtgttcgtctgctatcaggcaaatcttgccgacggtttcatcttcgtgcaaaacctcctcaacggcgaaccgctggaagaatacatcagccccttcggcggcggctatttcttcgtcttgcccggcgtgggaaaaggcggattcttgggacaagggctgccgggcgta

SEQ ID NO: 790 - protein, 421 aa, Neisseria gonorrhoeae
MSQNQPAQPTKRNLFKTALAVGAIGAIGGYFGGKKQGETAERTAESQHSPQAYPCYGEHQAGIVTPRQAFSIMCAFDVTAQSAKQLENLFRTLTARIEFLTQGGEYQDGDDKLPSAGSGILGKAFNPDGLTVTVGVGSSLFDGRFGLKDKKTVHLQEMRDFPNDKLQKSWCDGDLSLQICAFTPETCQTALRDIIKHTAQTAVIRWSIDGWQPKSEPGAMAARNLLGFRDGTGNPKVSDPKTADEVLWTGVAANSLDEPEWAKNGSYQAVRLIRRFVEFWDRTPLQEQTDIFGRRKYSGAPMDGKKEADQPDFAKDPEGDITPKDSHMRLANPRDPEFLKKHCLFRRAYSYSRGPASSGQLDVGLVFVCYQANLADGFIFVQNLLNGEPLEEYISPFGGGYFFVLPGVGKGGFLGQGLPGV

SEQ ID NO: 791 - DNA, 177 bp, Neisseria gonorrhoeae
ttgtcccaagaatccgccttttcccacgccgggcaagacgaagaaatagccgccgccgaaggggctgatgtattcttccagcggttcgccgttgaggaggttttgcacgaagatgaaaccgtcggcaagatttgcctgatagcagacgaacaccagcccgacatcaagctgtccgct

SEQ ID NO: 792 - protein, 59 aa, Neisseria gonorrhoeae
LSQESAFSHAGQDEEIAAAEGADVFFQRFAVEEVLHEDETVGKICLIADEHQPDIKLSA

SEQ ID NO: 793 - DNA, 201 bp, Neisseria gonorrhoeae
gtgcgcgatgccaacggcgcggcgctgcaaaacggcgacaccgtcatcctcatcaaagacctcaaggtaaaaggcagctcgatgacgatcaaacaaggtacgaaggtcaaaggcatacgcctgcaggaaggcgatcacaacatcggctgcaaaatcgacggcagcgcgatgaatttaaaatccgaattcgtcaaaaaagcc

SEQ ID NO: 794 - protein, 67 aa, Neisseria gonorrhoeae
VRDANGAALQNGDTVILIKDLKVKGSSMTIKQGTKVKGIRLQEGDHNIGCKIDGSAMNLKSEFVKKA

SEQ ID NO: 795 - DNA, 306 bp, Neisseria gonorrhoeae
atggaatattgcgaacctgaagaagcatccgacccgtacgcaacatacaggcgtgccaacctgatggcggggctgccgctgtttgtcgtgattttggttctgctcaatgttgtttttccgcttccggctcatcccttggcttggctggtgcctgcaggtttcatggttttgggcggcggctttcccttatcgctgccgcttgtggcgctgcttgtcccgacctgctgcattctggcgcgttgtccgccattatcccgtcttttgtgccacccttgcccgaatcatccgatgtctaaaaattctgcc

SEQ ID NO: 796 - protein, 102 aa, Neisseria gonorrhoeae
MEYCEPEEASDPYATYRRANLMAGLPLFVVILVLLNVVFPLPAHPLAWLVPAGFMVLGGGFPLSLPLVALLVPTCCILARCPPLSRLLCHPCPNHPMSKNSA

SEQ ID NO: 797 - DNA, 186 bp, Neisseria gonorrhoeae
aaacaaccatttgaccgacaatgcggcttctttgtcgccgtccgtccttttgccgtatccgatgcgtgcggacatatggcctttccaaccggcttcaatgccaaaccgcccttcgagcgccgtcctgcctgccagcgtctgtttttcgccgtccatttccatgccgaaagattttgacctgtgcaa

SEQ ID NO: 798 - protein, 58 aa, Neisseria gonorrhoeae
KQPFDRQCGFFVAVRPFAVSDACGHMAFPTGFNAKPPFERRPACQRLFFAVHFHAERF

SEQ ID NO: 799 - DNA, 114 bp, Neisseria gonorrhoeae
gtgccgtctgaagccggtttcaggtttcagacggcatcccaaaacaaacatccgataaggacggcaaaccatgtcattacccccttgcccgcaatgcgcctccgaatacaccta

SEQ ID NO: 800 - protein, 38 aa, Neisseria gonorrhoeae
VPSEAGFRFQTASQNKHPIRTANHVITPLPAMRLRIHL

SEQ ID NO: 801 - DNA, 1413 bp, Neisseria gonorrhoeae
atgccgtctgaaaccgcttcagacggcatggcacaggaaaacgctatgccgcaaaacactttaaacaccgtcatcctcgccgccggcaaaggcacgcgcatgtattcccaaatgcccaaagtgctgcactgcatcggcggcaagcccatggtcgagcgcgttatcgacaccgccgccgcgctgaatccgcaaaacatctgcgtcgtcgtcggacacggcaaagagcaagttttagacactgtcaaacgcgatgccgtctgggtcgaacaaaccgaacagctcggcaccggccacgccgtcaaaaccgccctgccccaccttgcctccgaaggccgcacgctggtgttgtacggcgacgttcctttaattgacgttgaaaccctcgaaaccctgctcgaagccgcaggcaacgaagtcgggctgttgaccgacgtgcccgccgacccggcaggcttggggcgcatcatccgcgacggcagcggcagcgtaaccgccattgtcgaagaaaaagacgcaagtgccacccaaaaaaccatccgcgaaatcaacacaggcatcctcgtcctgcccaacgccaaactggaaaactggctgaacagcctttccagcaacaatgcccaaggcgaatattatttaaccgacctcatcgccaaagccgttgccgacggcatcaaagtccgccccgtccgggtgcgcgcctcccacctcgccgccggcgtgaacaacaaacgccagctcgccgaactcgaacgcatcttccaaaccgaacaggcgcaagaattgctcaaagcaggcgtgaccctgcgcgatccggcgcgtttcgatttgcggggccgtctgaaacacggacaggatgtcgtgattgacgtcaacgtcgtcatcgaaggtgaagtcgaactcggcgacaacgtcgaaatcggcgcaaactgcgtcatcaaaaacgccaaaatcggcgcaaacagcaaaattgcccccttctcccacctcgaaggctgcgaagtcggcgaaaacaaccgaatcggcccgtacgcccgcctgcgtccgcaagccaaactggctgacaatgtacacgtcggcaacttcgtcgaaatcaaaaacgccgccatcggcaaaggcaccaaagccaaccacctcacctacataggcgacgccgaagtcggcagcaaaaccaacttcggcgcgggcacgattattgccaactacgacggcgtgcacaaacacaaaaccgtcatcggcgacgaagtgcgcatcggttcgaactgcgtactggttgcccctgtaacactgggcaacaaagtaaccacaggcgcaggcagcacgattacccgcaatatcgaagacaacaaactcgccctcgcccgcgcccgccaaaccgtcatcgaaggctggatgaggccggaaaaagacaaacaa

SEQ ID NO: 802 - protein, 471 aa, Neisseria gonorrhoeae
MPSETASDGMAQENAMPQNTLNTVILAAGKGTRMYSQMPKVLHCIGGKPMVERVIDTAAALNPQNICVVVGHGKEQVLDTVKRDAVWVEQTEQLGTGHAVKTALPHLASEGRTLVLYGDVPLIDVETLETLLEAAGNEVGLLTDVPADPAGLGRIIRDGSGSVTAIVEEKDASATQKTIREINTGILVLPNAKLENWLNSLSSNNAQGEYYLTDLIAKAVADGIKVRPVRVRASHLAAGVNNKRQLAELERIFQTEQAQELLKAGVTLRDPARFDLRGRLKHGQDVVIDVNVVIEGEVELGDNVEIGANCVIKNAKIGANSKIAPFSHLEGCEVGENNRIGPYARLRPQAKLADNVHVGNFVEIKNAAIGKGTKANHLTYIGDAEVGSKTNFGAGTIIANYDGVHKHKTVIGDEVRIGSNCVLVAPVTLGNKVTTGAGSTITRNIEDNKLALARARQTVIEGWMRPEKDKQ

SEQ ID NO: 803 - DNA, 270 bp, Neisseria gonorrhoeae
atgcgtaaaaccttccttatcctgaccgtctccgccgcccttttgtcgggctgcgcgtgggaaacttatcaagacggcaacggcaaaaccgccgtccgtcaaaaatatcccgccggcacgcccgtttattaccaagacggcagctactcgaaaaatatgaactacaaccaataccgtcccgaacgccgcgccgtgctgcccgaccaaaccggcaacaacgccgacgaagagcatcgccaacactggcaaaaaccaaagtttcaaaaccga

SEQ ID NO: 804 - protein, 90 aa, Neisseria gonorrhoeae
MRKTFLILTVSAALLSGCAWETYQDGNGKTAVRQKYPAGTPVYYQDGSYSKNMNYNQYRPERRAVLPDQTGNNADEEHRQHWQKPKFQNR

SEQ ID NO: 805 - DNA, 726 bp, Neisseria gonorrhoeae
atgcaagaaaacccgaccgtgtggctgttcgacctcgacaacacgctgcacgatgccgacgcaggcatcttccacctcatcaaccgcgctatgacgcgctatatggcacgccgcctcaaactctccgaatccgccgcgtccgacctgcgtcaagactattggcaccgttacggcgcaacgctcgccggactgcaaatccaccatcccgaaatcgacattgcggaatttttacgcgaaagccatccgatcgatgcaatcctgaccaggctgcacggcatggcggatacggaaaacaccctatgccgtctgaacgggcgcaaggcggttttttccaacggcccgtcgttttacgtccgtgccgttgccggcgcactcggtttggaaaactgtttcgacgcactgttcggcacggatgatttcggactgctgtacaaacccaatccgcaagcgtatctcaatgtctgccgcctgttggacgtaccgcccgaatgctgcattatggtggacgacagcgcggacaacctccatcaggcaaaagcattgggcatgaaaaccgtccggttcggtgcaaaatcccacgcaccgccctttatcgatgcctccgtaagcgatatggcgcaactggcacggtatgcagaaactttgtcagaacgccgccaaaatcattacaatacccgcaccccccgaaaatacgaaagaatgctatgcgtaaaaccttccttatcc

SEQ ID NO: 806 - protein, 242 aa, Neisseria gonorrhoeae
MQENPTVWLFDLDNTLHDADAGIFHLINRAMTRYMARRLKLSESAASDLRQDYWHRYGATLAGLQIHHPEIDIAEFLRESHPIDAILTRLHGMADTENTLCRLNGRKAVFSNGPSFYVRAVAGALGLENCFDALFGTDDFGLLYKPNPQAYLNVCRLLDVPPECCIMVDDSADNLHQAKALGMKTVRFGAKSHAPPFIDASVSDMAQLARYAETLSERRQNHYNTRTPRKYERMLCVKPSLS

SEQ ID NO: 807 - DNA, 999 bp, Neisseria gonorrhoeae
atgaaacggaaaatttggctgctgccgctgctggcggtttcggcatacctgcaggcgcagacggaagtcaggctggcggtgcataagtcgttcagcctgcccaaagggttgattgcgcgcttcgagcgggcaaacgatgcgaaagtgtcgattattcaggcgggcggcgcgaacgaaatgctcaacaaactgattttgagccgagccaacccgattgccgacgcggtgtacggtttggacaacgccaatatcggcaaggcgcgggaaatgggcattttggcggcggcgcaacccgaatccgcccccgtcgcggtcgggctgccttcggctttggcggtcgattacggctatgtgtccgtcaattacgacaaaaaatggtttgaaggcaaaaagctgcccctgccgcaaaccctgcaggatttgacccgccccgaatataaaaacctattggtcgtgccgtcccccgccacatcttcccccggcttgggcttcctgatggcgaacatcggcggtctgggcgaagaaggcgcgtttaaatggtgggcacagatgcggcagaacggcgtgaaggtcgccaaaggttggagcgaggcgtattacaccgacttttcgcacaacggcggcgcgtatccgctggtggtcggttatgccgccagccctgcggcggaagtatatttttccaaaggcaaatacagcgagccgccgacgggcaacctgtttttaaaaggcggcgtattccgtcaggtcgaaggcgcggcggtcttgaagggcgcgaaacagccgaagctggcggcaaaactggtgcaatggctgcaaagtctggaagtgcagcaggcggttccgtctgaaatgtgggtttaccccgccgtcaaaaacacgcgcctgcccgacgtgttccgcttcgcccaagccccggcgcacactaccgcccccgcgcagcgcgatattgatgcgaaccagcgcggatgggtttcccgttggatcaggacggttttgaaa

SEQ ID NO: 808 - protein, 333 aa, Neisseria gonorrhoeae
MKRKIWLLPLLAVSAYLQAQTEVRLAVHKSFSLPKGLIARFERANDAKVSIIQAGGANEMLNKLILSRANPIADAVYGLDNANIGKAREMGILAAAQPESAPVAVGLPSALAVDYGYVSVNYDKKWFEGKKLPLPQTLQDLTRPEYKNLLVVPSPATSSPGLGFLMANIGGLGEEGAFKWWAQMRQNGVKVAKGWSEAYYTDFSHNGGAYPLVVGYAASPAAEVYFSKGKYSEPPTGNLFLKGGVFRQVEGAAVLKGAKQPKLAAKLVQWLQSLEVQQAVPSEMWVYPAVKNTRLPDVFRFAQAPAHTTAPAQRDIDANQRGWVSRWIRTVLK

SEQ ID NO: 809 - DNA, 846 bp, Neisseria gonorrhoeae
atggacttcaaacaatttgattttttacacctgatcagtgtttccggttgggggcatctggctgaaaaggcgtgggcgttcgggctgaaccttgccgccgcgctgcttattttcttggtcgggaaatgggcggcgaaacgcattgtcgccgtaatgagggcggcgatgacgcgcgcgcaggtcgatgccacgctgattagttttttgtgtaatgttgccaatatcggcttattgattttggtgattattgccgcattgggacggttgggcgtttccacaacatccgtaaccgccttaatcggcggcgcgggtttggcggtggcgttgtccttaaaagaccagctgtccaattttgccgccggcgcgctgattatcctgttccgcccgttcaaagtcggcgactttatccgtgtcggcggttttgaaggatatgtccgggaaatcaaaatggtgcagacttctttgcggacgaccgacaacgaagaagtcgtgctgcccaacagcgtggtgatgggcaacagcatcgtcaaccgttccagcctgccgctttgccgcgcccaagtgatagtcggcgtcgattacaactgcgatttgaaagtggcgaaagaggcggtgttgaaagccgccgccgaacaccccttgagcgttcaaaacgaagagcggcagcccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattct

SEQ ID NO: 810 - protein, 282 aa, Neisseria gonorrhoeae
MDFKQFDFLHLISVSGWGHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 811 - DNA, 480 bp, Neisseria gonorrhoeae
atggacgcgttgcacaccatcgcccgaaacctgacgaaaaaacgtcaaaccgtaagctgtgccgaatcctgcacgggcggaatgcttgccgccgcattcacaagcgttgcaggcagttcgcaatggttcgaccagagttttgtaacatacagcaacaaagccaaagaataccgcttgggcgtgttgcccgaaaccctgctcgaacacggcgcggtcagccgccaaaccgtctatgagatggcgcgcggcgcgaaagccgtggctcaggcggattacgccgtcggtatttccggcatcgccggcccgggcggcggcgaaagcaaacccgtcggcacggtttggttcgggtttgcctttccgggcggaagttgcgaagcaatgcgccgttttgacggcaaccgcgaatccgtccgcgcgcaggcggtcgccttcgcgttggaacggttggccgggctggttgaaaacggcggcgatgctgtc

SEQ ID NO: 812 - protein, 160 aa, Neisseria gonorrhoeae
MDALHTIARNLTKKRQTVSCAESCTGGMLAAAFTSVAGSSQWFDQSFVTYSNKAKEYRLGVLPETLLEHGAVSRQTVYEMARGAKAVAQADYAVGISGIAGPGGGESKPVGTVWFGFAFPGGSCEAMRRFDGNRESVRAQAVAFALERLAGLVENGGDAV

SEQ ID NO: 813 - DNA, 480 bp, Neisseria gonorrhoeae
tgccccgcccttcggggcggcagggttcggatcggtttgcggggcggcgcacggggccgtgcaggtgtgccgcctgtgtgtcaaaacatttcccggcgcatcaaaacaaccatttgaccgacaatgcggcttctttgtcgccgtccgtccttttgccgtatccgatgcgtgcggacatatggcctttccaaccggcttcaatgccaaaccgcccttcgagcgccgtcctgcctgccagcgtctgtttttcgccgtccatttccatgccgaaagattttgacctgtgcaaaacattaaaagcggcaaaaggctgaagattgacaccgttacgcaaagcaaaacgggtttttgcccgaatgccggcgcggatttgccactgaccgctgccgagcagcccgaccgccgcccctcgctgtcggtaaagccgccgtttacgcccaagtaggtaaactgcgcctgcggttgcaggtaaaactgcat

SEQ ID NO: 814 - protein, 38 aa, Neisseria gonorrhoeae
CPALRGGRVRIGLRGGARGRAGVPPVCQNISRRIKTTI

SEQ ID NO: 815 - DNA, 153 bp, Neisseria gonorrhoeae
ttgaatgccggagcggataagccgcctgaaccttcaggcggttttttaatggcgaacctgatgccgtctgaaatatggatgcgggtatctgcaattttcagacggcaatttttaagccgcacatatcatgcggcaataaaggagggtagggga

SEQ ID NO: 816 - protein, 51 aa, Neisseria gonorrhoeae
LNAGADKPPEPSGGFLMANLMPSEIWMRVSAIFRRQFLSRTYHAAIKEGRG

SEQ ID NO: 817 - DNA, 573 bp, Neisseria gonorrhoeae
atgccgtctgaaacctgcaacgtttcagacggcattttttatccggcggggatttgttcagacagcatcgccgccgttttcaaccagcccggccaaccgttccaacgcgaaggcgaccgcctgcgcgcggacggattcgcggttgccgtcaaaacggcgcattgcttcgcaacttccgcccggaaaggcaaacccgaaccaaaccgtgccgacgggtttgctttcgccgccgcccgggccggcgatgccggaaataccgacggcgtaatccgcctgagccacggctttcgcgccgcgcgccatctcatagacggtttggcggctgaccgcgccgtgttcgagcagggtttcgggcaacacgcccaagcggtattctttggctttgttgctgtatgttacaaaactctggtcgaaccattgcgaactgcctgcaacgcttgtgaatgcggcggcaagcattccgcccgtgcaggattcggcacagcttacggtttgacgttttttcgtcaggtttcgggcgatggtgtgcaacgcgtccatttcccacccccctttcagacggcgtttaagaat

SEQ ID NO: 818 - protein, 191 aa, Neisseria gonorrhoeae
MPSETCNVSDGIFYPAGICSDSIAAVFNQPGQPFQREGDRLRADGFAVAVKTAHCFATSARKGKPEPNRADGFAFAAARAGDAGNTDGVIRLSHGFRAARHLIDGLAADRAVFEQGFGQHAQAVFFGFVAVCYKTLVEPLRTACNACECGGKHSARAGFGTAYGLTFFRQVSGDGVQRVHFPPPFQTAFKN

SEQ ID NO: 819 - DNA, 1596 bp, Neisseria gonorrhoeae
atgcaaaccgtccacacaggaaacatcaaaatgaaacaccgtactttcttttccctttgcgccaagttcggctgcctgcttgcgctgggcgcttgttcgcccaaaatcgtcgatgccgggaccgcgaccgtgccgcacactttatccacgttaaaaaccgcggacaaccgccccgccagtgtttatttgaaaaaagacaaaccgacgctgattaaattttgggcgagctggtgtcctttatgtttgtccgaattgggacaggccgagaaatgggcgcaagatgcaaaattcagctccgccaacctgattaccgtcgcctcccccggctttttgcacgagaaaaaagacggcgagtttcaaaaatggtatgccggtttgaactaccccaagctgcccgtcgttaccgacaacggcggcacgatcgcccaaaacctgaatatcagcgtttatccttcttgggcgttaatcggtaaagacggcgacgtgcagcgcatcgtcaaaggcagcatcaacgaagcgcaggcattggcgttaatccgcaacccgaatgccgatttgggcagtttgaaacattcgttctacaaacccgacactcagaaaaaggattcagcaatcatgaacacgcgcaccatctacctcgccggcggctgcttctggggcttggaagcctatttccaacgcatcgacggcgtggttgacgcggtatccggctacgccaacggcaacacggaaaacccgagctacgaagacgtgtcctaccgccatacgggtcatgccgagaccgtcaaagtgacctacgatgccgacaaactcagcctggacgacatcctgcaatattatttccgcgtcgttgatccgaccagcctcaacaaacagggtaacgacaccggcacgcaataccgcagcggcgtgtactacaccgaccccgccgaaaaagccgtcatcgccgccgccctcaaacgcgagcagcaaaaataccaactgcccctcgttgttgaaaacgaaccgctgaaaaacttctacgacgccgaggaataccatcaggactacctgattaaaaaccccaacggctactgccacatcgacatccgcaaagccgacgaaccgctgccgggcaaaaccaaagccgcaccgcaaggcaaaggcttcgacgcggcaacgtataaaaaaccgagtgacgccgaactcaaacgcaccctgaccgaagagcaataccaagtgacccaaaacagcgcgaccgaatacgccttcagccacgaatacgaccatttgttcaaacccggcatttatgtggacgttgtcagcggcgaacccctgttcagctccgccgacaaatatgattccggctgcggctggccgagcttcacgcgcccgattgatgcaaaatccgttaccgaacacgatgatttcagcttcaatatgcgccgcaccgaagtcagaagccgcgccgccgattcgcacttgggacacgtcttccccgacggccctcgcgacaaaggcagactgcgctactgcatcaacggcgcgagcttgaaattcatcccgctggaacaaatggacgcggcaggctacggcgcgttgaagggcaaagtgaaa

SEQ ID NO: 820 - protein, 532 aa, Neisseria gonorrhoeae
MQTVHTGNIKMKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAGGCFWGLEAYFQRIDGVVDAVSGYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSFNMRRTEVRSRAADSHLGHVFPDGPRDKGRLRYCINGASLKFIPLEQMDAAGYGALKGKVK

SEQ ID NO: 821 - DNA, 189 bp, Neisseria gonorrhoeae
atgccgaaaccttacggcccggattttcagacaaccttgccgcgcaaaatacgctacaatacgccctatttcaagtttctaaaattaaaaggaaaattcaatgttcagcttcttccgtcgcaagaaaaaacaggaaacgccggctctcgaggaggcccaagttcaggaaaccgcagcaaaagtagaatc

SEQ ID NO: 822 - protein, 63 aa, Neisseria gonorrhoeae
MPKPYGPDFQTTLPRKIRYNTPYFKFLKLKGKFNVQLLPSQEKTGNAGSRGGPSSGNRSKSRI

SEQ ID NO: 823 - DNA, 1041 bp, Neisseria gonorrhoeae
atgccgtctgaagcaggggaagcggctgaaaaagcggtggaacgcgttgaatccgcaaaagaagctgttgccgaaaccgtcggcgaggctgtcgggcaagttcaagaagccgttgcgacaactgaagaacacaagctcggttgggctgcgcgtttgaaacaaggcttggccaaatcacgcgacaaaatggcgaaatcgctggccggcgtgttcggcggcggacaaatcggcgaggatttgtacgaagagctggaaaccgtgctgattaccggcgatatgggcatggaggccaccgaatacctgatgaaagacgtgcgcggccgcgtcagcctcaaagggctgaaagacggcaacgaattgcgcggcgcgttgaaagaagccttgtacgacctgattaagccgttggaaaaaccgctggtcttgcccgaaactaaagagcctttcgtgattatgcttgccggtatcaacggcgcgggcaaaaccacgtctatcggcaaactcgccaaatatttccaagcgcagggcaaatccgtattgctggcggcaggcgatactttccgcgccgccgcgcgcgagcagcttcaggcttggggcgggcgcaacaatgtaaccgtcatttcacaaaccacgggcgattccgccgccgtgtgcttcgatgccgtccaagccgcgaaagcgcgcgggatcgacatcgtgcttgccgacaccgccggccgcctgcccacgcagcttcatttgatggaagaaatcaaaaaagtgaagcgcgtgctgcaaaaagccattcccggcgcgccgcacgaaatcatcgtcgtactcgatgccaatatcgggcaaaacgccgtcaaccaagtcaaagcctttgacgacgcattggggctgacggggcttatcgttaccaaactcgacggcacggcaaaaggcggcatcctcgccgcgcttgcttccgaccgccccgtccccgtccgctacatcggcgtgggcgaaggcatagacgacctgcgcccgtttgacgcgcgcgcgtttgtggacgcactgctggat

SEQ ID NO: 824 - protein, 347 aa, Neisseria gonorrhoeae
MPSEAGEAAEKAVERVESAKEAVAETVGEAVGQVQEAVATTEEHKLGWAARLKQGLAKSRDKMAKSLAGVFGGGQIGEDLYEELETVLITGDMGMEATEYLMKDVRGRVSLKGLKDGNELRGALKEALYDLIKPLEKPLVLPETKEPFVIMLAGINGAGKTTSIGKLAKYFQAQGKSVLLAAGDTFRAAAREQLQAWGGRNNVTVISQTTGDSAAVCFDAVQAAKARGIDIVLADTAGRLPTQLHLMEEIKKVKRVLQKAIPGAPHEIIVVLDANIGQNAVNQVKAFDDALGLTGLIVTKLDGTAKGGILAALASDRPVPVRYIGVGEGIDDLRPFDARAFVDALLD

SEQ ID NO: 825 - DNA, 258 bp, Neisseria gonorrhoeae
atgccgtccgaaaacggcagaccgaaccgtcattcccacggaagtgggaatctaggacgcggggtttgggcaaccgttttatccgataagtttccgtgcggacaggtccggatttccgcctgcgcgggaatgacgaatttcgagattgcggtgttgtcggacgggtttcgagattgcggtattgtcgggaatgacggttcgggtatttccccgcgcccgccccgcgcctgtaaacggcgggcgattaaaaatgccgtc

SEQ ID NO: 826 - protein, 86 aa, Neisseria gonorrhoeae
MPSENGRPNRHSHGSGNLGRGVWATVLSDKFPCGQVRISACAGMTNFEIAVLSDGFRDCGIVGNDGSGISPRPPRACKRRAIKNAV

SEQ ID NO: 827 - DNA, 195 bp, Neisseria gonorrhoeae
atgccgtctgaaccttcagacggcatttttaatcgcccgccgtttacaggcgcggggcgggcgcggggaaatacccgaaccgtcattcccgacaataccgcaatctcgaaacccgtccgacaacaccgcaatctcgaaattcgtcattcccgcgcaggcggaaatccggacctgtccgcacggaaacttatcgga

SEQ ID NO: 828 - protein, 65 aa, Neisseria gonorrhoeae
MPSEPSDGIFNRPPFTGAGRARGNTRTVIPDNTAISKPVRQHRNLEIRHSRAGGNPDLSARKLIG

SEQ ID NO: 829 - DNA, 681 bp, Neisseria gonorrhoeae; identical to SEQ ID NO: 53

SEQ ID NO: 830 - protein, 227 aa, Neisseria gonorrhoeae; identical to SEQ ID NO: 54

SEQ ID NO: 831 - DNA, 123 bp, Neisseria gonorrhoeae
ttgccttcacttgccgcctgcgctgccgaagagaagagaagagaagagaagagaagagaagagaagagaagagaagagaaggttttttgcgggctggattcattttcggctccttattcggtt

SEQ ID NO: 832 - protein, 41 aa, Neisseria gonorrhoeae
LPSLAACAAEEKRREEKRREEKRREEKVFCGLDSFSAPYSV

SEQ ID NO: 833 - DNA, 174 bp, Neisseria gonorrhoeae
ttgcgcttcaaggccctgcatgtgcctcattgccacccgtttaaacacggtttttatctgacaggcgcgcaatccgccccctcatttgttaatccgccatattgtattgaaacaccgcccggaacccgatataatccgcccttcaacatcagtgaaaatctttttttaaccggt

SEQ ID NO: 834 - protein, 58 aa, Neisseria gonorrhoeae
LRFKALHVPHCHPFKHGFYLTGAQSAPSFVNPPYCIETPPGTRYNPPFNISENLFLTG

SEQ ID NO: 835 - DNA, 714 bp, Neisseria gonorrhoeae
atgaactttgaaaacgacgacattatccatgcgccgaccacgtcttccctgattctcgaagagcggcacgattcggagctgttccgtgtttacgccctgattttggacggcattaccgatcaggtgctgctgcccggcaaaaagctgaccgaatccgaactttgccgtcagatggtgtgttcgcgcaacaccgtccgcggcgcgctgtcgcttttggcgcacgacaagattgtcgatttgcaacccaacaggggcgcgttcgtccacgttcccgatttgaaagaaatgcaggatgtgttcaatgcgcgcatcgaaatggagacgatgattttgaacatcctcgccggcctgccggatttggaaacgcgcctcaagccgctttatgcgatgataaggtgcgaagaagaggcctccggcaggggcgaccgcgtcggctggaaccgcctgtccaatgccttccacgtcgaactggcgcgcctggtgggcaacgatgtgctgttcgacattatgaacacgctgtgcgcgcggtcttccctgattgtcgccgtggcgggcgtgcatcgcgagaaaaaacacgccatcaatacgcatacgcattccgaacaccgcgaaatcctcgacctgctgctggcgggcaggcgcaaccgcgtggtcaaaatcctgcgccgccatttgggcaactgtatggagcgtttggaaaagactttggaagat

SEQ ID NO: 836 - protein, 238 aa, Neisseria gonorrhoeae
MNFENDDIIHAPTTSSLILEERHDSELFRVYALILDGITDQVLLPGKKLTESELCRQMVCSRNTVRGALSLLAHDKIVDLQPNRGAFVHVPDLKEMQDVFNARIEMETMILNILAGLPDLETRLKPLYAMIRCEEEASGRGDRVGWNRLSNAFHVELARLVGNDVLFDIMNTLCARSSLIVAVAGVHREKKHAINTHTHSEHREILDLLLAGRRNRVVKILRRHLGNCMERLEKTLED

SEQ ID NO: 837 - DNA, 144 bp, Neisseria gonorrhoeae
atgcagggccttgaagcgcaatcgatatattatttccaccggaacggacgaccccgcccgccttgcaaacccttaaaagacaagccgcccgggttgatccgggcggccgtgggaaatcacttaccgtttgatttatttaaaatt

SEQ ID NO: 838 - protein, 48 aa, Neisseria gonorrhoeae
MQGLEAQSIYYFHRNGRPRPPCKPLKDKPPGLIRAAVGNHLPFDLFKI

SEQ ID NO: 839 - DNA, 309 bp, Neisseria gonorrhoeae
atggccggaagacaacacttctgccggcgtggcatccccccctccgacatcaaaggcaaatatgttcaaagcgttacggtcgcaaacggcgtcgttaccgccgaaatgaaatcagacggcgtaaacaaagaaatcaaaggcaaaaaactctccctgtggggcaggcgtcaagacggttcggtaaaatggttctgcggacagccggttacgcgcaacgacgccaaagccgacgacgtcaaagccgacgccgccaacgccatcgaaaccaagcacctgccgtcaacctgccgcgatgaaccaactgccaaa

SEQ ID NO: 840 - protein, 103 aa, Neisseria gonorrhoeae
MAGRQHFCRRGIPPSDIKGKYVQSVTVANGVVTAEMKSDGVNKEIKGKKLSLWGRRQDGSVKWFCGQPVTRNDAKADDVKADAANAIETKHLPSTCRDEPTAK

SEQ ID NO: 841 - DNA, 294 bp, Neisseria gonorrhoeae
atgaatacccttcaaaaaggctttacccttatcgagctgatgattgtgatcgctatcgtcggcattttggcggcagtcgcccttcccgcctaccaagactacaccgcccgcgcgcaagtttccgaagccatccttttggccgaaggtcaaaaatcagccgttaccgggtattacctgaatcacggcatatggccggaagacaacacttctgccggcgtggcatccccccctccgacatcaaaggcaaatatgttcaaagcgttacggtcgcaaacggcgtcgttaccgccgaaa

SEQ ID NO: 842 - protein, 98 aa, Neisseria gonorrhoeae
MNTLQKGFTLIELMIVIAIVGILAAVALPAYQDYTARAQVSEAILLAEGQKSAVTGYYLNHGIWPEDNTSAGVASPPPTSKANMFKALRSQTASLPPK

SEQ ID NO: 843 - DNA, 99 bp, Neisseria gonorrhoeae
atgcgtttatctctatataattgtttttattttgtattttcttttaggtgggtgtggtttgcggaagtagggggcggcagtgtcgaaaattgtcagttt

SEQ ID NO: 844 - protein, 33 aa, Neisseria gonorrhoeae
MRLSLYNCFYFVFSFRWVWFAEVGGGSVENCQF

SEQ ID NO: 845 - DNA, 186 bp, Neisseria gonorrhoeae
gtgggaatgacgggatttaatgatgccgccggcaacgaaaaaatcgaaaccaagcacctgccgtcaacctgccgcgacgcttcatctgccggttgcatagaaacaccacgcgccgatttcaaatgctttccaagaaaacggagctttttaaaaaatagaaaattccccacccaacccaccctattc

SEQ ID NO: 846 - protein, 62 aa, Neisseria gonorrhoeae
VGMTGFNDAAGNEKIETKHLPSTCRDASSAGCIETPRADFKCFPRKRSFLKNRKFPTQPTLF

SEQ ID NO: 847 - DNA, 177 bp, Neisseria gonorrhoeae
ttgtcttttaagggtttgcaaggcgggcggggtcgtccgttccgaagccatccttttggccgaaggtcaaaaatcagccgttaccgggtattgcccgaatcacggcatatggccggaaaacttcgtcattcccgcgaaagcgggaatctaggtctgtcggcacggaaacttatcggg

SEQ ID NO: 848 - protein, 59 aa, Neisseria gonorrhoeae
LSFKGLQGGRGRPFRSHPFGRRSKISRYRVLPESRHMAGKLRHSRESGNLGLSARKLIG

SEQ ID NO: 849 - DNA, 93 bp, Neisseria gonorrhoeae
ttggccgaaggtcaaaaatcagccgttaccgggtattgcccgaatcacggcatatggccggaaaacttcgtcattcccgcgaaagcgggaatc

SEQ ID NO: 850 - protein, 31 aa, Neisseria gonorrhoeae
LAEGQKSAVTGYCPNHGIWPENFVIPAKAGI

SEQ ID NO: 851 - DNA, 420 bp, Neisseria gonorrhoeae
gtgccgacagacccggattcccgcctgcgcgggaatgacgaagccatccttttggccgaaggccaaaaatcagccgttgccgggtattgcccgaatcacggcaaatggcccgcaaacaacggtgatgccggcgtggcatcctccgccgaaatcaaaggcaaatatgttaaaagcgttacggtcgcaaacggcgtcgttaccgccgaaatggcttcaagcggcgtaaacaaagaaatcaaaggcaaaagactctccctgtgggccaggcgtcaagacggttcggtaaaatggttctgcggacagccggttacgcgcaacgacgccgccgacaacgacgacgtcgccaaagacgacgccgccggcaacgccatcgaaaccaagcacctgccgtcaacctgccgcgatgaaccaactgccacc

SEQ ID NO: 852 - protein, 140 aa, Neisseria gonorrhoeae
VPTDPDSRLRGNDEAILLAEGQKSAVAGYCPNHGKWPANNGDAGVASSAEIKGKYVKSVTVANGVVTAEMASSGVNKEIKGKRLSLWARRQDGSVKWFCGQPVTRNDAADNDDVAKDDAAGNAIETKHLPSTCRDEPTAT

SEQ ID NO: 853 - DNA, 2850 bp, Neisseria gonorrhoeae
atgaaactgtccgaactgttcaaccccaacgaatttgccgcgcggcatttgagtttcggcgacgaagcggcgttgcttgccgctgtcggcgagaagagcatggacgaatttgtcggcaacaccttgccgcaaagcatccgtatgccgtccgaactcgatttgcccgaagccctgaccgaggcggacgcattggcgaaattgaaaggcatcgcgtctaaaaacgtgatcaacaagtcctatatcggtttgggttattacccgacccgcgtgccgaacgtgattttgcgcaacgtattggaaaacccgggctggtacaccgcctacacgccgtatcaggcggagattgcccaaggtcgtttggaagcgttgttgaacttccagcaggtgtgcatcgatttgaccggtttccctgtggcaggcgcgtctttgttggacgaagcgaccgccgccgccgaagcgatggcgatggcgcaccgcgtgggcaaagtgaaatccgagcgtttctttgtggatgcgcgcgtgtatccgcaaactttggacgtgatgaaaacccgcgccaaatatttcggcttcgagctggtggtcagcgattttgcccaagcggatgaaggcgaatacttcggcgcgctgttccaatacgtcggtaaagacggcgacgtgcaagacttgcaggacgttatcggccgtctgaaagccaaaggcacaatcgttgctgttgccgccgacatcatgagcttggttttgctgaagtctccggctgaattgggcgcggatattgctttgggcaacacccaacgtttcggcgtaccgatgggctttggtggtccgcacgccgcttatttcgcgtttaaagacgagttcaaacgctccgccccgggccgcatcatcggcgtatccaaagacgcatcgggcaaacctgccttgcgcatggctttgtccacccgcgaacaacacatccgccgcgaaaaagcgacatccaatatttgtaccgcacaggcattgctggcgaacttggcgggcatgtacgccgtttatcacggccccaaaggcgtaaaacgcatcgccaaccgcattcacacactggcttccgtctttgccgacgcgctggtttcagacggcctcaaagtggttcacgaagtcttcttcgataccgttaccgtcgatttcggcagcaaagagaaagcagaccaagtgtttgccgctgctttggagtcgggttacaacctgcgcagcgtcaacaatactcaagttgcggctgcattccatgaaacgtcggtatacgaagatttggccgatttgtaccgcgcgtttaccggcaaggatacgttcacatttgccgatgatgtcaaaggccgtctgaatgccgaattactgcgtcaagacgacattctgcaacatcctgtgtacaacagttaccacaccgaacacgaaatgttgcgctacctgaaaaaactcgaagaccgcgacttggctatgaaccgcagcatgatttcgctcgggagctgcaccatgaagctcaatgcgactgcggaaatgttgccgattacttggactgagttctccgacatccacccttacgctcccgaagcgcaaaccgccggctaccgcgaattgcttgctgatatggaaaacagcctgaaagccatcaccggctttgacgcgatttccttccagcccaactccggcgcacaaggcgaatacagcggtatgctcgccatccgccgttatcaggaagcccaaggcgaagcacaccgcaacatctgcctgattcccaaatccgcccacggcaccaaccccgccaccgccgccatgctcggtttgaaagtcgtcgtcgtcgataccgacgaacacggcaacgtcaatattgacgatttgaaagccaaagccgaacaacaccgcgatgccttgtccgccatcatgattacctatccgtccacacacggcgtgtacgaagaaggcatccgcgacatctgccggatcattcacgaaaacggcggacaggtttacatggacggcgcaaacctcaatgcccaaatcggcatcatgcagcccgccgaagtcggcgcggacgtgttgcacatgaacctgcacaaaaccttctgtatccctcacggcggcggcggcccgggcatgggtccgattggcttgaaagcccacctcgccccgttcgcaccggggcataccctgaccgacacccacagcgcaagtgccgggcaaacctccgttgccgccgcagccttcggttctgcatccatcctgccgattacttggatgtacctgaccatgatgggcaaacaaggcatggaacaggcaacacgctgggcattgctcaacgccaactatgtcgctaaacgcttgagcgaagactatccgattctgtatacaggcaaaaacggccgcatcgcgcacgaatgcatcgtcgatttgcgtccgctcaaagccgaaagcggcatcaccgaaaccgacatcgccaaacgcctgatggactacggcttccacgcgccgacggtttccttccctgttgccggcacgctgatgatcgaaccgaccgagagcgaaagcaaagccgaactcgaccgcttcatcgccgccctgaaatccattcgccgcgaagtgcagaaagtcatcgacggcgaatggccgaaagacgacaacccactggtcaacgcgccgcacaccgccgcagatataaccggcgaatgggcgcatccgtactctcgcgaagaagccgtcttcccgctgcccttcgtgcgcgaacacaagttctggcccttcgtcaaccgcgtggacgacgtgtacggcgaccgcaacctcgtgtgcagctgcccgccgatggaaaattatgaagac

SEQ ID NO: 854 - protein, 950 aa, Neisseria gonorrhoeae
MKLSELFNPNEFAARHLSFGDEAALLAAVGEKSMDEFVGNTLPQSIRMPSELDLPEALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIANRIHTLASVFADALVSDGLKVVHEVFFDTVTVDFGSKEKADQVFAAALESGYNLRSVNNTQVAAAFHETSVYEDLADLYRAFTGKDTFTFADDVKGRLNAELLRQDDILQHPVYNSYHTEHEMLRYLKKLEDRDLAMNRSMISLGSCTMKLNATAEMLPITWTEFSDIHPYAPEAQTAGYRELLADMENSLKAITGFDAISFQPNSGAQGEYSGMLAIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTSVAAAAFGSASILPITWMYLTMMGKQGMEQATRWALLNANYVAKRLSEDYPILYTGKNGRIAHECIVDLRPLKAESGITETDIAKRLMDYGFHAPTVSFPVAGTLMIEPTESESKAELDRFIAALKSIRREVQKVIDGEWPKDDNPLVNAPHTAADITGEWAHPYSREEAVFPLPFVREHKFWPFVNRVDDVYGDRNLVCSCPPMENYED

SEQ ID NO: 855 - DNA, 477 bp, Neisseria gonorrhoeae
gggacgcaatatataaggagtgagtacctgttcttctattaaagaattaatcttttgaggcattttctgttgaagtttattaaacacatcttcagaaattccaaactgctttattatctcttccctaacccgttttttattttcttcccaagcctcgggtcttgttttgtataaatcctgtaattgctttttaactgcctgctttaaatcagttcggtaattatctgtaatatatttcttaacaacaggcatattatcgacggcgaggatgccgctattgtagtttttacccgtaatattgatttcgtcatacaaggcttcagatgatttttgatcggttttaccgctggagaaataatggaaaacaccgtttgccggcttgtctgaaaatgaaaaatcggcagtatcgccaacatttgtaggacgagtatccgaaccgggctgataactgaaagcaccgaagcaatcaaaagacac

SEQ ID NO: 856 - protein, 13 aa, Neisseria gonorrhoeae
GTQYIRSEYLFFY

SEQ ID NO: 857 - DNA, 129 bp, Neisseria gonorrhoeae
aacggttgcgcgaatatatttgtgtaaccgtgcatttgcatatcgtaaataaacgtaaataaaaataacaatataaatcagcatgttgcaactttgttttttattttgtgttgacgggcaacatatcat

SEQ ID NO: 858 - protein, 8 aa, Neisseria gonorrhoeae
NGCANIFV

SEQ ID NO: 859 - DNA, 90 bp, Neisseria gonorrhoeae
ttgcagcaaaatatcttcatcttgtgccgtgcagatggggcagggttgggcggtcatttttccttattcctgaaagtgtttaaaaaacgg

SEQ ID NO: 860 - protein, 30 aa, Neisseria gonorrhoeae
LQQNIFILCRADGAGLGGHFSLFLKVFKKR

SEQ ID NO: 861 - DNA, 423 bp, Neisseria gonorrhoeae
gtgcttcatcaccttagggaatcgttccctttgagccggggcggggcaacgccgtaccggtttttgttaatccgccatatcgtcgcaagatgcggtttgttgtttgcaacccttaaaggaaaaaccatgaaaaaaatgtttgtattgttctgtatgctgttctcctgcgccttctcccttgcggcggtaaacatcaatgcggcttcgcagcaggagctggaggcgctgccgggcataggcccggcgaaggcgaaggccattgcggaataccgcgcgcaaaacggcgcgttcaagtctgtggacgatttgatcaaggtgaagggcatcggtccggcggtgctggcgaagctgaaagaccaggcttccgtcggcgcgcccgcaccaaaaggccccgccaaaccggtgctgcctgcggttaaaaaa

SEQ ID NO: 862 - protein, 141 aa, Neisseria gonorrhoeae
VLHHLRESFPLSRGGATPYRFLLIRHIVARCGLLFATLKGKTMKKMFVLFCMLFSCAFSLAAVNINAASQQELEALPGIGPAKAKAIAEYRAQNGAFKSVDDLIKVKGIGPAVLAKLKDQASVGAPAPKGPAKPVLPAVKK

SEQ ID NO: 863 - DNA, 1023 bp, Neisseria gonorrhoeae
gtggaaacggatacattggcaaatactattgaaaaacatagcctgtttttccggttttatcgtattattccgaaacttaccccattgataaggaagcggtttatgctgcaaagaactttggcgaaatccatcggcgttaccggagtcgggctgcattcgggcgaacgcgtcgcgctgaccctgcaccccgcgcctgaaaacagcgggatttccttccgccgcaccgatttggacggcgagatgggcgaacaaatcaagctgaacccttatttgatcaacgatacccgcctttcatccaccatcgttaccgacaaaggcctgcgcgtcggcaccatcgaacacatcatgtccgcactgtccgcctacggcatcgacaatgcgctgattgagttgaacgcgcccgaaatcccgattatggacggctccagcctgccgtttatttacctcctgcaagatgcgggcgttgtagaccaaaaggcgcaaaagcgttttttgaaaatcctcaaacccgtcgaaatcaaagaagcgggcaaatgggtccgatttacgccgtatgacggttttaaggtaacgctgaccatcgaattcgaccatcctgttttcaaccgcagcccgcctacgtttgaaattgatttcgccggcaaatcctacatcggcgaaatcgcgcgcgcgcgcactttcggctttatgcacgaagtggaaatgatgcgcgcccacaatctcggcttaggcggcaatttgaacaacgccatcgtgattggcgacacggatgtcctgaatcctgaaggcttgcgctatcccgatgagtttgtgcgccacaaaatcctcgacgccatcggcgatttgtatatcgtcggacatccgattgtcggcgcgtttgaaggctacaaatcgggacacgccgtcaacaacgcccttttgcgcgcagttttggcagacgaaacggcttacgaatgggtggaatttgccgacagcgatgatttgcccgacgcatttcacgagctgaacatcagaaattgcgga

SEQ ID NO: 864 - protein, 341 aa, Neisseria gonorrhoeae
VETDTLANTIEKHSLFFRFYRIIPKLTPLIRKRFMLQRTLAKSIGVTGVGLHSGERVALTLHPAPENSGISFRRTDLDGEMGEQIKLNPYLINDTRLSSTIVTDKGLRVGTIEHIMSALSAYGIDNALIELNAPEIPIMDGSSLPFIYLLQDAGVVDQKAQKRFLKILKPVEIKEAGKWVRFTPYDGFKVTLTIEFDHPVFNRSPPTFEIDFAGKSYIGEIARARTFGFMHEVEMMRAHNLGLGGNLNNAIVIGDTDVLNPEGLRYPDEFVRHKILDAIGDLYIVGHPIVGAFEGYKSGHAVNNALLRAVLADETAYEWVEFADSDDLPDAFHELNIRNCG

SEQ ID NO: 865 - DNA, 153 bp, Neisseria gonorrhoeae
gtgcggaaacttatcgggaaaaaaggtttcttgagattttacgtcctggattcccgctttcgcgggaatgacgggatgtatagtgaattaaatttaaaccagtacggcgttgcctcgccttgccgtactgtccgcggcttcgccgccttgtcc

SEQ ID NO: 866 - protein, 51 aa, Neisseria gonorrhoeae
VRKLIGKKGFLRFYVLDSRFRGNDGMYSELNLNQYGVASPCRTVRGFAALS

SEQ ID NO: 867 - DNA, 126 bp, Neisseria gonorrhoeae
ttgcgcttcaaggccctgcatgtgcctcattgccacccgtttaaacacggtttttatctgacaggcgcgcaacccgccccctcatttgccgaacaagcggtccggactcccgcccgcgcgggaatc

SEQ ID NO: 868 - protein, 42 aa, Neisseria gonorrhoeae
LRFKALHVPHCHPFKHGFYLTGAQPAPSFAEQAVRTPARAGI

SEQ ID NO: 869 - DNA, 144 bp, Neisseria gonorrhoeae; identical to SEQ ID NO: 737

SEQ ID NO: 870 - protein, 48 aa, Neisseria gonorrhoeae; identical to SEQ ID NO: 738

SEQ ID NO: 871 - DNA, 276 bp, Neisseria gonorrhoeae
gtggcatccgcttcaacaatcaaaggcaaatatgttcagaaagttgaagtcgcaaaaggcgtcgttaccgcccaaatggcttcaaccggcgtaaacaaagaaatccaagacaaaaaactctccctgtgggccaagcgtcaagacggttcggtaaaatggttctgcggacagccggttacgcgcaccggcgacaacgacgacaccgttgccgacgccaacaacgccatcgacaccaagcacctgccgtcaacctgccgcgataaacatgatgccaaa

SEQ ID NO: 872 - protein, 92 aa, Neisseria gonorrhoeae
VASASTIKGKYVQKVEVAKGVVTAQMASTGVNKEIQDKKLSLWAKRQDGSVKWFCGQPVTRTGDNDDTVADANNAIDTKHLPSTCRDKHDAK

SEQ ID NO: 873 - DNA, 756 bp, Neisseria gonorrhoeae
ttggccgaaggtcaaaaatcagccgttaccgagtattacctgaatcacggcatatggccggaaaacaacgacaaggccggcgtggcatcttcttcatcaatcaaaggcaaatatgttaaggaagttaaagtcgaaaacggcgtcgtcaccgccacaatgaattcaagcaacgtaaacaaagaaatcaaagacaaaagactctccctgtgggccaagcgtgaaaacggttcggtaaaatggttctgcggacagccggttaagcgcgccaacgttgccgccgccaacgacgacgacgttaccgacgacaaaaacaacaacggcatcgacaccaagcacctgccgtcaacctgccgcgataaatcatctgccgtttgcacgaaacaccacgcgccgatttcaaacacttccaaaaaatcagccgttaccgagtattgcccgaatcacggcgaatggccgaaagacaacgacaaggccggcgtggcatcccccccctccaacatcaaaggcaaatatgttgaaagcgttacggtcacaaacggcgtcgttaccgccacaatgctttcaagcggcgtaaacaatgaaatcaaaggcaaaaaactctccctgtgggccaagcgtcaagccggttcggtaaaatggttctgcggacagccggttcagcgcgccaaagccgacgacgccgtcaccgccgacgccaacaacgccatcgacaccaagcacctgccgtcaacctgccgtgatacgtcatctgccaaa

SEQ ID NO: 874 - protein, 252 aa, Neisseria gonorrhoeae
LAEGQKSAVTEYYLNHGIWPENNDKAGVASSSSIKGKYVKEVKVENGVVTATMNSSNVNKEIKDKRLSLWAKRENGSVKWFCGQPVKRANVAAANDDDVTDDKNNNGIDTKHLPSTCRDKSSAVCTKHHAPISNTSKKSAVTEYCPNHGEWPKDNDKAGVASPPSNIKGKYVESVTVTNGVVTATMLSSGVNNEIKGKKLSLWAKRQAGSVKWFCGQPVQRAKADDAVTADANNAIDTKHLPSTCRDTSSAK

SEQ ID NO: 875 - DNA, 144 bp, Neisseria gonorrhoeae
ttgcttgctttcagtgtcatgagaaattttcctttgtcaagtgttaaagttataatgattatatactatatcacactacatcgcaatgaaaaatcgggaaaaacaaaaaacccctccgccgtcattcccgcgaaagcgggaatc

SEQ ID NO: 876 - protein, 48 aa, Neisseria gonorrhoeae
LLAFSVMRNFPLSSVKVIMIIYYITLHRNEKSGKTKNPSAVIPAKAGI

SEQ ID NO: 877 - DNA, 159 bp, Neisseria gonorrhoeae
ttgaccttcggccaaaaggatggcttcgtcattcccgcgcaggcgggaatccgggtctgtcggtacggaaacttatcgggtaaaacggtttctttagattttgcgttccggattcccactttcgcgggaatgacgggattaaagtttcaaaatttattc

SEQ ID NO: 878 - protein, 53 aa, Neisseria gonorrhoeae
LTFGQKDGFVIPAQAGIRVCRYGNLSGKTVSLDFAFRIPTFAGMTGLKFQNLF

SEQ ID NO: 879 - DNA, 141 bp, Neisseria gonorrhoeae
ttgtgggaatcttgtgggaatgatgaaattttgagttttaggaatttatcgggagcaacagaaaccgctccgccgtcattcccgcgcaggcgggaatcccgaccgatcggcgcagaaacttatcgggtaaaacggtttctt

SEQ ID NO: 880 - protein, 47 aa, Neisseria gonorrhoeae
LWESCGNDEILSFRNLSGATETAPPSFPRRRESRPIGAETYRVKRFL

SEQ ID NO: 881 - DNA, 531 bp, Neisseria gonorrhoeae
atgaatcatcgttgccgggtattgcctgaatcacggcgaatggccggaagacaacacttctgccggcgtggcatcccccccaccgacatcaaaggcaaatatgttaaaagcgttacggtcgcaaaaggcgtcgtcaccgccgaaatggcttcaaccggcgtaaacaatgaaatcaaaggcaaaaaactctccctgtgggccaagcgtcaagacggttcggtaaaatggttctgcggacagccggttaagcgcgccgacaacaacggcaacattaccgccgacaacggcaacgccatcgaaaccaagcacctgccgtcaacctgccgcgatgaatcatctgccgtttgcatagaaacaccacctacggctttctataaaaatacccaaaccgtcattcccacgaaagcgggaatccagaacgcaaaatctaaagaaaccgttttacccgataagtttctgcgccgatcggtcgggattcccgcctgcgcgggaatgacggcggagcggtttctgttgctcccgataaattcc

SEQ ID NO: 882 - protein, 177 aa, Neisseria gonorrhoeae
MNHRCRVLPESRRMAGRQHFCRRGIPPTDIKGKYVKSVTVAKGVVTAEMASTGVNNEIKGKKLSLWAKRQDGSVKWFCGQPVKRADNNGNITADNGNAIETKHLPSTCRDESSAVCIETPPTAFYKNTQTVIPTKAGIQNAKSKETVLPDKFLRRSVGIPACAGMTAERFLLLPINS

SEQ ID NO: 883 - DNA, 348 bp, Neisseria gonorrhoeae
gtgattcaggcaatacccggcaacgatgattcatcgcggcaggttgacggcaggtgcttggtgtcgattttggtgccggcggtgtcgtctttggcgacgtcgtcggtgccggctttggcgttggcttcggtgcgcttaaccggctgtccgcagaaccattttaccgaaccgttttcacgcttggcccacagggagagttttttgccttggatttctttgtttacgccggttgaagccatttcggcggtaacgacgccttttgcgaccgtaacgcttttaacatatttgcctttgatgtcggaggcggatgccacgccggccttgtcgttgttttccggccattcgccg

SEQ ID NO: 884 - protein, 116 aa, Neisseria gonorrhoeae
VIQAIPGNDDSSRQVDGRCLVSILVPAVSSLATSSVPALALASVRLTGCPQNHFTEPFSRLAHRESFLPWISLFTPVEAISAVTTPFATVTLLTYLPLMSEADATPALSLFSGHSP

SEQ ID NO: 885 - DNA, 306 bp, Neisseria gonorrhoeae
gtggcatccgcctccgacatcaaaggcaaatatgttaaaagcgttacggtcgcaaaaggcgtcgttaccgccgaaatggcttcaaccggcgtaaacaaagaaatccaaggcaaaaaactctccctgtgggccaagcgtgaaaacggttcggtaaaatggttctgcggacagccggttaagcgcaccgaagccaacgccaaagccggcaccgacgacgtcgccaaagacgacaccgccggcaccaaaatcgacaccaagcacctgccgtcaacctgccgcgatgaatcatcgttgccgggtattgcc

SEQ ID NO: 886 - protein, 102 aa, Neisseria gonorrhoeae
VASASDIKGKYVKSVTVAKGVVTAEMASTGVNKEIQGKKLSLWAKRENGSVKWFCGQPVKRTEANAKAGTDDVAKDDTAGTKIDTKHLPSTCRDESSLPGIA

SEQ ID NO: 887 - DNA, 378 bp, Neisseria gonorrhoeae
ttggccgaaggtcaaaaatcagccgttaccgggtattgcccgaatcacggcatatggccgaaagacaacacttctgccggcgtggcatcctccgccgccgacatcaaaggcaaatatgttcagaaagttgaagtcaacaacggcgtcgttaccgccacaatggcttcaagcaacgtaaacaaagaaatccaaggcaaaagactctccctgtgggccaagcgtgaaaacggttcggtaaaatggttctgcggacagccggttacgcgcgacgacaaagccaaagacgacgtcaaagccgacggcaccgccggcaccaaaatcgacaccaagcacctgccgtcaacctgccgcgatgaatcatcgttgccgggtattacc

SEQ ID NO: 888 - protein, 126 aa, Neisseria gonorrhoeae
LAEGQKSAVTGYCPNHGIWPKDNTSAGVASSAADIKGKYVQKVEVNNGVVTATMASSNVNKEIQGKRLSLWAKRENGSVKWFCGQPVTRDDKAKDDVKADGTAGTKIDTKHLPSTCRDESSLPGIT

SEQ ID NO: 889 - DNA, 198 bp, Neisseria gonorrhoeae
atgcccgacggtctttatagcggattaacaaaaatcaggacaaggcggcgaagtcattgcggtattcgcatcataggccggaaaaatccggcctccgtcattcccgcgaaagcgggaatccggaacgcaaaatctaaagaaaccgttttcccgataagtttccgtgccgacagacccggattcccgcctgcgcgggaa

SEQ ID NO: 890 - protein, 66 aa, Neisseria gonorrhoeae
MPDGLYSGLTKIRTRRRSHCGIRIIGRKNPASVIPAKAGIRNAKSKETVFPISFRADRPGFPPARE

SEQ ID NO: 891 - DNA, 378 bp, Neisseria gonorrhoeae
gtgggtaatctttgccgctttgcccaacataatcgaagccgaacagtatttttcggcagacatctgaacggcgcgctcaatggccgattctttcaaatcatgcccgattaccttgaaatggatgtggatttcggtaaacacgcgcggcgcatcgtccgcccgtttcgccgtaaccgtcgcacggcagtcagtcactttctgacgctgtttttcggcaatcattaccacatcgatgctcgaacagcccgccacccccaacagcagcatttccaaagggctgggcccgcgcttggccgcgccttctgccgccgatccctccataacgacgctgtgcccgccttccgccgtgccgacaaaacacattccgtctatccattt

SEQ ID NO: 892 - protein, 126 aa, Neisseria gonorrhoeae
VGNLCRFAQHNRSRTVFFGRHLNGALNGRFFQIMPDYLEMDVDFGKHARRIVRPFRRNRRTAVSHFLTLFFGNHYHIDARTARHPQQQHFQRAGPALGRAFCRRSLHNDAVPAFRRADKTHSVYPF

SEQ ID NO: 893 - DNA, 90 bp, Neisseria gonorrhoeae
tccgcctgattttatcacgtttcccaagcggtttgcctgtacaataccgcttttcggaagggtgtgggcgatgatgttttcttggttcaa

SEQ ID NO: 894 - protein, 27 aa, Neisseria gonorrhoeae
FYHVSQAVCLYNTAFRKGVGDDVFLVQ

SEQ ID NO: 895 - DNA, 591 bp, Neisseria gonorrhoeae
ttgtacggcagccgccgtttgccatgcgcccaaacagatgcggatggcgcgcaaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagtgggaaaagataccggcgcttatctttggtgtccgcacaagccgacaaccggccgattgctccggtggtttgtcaaaatacggtggccggggtcttttttgaagcgcggtttcagcaatgcctactgcccgcattggctcaaaaatcggtgattatttcagataatgcgcgatttcgccgtatgggtgccttacggggaacggcggaaaaattgggacataaggtattgcctcccgcaccttattcacccgagcccaacccgattgagaaagtgtgggcgaatattaagcggtatctgcgaaccgttttgtctgattacgcccgatttgacgatgcactactgtcctattttgattttaat

SEQ ID NO: 896 - protein, 197 aa, Neisseria gonorrhoeae
LYGSRRLPCAQTDADGAQKKTAAYKGQDPAKVTHYLTRPAGFSDCQRVCPDETGFDRRLFRPYARSLKGQMAKARISGKRYRRLSLVSAQADNRPIAPVVCQNTVAGVFFEARFQQCLLPALAQKSVIISDNARFRRMGALRGTAEKLGHKVLPPAPYSPEPNPIEKVWANIKRYLRTVLSDYARFDDALLSYFDFN

SEQ ID NO: 897 - DNA, 219 bp, Neisseria gonorrhoeae
ttgttcggcaaatgggggggcggattgcgcgcctgtcagataaaaaccgtgtttaaacgggtggcaatgaggtacatgcagggccttgaagcgcaatcgatatattatttccaccggaacggacgaccccgcccgccttgcaaacccttaaaagacaagccgcccgggttgatccgggcggccgtgggaaatcacttaccgcttgatttatttaaaatt

SEQ ID NO: 898 - protein, 73 aa, Neisseria gonorrhoeae
LFGKWGGGLRACQIKTVFKRVAMRYMQGLEAQSIYYFHRNGRPRPPCKPLKDKPPGLIRAAVGNHLPLDLFKI

SEQ ID NO: 899 - DNA, 285 bp, Neisseria gonorrhoeae
gtggcatcccccgccgacaaaatcaaaggcaaatatgttcagaaagttgaagtcgcaaaaggcgtcgttaccgccgaaatgaaaccaagcggcgtaaacaaagaaatcaaaggcaaaaaactctccctgtgggccaagcgtgaagacggttcggtaaaatggttctgcggacagccggttaagcgcgacgccggcgccaaagccgacgacgtcaaagccgacgccgccaacgccatcgaaaccaagcacctgccgtcaacctgccgcgatgaatcatctgccacc

SEQ ID NO: 900 - protein, 95 aa, Neisseria gonorrhoeae
VASPADKIKGKYVQKVEVAKGVVTAEMKPSGVNKEIKGKKLSLWAKREDGSVKWFCGQPVKRDAGAKADDVKADAANAIETKHLPSTCRDESSAT

SEQ ID NO: 901 - DNA, 684 bp, Neisseria gonorrhoeae
atgctttcaagcggcgtaaacaatgaaatcaaaggcaaaaaactctccctgtgggccaggcgtgaaaacggttcggtaaaatggttctgcggacagccggttacgcgcgccaaagccgacgccgacgccgacgccgccggcaaagacaccaccaacatcgacaccaagcacctgccgtcaacctgccgcgatgaatcatctgccgtttgcacgaaacaccacgcgccgatttcaaacacttccaaaaaatcagccgttaccgggtattgcccgaatcacggcaaatggccgaaagacaacacttctgccggcgtggcatcccccgccgaaatcaaaggcaaatatgttaaaagcgttacggtcgcaaaaggcgtcgttaccgcccaaatgaatccaagcggcgtaaacaatgaaatcaaagacaaaaaactctccctgtgggccaagcgtgaaaacggttcggtaaaatggttctgcggacagccggttacgcgcaacgacgccaaagccgacgccaaagacgacaccgtcaccgccatcgaaaccaagcacctgccgtcaacctgccgcgatgaatcatctgccggttgcataaaaacaccacgcgccgatttcaaacacttccaaaaaatcagccgttgccgggtattgcccgaatcacggcacatggccgaaagacaacgg

SEQ ID NO: 902 - protein, 228 aa, Neisseria gonorrhoeae
MLSSGVNNEIKGKKLSLWARRENGSVKWFCGQPVTRAKADADADAAGKDTTNIDTKHLPSTCRDESSAVCTKHHAPISNTSKKSAVTGYCPNHGKWPKDNTSAGVASPAEIKGKYVKSVTVAKGVVTAQMNPSGVNNEIKDKKLSLWAKRENGSVKWFCGQPVTRNDAKADAKDDTVTAIETKHLPSTCRDESSAGCIKTPRADFKHFQKISRCRVLPESRHMAERQR

SEQ ID NO: 903 - DNA, 171 bp, Neisseria gonorrhoeae
ttgaataaaatacatttgcacggccggttaggtttgcccgccggaatattaaaacaccgcccaaaaaaatcagccgttgccgggtattgcccgaatcacggcaaatggccggaaaacaacacttctgccggcgtggcatccccccccctccgacatcaaaggcaaatatgt

SEQ ID NO: 904 - protein, 57 aa, Neisseria gonorrhoeae
LNKIHLHGRLGLPAGILKHRPKKSAVAGYCPNHGKWPENNTSAGVASPPLRHQRQIC

SEQ ID NO: 905 - DNA, 99 bp, Neisseria gonorrhoeae
ttgggcggtgttttaatattccggcgggcaaacctaaccggccgtgcaaatgtattttattcaataatcccggctttcatgcaaacagaagcaagcggc

SEQ ID NO: 906 - protein, 33 aa, Neisseria gonorrhoeae
LGGVLIFRRANLTGRANVFYSIIPAFMQTEASG

SEQ ID NO: 907 - DNA, 558 bp, Neisseria gonorrhoeae
atgaatcatcgttgccgggtattgcctgaatcacggcgaatggccggaagacaacacttctgccggcgtggcatcccccccaccgacatcaaaggcaaatatgttaaaagcgttacggtcgcaaaaggcgtcgtcaccgccgaaatggcttcaaccggcgtaaacaatgaaatcaaaggcaaaaaactctccctgtgggccaagcgtcaagacggttcggtaaaatggttctgcggacagccggttaagcgcgacgccggcgccaaaaccggcgccgacgacgtcaaagccgacggcaaagacaccgacaaaatcaacaccaagcacctgccgtcaacctgccgcgataaatcatctgccgtttgcacgaaacaccacgcgccgatttcaaacacttccaaaaaatcagccgttgccgggtattgcccgaatcacggcacatggccgaaaaacttcgtcattcccgcgaaagcgggaatccaggtctgtcggcacggaaacttatcgggtaaaaaggtttctccggtcctgagtcctggattcccactttcgtgggaa

SEQ ID NO: 908 - protein, 186 aa, Neisseria gonorrhoeae
MNHRCRVLPESRRMAGRQHFCRRGIPPTDIKGKYVKSVTVAKGVVTAEMASTGVNNEIKGKKLSLWAKRQDGSVKWFCGQPVKRDAGAKTGADDVKADGKDTDKINTKHLPSTCRDKSSAVCTKHHAPISNTSKKSAVAGYCPNHGTWPKNFVIPAKAGIQVCRHGNLSGKKVSPVLSPGFPLSWE

SEQ ID NO: 909 - DNA, 387 bp, Neisseria gonorrhoeae
ttggccgaaggtcaaaaatcagccgttaccgagtattacctgaatcacggcgaatggcccaaagacaacggctctgccggcgtggcatccgcttcaaaaatcataggcaaatatgttaaggaagttaaagtcgaaaacggcgtcgtcaccgcccaaatggcttcaagcaacgtaaacaaagaaatcaaagacaaaaaactctccctgtgggccaagcgtgaaaacggttcggtaaaatggttctgcggacagccggttaagcgcaccgaagccaacgccaaagccggcaccgacgacgtcgccaaagacgacaccgccggcaccaaaatcgacaccaagcacctgccgtcaacctgccgcgatgaatcatcgttgccgggtattgcc

SEQ ID NO: 910 - protein, 129 aa, Neisseria gonorrhoeae
LAEGQKSAVTEYYLNHGEWPKDNGSAGVASASKIIGKYVKEVKVENGVVTAQMASSNVNKEIKDKKLSLWAKRENGSVKWFCGQPVKRTEANAKAGTDDVAKDDTAGTKIDTKHLPSTCRDESSLPGIA

SEQ ID NO: 911 - DNA, 384 bp, Neisseria gonorrhoeae
tccctgcatccggcggctgatgtagtcggcaatcaaatcccgcttttcccaaaaaaacttctgcattttttgttcggaatacagtttgcggaccagagtgggcagaccgctgtggacgatggcggcgatttctttgttgccttcttcttcctgcattgccgtctgaaaatccaaacccctgcctttcagatatgctgcaaggcggttgcggatgtgtgaattgagttcgatggatttgagcattttgcctccgttttgcggtaaggatttattcgatttgtttatccgcctgattttatcacgtttcccaagcggtttgcctgtacaataccgcttttcggaagggtgtgggcgatgatgttttcttggttcaagctgtttcac

SEQ ID NO: 912 - protein, 72 aa, Neisseria gonorrhoeae
SLHPAADVVGNQIPLFPKKLLHFLFGIQFADQSGQTAVDDGGDFFVAFFFLHCRLKIQTPAFQICCKAVADV

SEQ ID NO: 913 - DNA, 459 bp, Neisseria gonorrhoeae
atgcaaagcggttttaacgctattttcgggaatgacaccatgcaggttacatcaaaatggatagacggaatgtgttttgtcggcacggcggaaggcgggcacagcgtcgttatggagggatcggcggcagaaggcgcggccaagcgcgggcccagccctttggaaatgctgctgttgggggtggcgggctgttcgagcatcgatgtggtaatgattgccgaaaaacagcgtcagaaagtgactgactgccgtgcgacggttacggcgaaacgggcggacgatgcgccgcgcgtgtttaccgaaatccacatccatttcaaggtaatcgggcatgatttgaaagaatcggccattgagcgcgccgttcagatgtctgccgaaaaatactgttcggcttcgattatgttgggcaaagcggcaaagattacccacagttttgaaattgccggggcggagaaa

SEQ ID NO: 914 - protein, 153 aa, Neisseria gonorrhoeae
MQSGFNAIFGNDTMQVTSKWIDGMCFVGTAEGGHSVVMEGSAAEGAAKRGPSPLEMLLLGVAGCSSIDVVMIAEKQRQKVTDCRATVTAKRADDAPRVFTEIHIHFKVIGHDLKESAIERAVQMSAEKYCSASIMLGKAAKITHSFEIAGAEK

SEQ ID NO: 915 - DNA, 687 bp, Neisseria gonorrhoeae
atgacctccctgattcacaccctttcagacggcatagaactgaccgtcgaaatcaaccgccgtgccaagaaaaacctgattatccgccctatcggcacacataccgtccgcatcagcgtcccaccctgcttctccgtctccgccctcaaccgctggctgtatgaaaacgaagccgtcctgcggcgaacactggcgaaaacaccgccgcacaatacggcaaaccgactgcccgaacatatctggttccacggcaggcagcttgcccttaccgcccatcaagacacgcaaatcctgctgatgccgtctgaaatccgcgtccccgaaggcgcgcccgaaaaacagcttgcgctgctgcgggactttttggaacggcaggcgcacagttacctgattccccgtctcgaacgccacgcccgcgccacgcaactgttccccgcctcctcctcgctgacctccgccaaaaccttctggggcgtgtgccgcaaaaccacaggcatacgcctcaaccggcggctggtcggcgcacccgaatacgttgccgactatgtctgcatacacgaactctgccacctcgcccatcccgaccacagccccgccttttgggaactgacccgccgcttcgccccctacacgcccgaagcaaaacagcggatcaaaatccacggcagggagcttttcgccttgggc

SEQ ID NO: 916 - protein, 229 aa, Neisseria gonorrhoeae
MTSLIHTLSDGIELTVEINRRAKKNLIIRPIGTHTVRISVPPCFSVSALNRWLYENEAVLRRTLAKTPPHNTANRLPEHIWFHGRQLALTAHQDTQILLMPSEIRVPEGAPEKQLALLRDFLERQAHSYLIPRLERHARATQLFPASSSLTSAKTFWGVCRKTTGIRLNRRLVGAPEYVADYVCIHELCHLAHPDHSPAFWELTRRFAPYTPEAKQRIKIHGRELFALG

SEQ ID NO: 917 - DNA, 741 bp, Neisseria gonorrhoeae
atgctcatcatccgcaacctgatttactggctgatactctgttccagcctgattttcctctttccctttatgctgctcgcctcgcctttccgggacggggcgcacaagatggcgcgggtctgggtcggcatcctcaactggtcgctcaaacacatcgtcgggctcaaataccgcatcatcggcgcggaacacattccggaccgcccctccgtcatctgcgccaaacaccaaagcggctgggaaacgctcgcgctccaagagatttttccgccgcaggtttacgttgccaagcgcgagttgttcaaaatcccctttttcggctggggcttgaaactggtcaaaaccataggcatagaccgcaacaaccgccgcgaagccaacgaacagctcataaaacagggtttggcgcgcaaaaacgaaggttattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaattcctttctgaaatatccgggggaaatcaccgtcatcatctgtccgaccatcccgcacgcaagcggcagcgaagccgaattgatggaaaaatgcgaacacctcattgaaacgcaacaaccgcttatttccggcgcaggcccgtttgccgccgaaatgccgtctgaaaccgca

SEQ ID NO: 918 - protein, 247 aa, Neisseria gonorrhoeae
MLIIRNLIYWLILCSSLIFLFPFMLLASPFRDGAHKMARVWVGILNWSLKHIVGLKYRIIGAEHIPDRPSVICAKHQSGWETLALQEIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVIICPTIPHASGSEAELMEKCEHLIETQQPLISGAGPFAAEMPSETA

SEQ ID NO: 919 - DNA, 564 bp, Neisseria gonorrhoeae
gtgatgaaactcatcattctcgaccgcgacggcgtcatcaaccgggaccgcgacgacttcgtcaaatccgccgacgagtggatacctgtcgaaggcagcatggatgcggtggcattcctgacgcaggcaggctgcaccgttgccgtcgccaccaaccaatccggcatcggccgcaaatattttaccgttcaagacctcaccgaaatgcatgccaaaatgcaccgcctcatccgtcaggcaggcggggaaatcgacggcatctggttctgcccgcataccggcgccgacggctgcaactgccgcaagcccaaaccgggcatgattgaagacatcctcgaacgcttcaacgcccaagcttcggaaacttggctggtcggcgacagcctgcgcgatttgcaggcaatcgatgccgtcggcggaaaacccgcgctggttctgaccggaaaaggcaaaaaaacgctctcccaacacggacacgaattgcccggacacacacaggttttcgataccctgctcgatttctcacaatacatcatgcaggaaaacgccgcaccgcaagccgac

SEQ ID NO: 920 - protein, 188 aa, Neisseria gonorrhoeae
VMKLIILDRDGVINRDRDDFVKSADEWIPVEGSMDAVAFLTQAGCTVAVATNQSGIGRKYFTVQDLTEMHAKMHRLIRQAGGEIDGIWFCPHTGADGCNCRKPKPGMIEDILERFNAQASETWLVGDSLRDLQAIDAVGGKPALVLTGKGKKTLSQHGHELPGHTQVFDTLLDFSQYIMQENAAPQAD

SEQ ID NO: 921 - DNA, 567 bp, Neisseria gonorrhoeae
gtgtccgggcaattcgtgtccgtgttgggagagcgtttttttgccttttccggtcagaaccagcgcgggttttccgccgacggcatcgattgcctgcaaatcgcgcaggctgtcgccgaccagccaagtttccgaagcttgggcgttgaagcgttcgaggatgtcttcaatcatgcccggtttgggcttgcggcagttgcagccgtcggcgccggtatgcgggcagaaccagatgccgtcgatttccccgcctgcctgacggatgaggcggtgcattttggcatgcatttcggtgaggtcttgaacggtaaaatatttgcggccgatgccggattggttggtggcgacggcaacggtgcagcctgcctgcgtcaggaatgccaccgcatccatgctgccttcgacaggtatccactcgtcggcggatttgacgaagtcgtcgcggtcccggttgatgacgccgtcgcggtcgagaatgatgagtttcatcacggttcctttgggttgggcgggttcggggatggcattatactgaaatatcggtggaaatgcgcctgtgctgcatta

SEQ ID NO: 922 - protein, 189 aa, Neisseria gonorrhoeae
VSGQFVSVLGERFFAFSGQNQRGFSADGIDCLQIAQAVADQPSFRSLGVEAFEDVFNHARFGLAAVAAVGAGMRAEPDAVDFPACLTDEAVHFGMHFGEVLNGKIFAADAGLVGGDGNGAACLRQECHRIHAAFDRYPLVGGFDEVVAVPVDDAVAVENDEFHHGSFGLGGFGDGIILKYRWKCACAAL

SEQ ID NO: 923 - DNA, 1650 bp, Neisseria gonorrhoeae; identical to SEQ ID NO: 233

SEQ ID NO: 924 - protein, 550 aa, Neisseria gonorrhoeae; identical to SEQ ID NO: 234

SEQ ID NO: 925 - DNA, 426 bp, Neisseria gonorrhoeae
atgatgttttcttggttcaagctgtttcacttgttttttgtcatttcgtggtttgcagggctgttttacctgccgaggattttcgtcaatatggcgatgattgatgcgccgcgcggcaatcccgagtatgtgcgcctgtcggggatggcggtgcggttgtaccgttttatgtcgcctttgggtttcggcgcggtcgtgttcggcgcggcgataccgtttgccgccggccggtggggcagcggctgggttcacgtcaaactgtgtttgggcttgatgctcttggcttatcagttgtattgcggcgtgctgctgcgccgttttcaggattacagcaatgctttttcacaccgctggtaccgcgtgttcaacgaaatccccgtgctgctgatggttgccgcgctgtatctggtcgtgttcaaaccgttt

SEQ ID NO: 926 - protein, 142 aa, Neisseria gonorrhoeae
MMFSWFKLFHLFFVISWFAGLFYLPRIFVNMAMIDAPRGNPEYVRLSGMAVRLYRFMSPLGFGAVVFGAAIPFAAGRWGSGWVHVKLCLGLMLLAYQLYCGVLLRRFQDYSNAFSHRWYRVFNEIPVLLMVAALYLVVFKPF

SEQ ID NO: 927 - DNA, 1197 bp, Neisseria gonorrhoeae
atgccgtttgaaacccgccggcggcttcaggcggcattgccgcaacaaacggcaaccgtattccggcacacagcgcattaccctaccccctcacgcacaaatcccgccccgacaggcgcgggacgcaaccataaaggaacaatgatgaagctcaaaatagacattgcaaccaacaacttcaaacacggcggcggcacggaacgctacacattggatttggtaaagggtctgaacagacaaaacatcacaccggccgtttatgcgacgaaatttgatcacggcattcccgaatacgccatgatcgaaccccatcttgtcgatcaacgccggacgctgaaaaaactacgctcgttcctcttttcaagccggctcgctcaaaccagaaaaaacagtgccgccaaactgattgcctgccaccacgccgattacgccgacctcctcatctgcggcggcacgcacttgggctacctgcaccatatggcgcaaaaaccgaacctgctcgaccgcctcgccatacgccgcaaccgcagcaactacgccaccgccaaactgattgtggcgcattcccatatgatgcggcgcgaactggtcggactatacggcgttccccccgaaagaatccaagtcgcccccccccccgcagatacggaacgcttctttccacaacctagagaaactgccgccctgcgcgccaaatacggttttgccgaccatgaaaccgttttcctattcccatcgaccggccacacgcgcaaaggcctggaactgctcgccgactttttcgaacaaaccgaactgcccgtcaagctcgccgttgccggttcaccgcttccccgcccgatgaaaaacgtcgtcggactgggcttctgcaccgatatgcccgaactctaccgcgccgccgactttaccattatggcatccctgtacgaacccttcgggctggtcggtgtcgaatccgccctatgcggcacacgcgtcgtcctctccgaaaacatggcatgtacagaggtcatgaacgaagaagccggattctttttctcacgacaaaacccggaaaccctcgcgcaagccgttgcccaagccgtcagccttaaaaaacagggcggacaccgcctgtccgacccgatgcgggcgctgaactacaacccgtccctgtcgcaccacatcgaccgactgaccgacatgctggcatccgta

SEQ ID NO: 928 - protein, 399 aa, Neisseria gonorrhoeae
MPFETRRRLQAALPQQTATVFRHTAHYPTPSRTNPAPTGAGRNHKGTMMKLKIDIATNNFKHGGGTERYTLDLVKGLNRQNITPAVYATKFDHGIPEYAMIEPHLVDQRRTLKKLRSFLFSSRLAQTRKNSAAKLIACHHADYADLLICGGTHLGYLHHMAQKPNLLDRLAIRRNRSNYATAKLIVAHSHMMRRELVGLYGVPPERIQVAPPPADTERFFPQPRETAALRAKYGFADHETVFLFPSTGHTRKGLELLADFFEQTELPVKLAVAGSPLPRPMKNVVGLGFCTDMPELYRAADFTIMASLYEPFGLVGVESALCGTRVVLSENMACTEVMNEEAGFFFSRQNPETLAQAVAQAVSLKKQGGHRLSDPMRALNYNPSLSHHIDRLTDMLASV

SEQ ID NO: 929 - DNA, 1338 bp, Neisseria gonorrhoeae
atgccgtctgaaagccttttcgggcggcgcggcgcaaataccttacaaacccttacactttacggcataatgcaggctgtttttcccgaggaggcttatatgtccgccaaaactccgtcgctcttcggcggcgcgatgattatcgccggtacggtcatcggcgcaggtatgctcgccaaccccaccgccacctccggcgtatggtttacaggctcgctgattgtgctgctgtacacctggttttccatgctctccggcggcctgatgattttggaagtcaacacccactacccccgcggcgcaagtttcgacaccatggtcaaagacctgctcggacgcggctggaacatcatcaacggcatcgccgtcgccttcgtcctatacctgctcacctacgcctacatcttcgtcggcggcgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacgttggttgccttggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggataaaatattgtccctattttcctacatggcaatcgccacctcgtttttaggcgtaaccttaggcctgttcgactacatcgccgacatcttcaaatggaacgacagcatgtccggccgcaccaaaaccgccgcgctgaccttcctgccgcccctgatttcctgcctgctcttccccaccggcttcgttaccgccatcggctgcgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgccaacatcgccgcacaggtattgagccaaatggaactcgtccccgtatttaaagga

SEQ ID NO: 930 - protein, 446 aa, Neisseria gonorrhoeae
MPSESLFGRRGANTLQTLTLYGIMQAVFPEEAYMSAKTPSLFGGAMIIAGTVIGAGMLANPTATSGVWFTGSLIVLLYTWFSMLSGGLMILEVNTHYPRGASFDTMVKDLLGRGWNIINGIAVAFVLYLLTYAYIFVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQGNLPRNEFAPVIAAEGQVSVLIETLSKFAQTGNMDKILSLFSYMAIATSFLGVTLGLFDYIADIFKWNDSMSGRTKTAALTFLPPLISCLLFPTGFVTAIGCVGLAATVWTGIIPAMLLYRSRKKFGAGKTYKVYGGLWLMVWVFLFGIANIAAQVLSQMELVPVFKG

SEQ ID NO: 931 - DNA, 747 bp, Neisseria gonorrhoeae
ttgagtggggcggttcgtcagatgggagggaaaatgtccgacaaaaaatataatgtcgatgagggagaaatcgccaagttcagccggattgccgacaaatggtgggacaagtcgggcgagttcaaaaccttgcacgacatcaatccgctgcggctggattatatcgacggacacgcggatttgcgcggcaaacgggttttagatgtaggctgtggcggcggcatcctcgcggaaagcatggcgcggcgcggcgcggcgtttgtcaaaggtatcgacatggcggagcagtcgttggaaaccgcccgcctgcacgcggctttgaacaatgtcgccgatatcgaatacgaatgtgtccgcgtggaagaccttgccggggcggaaccgcactcgttcgatgtggtaacgtgcatggaaatgatggagcacgtccccgatcccgccgccatcgtgcgtgcctgtgccaagctggtcaggccggacagcatggtgtttttttccaccatcaataaaaacccgaaatcgtacctgcatctgattgtggcggcggaatatctgttgaagtttgtccccaaaggtacgcacgactggaaaaaattcatctcgcctgccgagctggcgcggatgtgccgtcaggcgggcttggatgtggcggatacgaagggtatgacttaccatgtgttgtcgcaaacttatgccctgtgcgattcgaccgatgtgaattatatgtttgcctgccgtccggcgttc

SEQ ID NO: 932 - protein, 249 aa, Neisseria gonorrhoeae
LSGAVRQMGGKMSDKKYNVDEGEIAKFSRIADKWWDKSGEFKTLHDINPLRLDYIDGHADLRGKRVLDVGCGGGILAESMARRGAAFVKGIDMAEQSLETARLHAALNNVADIEYECVRVEDLAGAEPHSFDVVTCMEMMEHVPDPAAIVRACAKLVRPDSMVFFSTINKNPKSYLHLIVAAEYLLKFVPKGTHDWKKFISPAELARMCRQAGLDVADTKGMTYHVLSQTYALCDSTDVNYMFACRPAF

SEQ ID NO: 933 - DNA, 882 bp, Neisseria gonorrhoeae
atgcgcggcttcctgagcggttacgatttgggggaatttgtttccctgcagggcattgcgcaggggattaccaacagcaattattttctgacgacgacttcgggacgttatgtgctgaccgtgtttgaagtgttgaaacaggaagagctgccgttttttctggagcttaaccggcatttgagtatgaagggcgtggcggttgccgcgccggttgcgcgcaaagacggccggctcgattccgttttggcgggcaagccggcctgcctggttgcctgcctgaaaggttcggataccgcgctgccgacggctgagcagtgtttccataccggtgcgatgttggcgaaaatgcaccttgccgccgccgatttccctttggaaatggaaaacccgcgttacgatgcgtggtggacggaagcgtgcgcccggctgctgcccgtcctgtcgcaagacgatgccgcgctgctgtgttccgaaatcgatgcgctgaaggacaatctcggcaaccatctgccttcgggcatcatccacgccgacctgtttaaagacaatgtgttgcttgacggcggtcaggtatcgggcttcatcgatttctattatgcctgccggggcaattttatgtatgacttggcgattgcggtcaacgattgggcaaggacggcggacaataagttggatgaggcgttgaaaaaggcgtttgtcggcggttatgagggcgtgcgccccttgagtgccggagaaaaggcgtatttcccgaccgcccaacgcgccggctgcatccgtttttgggtgtcgcgcctgttggattttcattttccgcaggcgggcgagatgacgtttatcaaagacccgaacgcgttccgcaacctgctgttgagtttggat

SEQ ID NO: 934 - protein, 294 aa, Neisseria gonorrhoeae
MRGFLSGYDLGEFVSLQGIAQGITNSNYFLTTTSGRYVLTVFEVLKQEELPFFLELNRHLSMKGVAVAAPVARKDGRLDSVLAGKPACLVACLKGSDTALPTAEQCFHTGAMLAKMHLAAADFPLEMENPRYDAWWTEACARLLPVLSQDDAALLCSEIDALKDNLGNHLPSGIIHADLFKDNVLLDGGQVSGFIDFYYACRGNFMYDLAIAVNDWARTADNKLDEALKKAFVGGYEGVRPLSAGEKAYFPTAQRAGCIRFWVSRLLDFHFPQAGEMTFIKDPNAFRNLLLSLD

SEQ ID NO: 935 - DNA, 1554 bp, Neisseria gonorrhoeae
atgccgtccgaaaccctttcagacggcatttctgtcaaacgccggacgcactcaatccaaactcaacagcaggttgcggaacgcgttcgggtctttgataaacgtcatctcgcccgcctgcggaaaatgaaaatccaacaggcgcgacacccaaaaacggatgcagccggcgcgttgggcggtcgggaaatacgccttttctccggcactcaaggggcgcacgccctcataaccgccgacaaacgcctttttcaacgcctcatccaacttattgtccgccgtccttgcccaatcgttgaccgcaatcgccaagtcatacataaaattgccccggcaggcataatagaaatcgatgaagcccgatacctgaccgccgtcaagcaacacattgtctttaaacaggtcggcgtggatgatgcccgaaggcagatggttgccgagattgtccttcagcgcatcgatttcggaacacagcagcgcggcatcgtcttgcgacaggacgggcagcagccgggcgcacgcttccgtccaccacgcatcgtaacgcgggttttccatttccaaagggaaatcggcggcggcaaggtgcattttcgccaacatcgcaccggtatggaaacactgctcagccgtcggcagcgcggtatccgaacctttcaggcaggcaaccaggcaggccggcttgcccgccaaaacggaatcgagccggccgtctttgcgcgcaaccggcgcggcaaccgccacgcccttcatactcaaatgccggttaagctccagaaaaaacggcagctcttcctgtttcaacacttcaaacacggtcagcacataacgtcccgaagtcgtcgtcagaaaataattgctgttggtaatcccctgcgcaatgccctgcagggaaacaaattcccccaaatcgtaaccgctcaggaagccgcgcatttcatcatcggaaacactggtatagacagacatatcaactcacttgctcaaaaacgggcaaacccgccgtcagaacgccggacggcaggcaaacatataattcacatcggtcgaatcgcacagggcataagtttgcgacaacacatggtaagtcatacccttcgtatccgccacatccaagcccgcctgacggcacatccgcgccagctcggcaggcgagatgaattttttccagtcgtgcgtacctttggggacaaacttcaacagatattccgccgccacaatcagatgcaggtacgatttcgggtttttattgatggtggaaaaaaacaccatgctgtccggcctgaccagcttggcacaggcacgcacgatggcggcgggatcggggacgtgctccatcatttccatgcacgttaccacatcgaacgagtgcggttccgccccggcaaggtcttccacgcggacacattcgtattcgatatcggcgacattgttcaaagccgcgtgcaggcgggcggtttccaacgactgctccgccatgtcgatacctttgacaaacgccgcgccgcgccgcgccatgctttccgcgaggatgccgccgccacagcctacatc

SEQ ID NO: 936 - protein, 518 aa, Neisseria gonorrhoeae
MPSETLSDGISVKRRTHSIQTQQQVAERVRVFDKRHLARLRKMKIQQARHPKTDAAGALGGREIRLFSGTQGAHALITADKRLFQRLIQLIVRRPCPIVDRNRQVIHKIAPAGIIEIDEARYLTAVKQHIVFKQVGVDDARRQMVAEIVLQRIDFGTQQRGIVLRQDGQQPGARFRPPRIVTRVFHFQREIGGGKVHFRQHRTGMETLLSRRQRGIRTFQAGNQAGRLARQNGIEPAVFARNRRGNRHALHTQMPVKLQKKRQLFLFQHFKHGQHITSRSRRQKIIAVGNPLRNALQGNKFPQIVTAQEAAHFIIGNTGIDRHINSLAQKRANPPSERRTAGKHIIHIGRIAQGISLRQHMVSHTLRIRHIQARLTAHPRQLGRRDEFFPVVRTFGDKLQQIFRRHNQMQVRFRVFIDGGKKHHAVRPDQLGTGTHDGGGIGDVLHHFHARYHIERVRFRPGKVFHADTFVFDIGDIVQSRVQAGGFQRLLRHVDTFDKRRAAPRHAFREDAAATAYI

SEQ ID NO: 937 - DNA, 516 bp, Neisseria gonorrhoeae
atgactacgcattttgtcgttacgggcgtatgcggctgcggcaagaccaccgccgcgccgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggcgcggaccacaccatcgtaacctgttccgccctcaaacgcggctaccgcgacattctgcgcggagccgaaggcaaagccgccttcatccacctcagtccgccgcaagacatcaacctcgaacgcatgatgtcgcgcaaagggcactacatgaaagcaggggtgctcgattcgcaactggaaatcctcgaggaactgggcgaaggcgaatacggggtcaaaatcgccaaccccggcacgcccgaagcggtcgaagccgatattctgaactgggttgcctcggaaaacctgctt

SEQ ID NO: 938 - protein, 172 aa, Neisseria gonorrhoeae
MTTHFVVTGVCGCGKTTAAPSLQKHLGQCPYAEGDEFHTQANRDKMGAGIPLTDEDRYPWLGNLRDWMTQQAQNGADHTIVTCSALKRGYRDILRGAEGKAAFIHLSPPQDINLERMMSRKGHYMKAGVLDSQLEILEELGEGEYGVKIANPGTPEAVEADILNWVASENLL

SEQ ID NO: 939 - DNA, 489 bp, Neisseria gonorrhoeae
ttgacggagcatcttatgccgatagaaatcgaacgccgttttttgattgaaaacgacaaatggcggcaatacgccgatgagccgctgctgctgaaacagggctacctgtctgttgaaaaagaacgcaccatccgcatccgcattgccggaaaacgggcgtggctgacgctgaaaggctatatttcggaaatcagccgcagcgagttcgaatacgaaatcccgcttgccgatgcggaaaagatgatggaaacgatgtgcccgtttaagatggaaaaacggcgttatccggtcagatggggcggcagcctgtttgaagtcgatgttttccttggcgaaaactcgcctttggtcgtcgcggaaatcgagttgcccgccgaaaatgccgattttgaccgtccggactggctggggcgcgaaatcacttcagacggtatgtttaccaatgcctatttgagcaaacatccgttctcaagctggaaaaatgccgtc

SEQ ID NO: 940 - protein, 163 aa, Neisseria gonorrhoeae
LTEHLMPIEIERRFLIENDKWRQYADEPLLLKQGYLSVEKERTIRIRIAGKRAWLTLKGYISEISRSEFEYEIPLADAEKMMETMCPFKMEKRRYPVRWGGSLFEVDVFLGENSPLVVAEIELPAENADFDRPDWLGREITSDGMFTNAYLSKHPFSSWKNAV

SEQ ID NO: 941 - DNA, 519 bp, Neisseria gonorrhoeae
atggacaaaacggcaaaaaaccgcctgaaaaccgatttacggtttggcggcctgtccgttgatctgcaccgatttgagcttcagcgtataggttttgccgtcgtcggtatagccgatttgtgccggaatattgttcagggacggtgcgaagaaatacgttaccgtatcgtcgccgcgccgcacccgatatttgacgacttcggtttccacgccgcctatgctgtattttcccgtacccgccttattcaggccgccgacggaataaagttttttgccgttggtgattttcagacccggggggagtttcgcgtcatttgccgccaactgccaggcaagcgtgaacaaatccatagccttggggctttgctcggttttgctctcgcccgctttgccgtaggttacgctgccgtcggcgaatttggcttccgcatacagtttgcccctgcgtatgtctttatagtaggcagggtgcagggtattgccgacaaccgtaccgccggattcgaaacggatattgta

SEQ ID NO: 942 - protein, 173 aa, Neisseria gonorrhoeae
MDKTAKNRLKTDLRFGGLSVDLHRFELQRIGFAVVGIADLCRNIVQGRCEEIRYRIVAAPHPIFDDFGFHAAYAVFSRTRLIQAADGIKFFAVGDFQTRGEFRVICRQLPGKREQIHSLGALLGFALARFAVGYAAVGEFGFRIQFAPAYVFIVGRVQGIADNRTAGFETDIV

SEQ ID NO: 943 - DNA, 627 bp, Neisseria gonorrhoeae
atgccgtctgaaacccatcctgtgccgggcttcagacggcatattgcttcaaagcaggttttccgaggcaacccagttcagaatatcggcttcgaccgcttcgggcgtgccggggttggcgattttgaccccgtattcgccttcgcccagttcctcgaggatttccagttgcgaatcgagcacccctgctttcatgtagtgccctttgcgcgacatcatgcgttcgaggttgatgtcttgcggcggactgaggtggatgaaggcggctttgccttcggctccgcgcagaatgtcgcggtagccgcgtttgagggcggaacaggttacgatggtgtggtccgcgccgttttgcgcctgttgcgtcatccagtcgcgcagattgcccaaccacggatagcggtcttcatcggtcagcggaatacccgcgcccatcttgtcgcggttggcttgggtgtggaactcgtcgccttcggcatagggacattgaccgaggtgtttctgcagggacggcgcggcggtggtcttgccgcagccgcatacgcccgtaacgacaaaatgcgtagtcatttactatcctttccgtctgtcagacgatggcaaacagcagtgcggacaaggcaaagccga

SEQ ID NO: 944 - protein, 209 aa, Neisseria gonorrhoeae
MPSETHPVPGFRRHIASKQVFRGNPVQNIGFDRFGRAGVGDFDPVFAFAQFLEDFQLRIEHPCFHVVPFARHHAFEVDVLRRTEVDEGGFAFGSAQNVAVAAFEGGTGYDGVVRAVLRLLRHPVAQIAQPRIAVFIGQRNTRAHLVAVGLGVELVAFGIGTLTEVFLQGRRGGGLAAAAYARNDKMRSHLLSFPSVRRWQTAVRTRQSR

SEQ ID NO: 945 - DNA, 1455 bp, Neisseria gonorrhoeae
gtgctatcgttttcgcacaacttaaaaaaacctgacaattttgtacttttattacagagaaaggctttacaaatggacggccggacacagacgctgtccgcgcaaaccttgttgggcatttcggcggcggcaatcatcctcattctgattttaatcgtcaaattccgcatccgcgcgctgctgacactggtcatcgccagcctgctgacggctttggcaaccggtttgcccacaggcagcatcgtcaacgacgtactggtcaaaaacttcggcggcacgctcggcggcgtggcgcttctggtcggtctgggcgcaatgctcggacgtttggtagaaacatccggcggcgcacagtcgctggcggacgcgctgatccggatgttcggcgaaaaacgcgcaccgttcgctccgggcgttgcctcgctgattttcggcttcccgattttcttcgatgccggactaatcgtcatgctgcccatcgtattcgccaccgcacggcgcatgaaacaggacgtactgcccttcgcgcttgcctccgtcggcgcattttccgtcatgcacgtcttcctgccgccccatccgggcccgattgccgcttccgaattttacggcgcgaacatcggccaggttttgattttgggtctgccgaccgccttcatcacatggtatttcagcggctatatgctcggcaaagtgttggggcgcgccatccatgttcccgttcccgaactgctcagcggcggcacgcaagacagcgacccgccgaaagaacctgccaaagcaggaacggtcgtcgccgtcatgctgattcccatgctgctgattttcctgaataccggcgtatcagccctcatcagcgaaaaactcgtaagtgcggacgaaacttgggttcagacggcaaaaatgatcggttcgacacctgtcgcccttctgatttccgtattggccgcactgttggtcttgggacgcaaacgcggcgaaagcggcagcacgttggaaaaaaccgtggacggcgcactcgcccccgcctgttccgtgattctgattaccggcgcgggcggtatgttcggcggcgttttgcgcgcttccggcatcggcaaggcactcgccgacagcatggcggatttgggcattcccgtccttttgggctgcttccttgtcgccttggcactgcgtatcgcgcaaggttcggcaaccgtcgccctgaccacagccgccgcgctgatggctcctgccgttgccgccgccggctttaccgactggcagctcgcctgtatcgtattggcaacggcggcaggttcggtcggttgcagccacttcaacgactccggcttctggctggtcggccgcctcttggatatggacgtaccgaccacgctgaaaacctggacggtcaaccaaaccctcatcgcattcatcggctttgccttgtccgcactgctgtttgccatcgtc

SEQ ID NO: 946 - protein, 485 aa, Neisseria gonorrhoeae
VLSFSHNLKKPDNFVLLLQRKALQMDGRTQTLSAQTLLGISAAAIILILILIVKFRIRALLTLVIASLLTALATGLPTGSIVNDVLVKNFGGTLGGVALLVGLGAMLGRLVETSGGAQSLADALIRMFGEKRAPFAPGVASLIFGFPIFFDAGLIVMLPIVFATARRMKQDVLPFALASVGAFSVMHVFLPPHPGPIAASEFYGANIGQVLILGLPTAFITWYFSGYMLGKVLGRAIHVPVPELLSGGTQDSDPPKEPAKAGTVVAVMLIPMLLIFLNTGVSALISEKLVSADETWVQTAKMIGSTPVALLISVLAALLVLGRKRGESGSTLEKTVDGALAPACSVILITGAGGMFGGVLRASGIGKALADSMADLGIPVLLGCFLVALALRIAQGSATVALTTAAALMAPAVAAAGFTDWQLACIVLATAAGSVGCSHFNDSGFWLVGRLLDMDVPTTLKTWTVNQTLIAFIGFALSALLFAIV

SEQ ID NO: 947 - DNA, 168 bp, Neisseria gonorrhoeae
ttgaaatatacggtatgtggggcttttgggtacaatcgcaacatcagtgtttcaagtggggaaggcgatggatggacggtgttgggcggtacggggtgctttttccctgctgccttcggcttttttggcggtaatggtcgttgcgcctttgtgggcggtggcggcgta

SEQ ID NO: 948 - protein, 56 aa, Neisseria gonorrhoeae
LKYTVCGAFGYNRNISVSSGEGDGWTVLGGTGCFFPAAFGFFGGNGRCAFVGGGGV

SEQ ID NO: 949 - DNA, 1458 bp, Neisseria gonorrhoeae
ttgtgggcggtggcggcgtatgacggtttggcgtggcgcgcggtgctgtcggatgcctatatgctcaaacgtttggcgtggacggtgtttcaggcggcggcaacctgtgtgctggtgctgcctttgggcgtgcctgtcgcgtgggtgctggcgcggctggcgttcccggggcgggctttggtgctgcgcctgctgatgctgccgtttgtgatgcccacgctggtggcgggcgtgggcgtgctggctctgttcggggcggacgggctgttgtggcgcggccggcaggatacgccgtatctgttgttgtacggcaatgtgtttttcaacctgcccgtgttggtcagggcggcgtatcaggggtttgctcaagtgcctgcggcacggcttcagacggcacggacgttgggcgcgggggcgtggcggcggttttgggacattgaaatgcccgttttgcgcccgtggcttgccggcggcgtgtgccttgtcttcctgtattgtttttcggggttcgggctggcattgctgttgggcggcagccgttatgccacggtcgaagtggaaatttaccagttggttatgttcgaactcgatatggcgggggcttcggcgctggtgtggctggtgttgggggtaacggcggcggcagggttgctgtatgcgtggttcggcaggcgcgcggtttcggataaggcggtttcccccgtgatgccgtcgccgccgcaatcggtgggggaatatgtattgctggcattttcggtggcggtgttgtccgtgtgctgcctgtttcctttgtcggcaattgttgtgaaagcgtggtcggccggcgaatcgcggcgtgtgttaatggaaagtgaaacgtggcaggcagtgtggaatactttgcgcttttcggcggcggcggtgtttgcggcggcggttttgggtgtggtgtatgcggcggcggcgcggcggctggtgtggatgcgcggactggtgtttttaccgtttatggtgtcgccggtttgtgtttcggcgggcgtgctgctgctttatccggggtggacggcttcgttaccgctgctgctggcgatgtatgcgctgctggcgtatccgtttgtggcaaaagatgttttatcggcctgggatgcactgccgccggattacggcagggcggcggcaggtttgggcgcaaacggctttcagacggcatgccgtatcacgttccccctcttgaaaccggcgttgcggcgcggtctgactttggcggcggcgacgtgtgtgggcgaatttgcggcaaccttgttcctgtcgcgtccggaatggcagacgttgacgactttgatttatgcctatttggggcgtgcgggtgaggacaattatgcgcgggcaatggtgttgacattgctgttgtcggcatttgcggtgtgcattttcctgctgttggacaacggcgaaggcggaaaacggacggaaacgtta

SEQ ID NO: 950 - protein, 486 aa, Neisseria gonorrhoeae
LWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFAQVPAARLQTARTLGAGAWRRFWDIEMPVLRPWLAGGVCLVFLYCFSGFGLALLLGGSRYATVEVEIYQLVMFELDMAGASALVWLVLGVTAAAGLLYAWFGRRAVSDKAVSPVMPSPPQSVGEYVLLAFSVAVLSVCCLFPLSAIVVKAWSAGESRRVLMESETWQAVWNTLRFSAAAVFAAAVLGVVYAAAARRLVWMRGLVFLPFMVSPVCVSAGVLLLYPGWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLSAFAVCIFLLLDNGEGGKRTETL

SEQ ID NO: 951 - DNA, 690 bp, Neisseria gonorrhoeae
ttgcggtgtgcattttcctgctgttggacaacggcgaaggcggaaaacggacggaaacgttataatgcgaaccctttttcagaggacggcaaaatgagcgagttgagcgaaatcctttcctataatcagaagtttgtcgagtcgggagaatatgaaaaatactttaccgacaaataccccgaacgcgggctggcggttttgtcctgtatggatgcgcggattatcgggctgctgcccgacgcgttgggtttgaaaaacggcgatgccaagctgattaaaaatgccggcgcgctggttacgcacccgtggggttcggtgatgcggagccttttggttgccgtgtttgaattgaaggtcagagagattatggtcatcgcccatcacgattgcggtatgcaggggctgaatgccgaagaattcctcgggcgcgtccgggaaagccggattcccgaagaccgtatcgaaaccctgcgttatgcaggtgtcgacctcgacggctggctgaccggtttcgacaacgtcgaagacagcgtgcgccacacggtggaccttatccgcaaccatccgctgatgccgcgccatatcgccgttcacggactggtcatccatcccgttaccggcaaactgacgctggttgtggacggcagtgtttcagacggcatggacttatcggaaggaatggaaacatca

SEQ ID NO: 952 - protein, 230 aa, Neisseria gonorrhoeae
LRCAFSCCWTTAKAENGRKRYNANPFSEDGKMSELSEILSYNQKFVESGEYEKYFTDKYPERGLAVLSCMDARIIGLLPDALGLKNGDAKLIKNAGALVTHPWGSVMRSLLVAVFELKVREIMVIAHHDCGMQGLNAEEFLGRVRESRIPEDRIETLRYAGVDLDGWLTGFDNVEDSVRHTVDLIRNHPLMPRHIAVHGLVIHPVTGKLTLVVDGSVSDGMDLSEGMETS

SEQ ID NO: 953 - DNA, 603 bp, Neisseria gonorrhoeae
atgaagaaaatcggactgttcggcggcactttcgacccgatacacaacgggcattttcatatcgcccgtgcctttgccgacgaaatcgggttggacgcggttgttttcctgccggcaggcggcccgtatcacaaagacgccgcctccgcttccgccgccgaccgccttgccatggtcgaactggcgacggcagaagacgcgcgttttgccgtcagcgactgcgacatcgtccgagaaagtgcaacctatacttttgataccgtccaaatcttccgccggcagttcccgtccgcgcaactttggtggctgatgggcagcgacagcctgctgaagctgcatacttggaaaaaatggcagttgctcgtgcgcgaaaccaatatcgccgtcgccatgcggcagggcgacagcctgcaccaaaccccgcgcgaactgcacgcgtggctgggcaatgcccttcaggacggcagcgtccgcatcttgtcagccccgatgcataatgtgtcgtcaacggaaatccgccgcaacctgagtgccgccggtgtttcagacggcatcccgcctgccgccgcccgttatatccgaaaacacggtttgtatgaaaaa

SEQ ID NO: 954 - protein, 201 aa, Neisseria gonorrhoeae
MKKIGLFGGTFDPIHNGHFHIARAFADEIGLDAVVFLPAGGPYHKDAASASAADRLAMVELATAEDARFAVSDCDIVRESATYTFDTVQIFRRQFPSAQLWWLMGSDSLLKLHTWKKWQLLVRETNIAVAMRQGDSLHQTPRELHAWLGNALQDGSVRILSAPMHNVSSTEIRRNLSAAGVSDGIPPAAARYIRKHGLYEK

SEQ ID NO: 955 - DNA, 384 bp, Neisseria gonorrhoeae
atgaacgaacaagaactgcaagacctgcaaaaaatggtcggggtcgccgtcaatgccctcgaagacatcaaagccaaagacatttccgttctcgaaacgcaagacaaaacttcgctgtttgccagaatgattatcgccagcggcgacagtacgcgccaagtcaaagcactggccaacaacgttgccgtcgatttgaaagaagccggttttgaaatcctcagtaccgaaggagacagcggcgaatggacgttggttgatgcaggagacctcgtcgtccacgtcatgctccctgccgtgcgcgacttctacgacattgacaccatctggggcggcgagaaaccgagtttccacgccggaatgcagaagccgtggcacgctgcagac

SEQ ID NO: 956 - protein, 128 aa, Neisseria gonorrhoeae
MNEQELQDLQKMVGVAVNALEDIKAKDISVLETQDKTSLFARMIIASGDSTRQVKALANNVAVDLKEAGFEILSTEGDSGEWTLVDAGDLVVHVMLPAVRDFYDIDTIWGGEKPSFHAGMQKPWHAAD

SEQ ID NO: 957 - DNA, 552 bp, Neisseria gonorrhoeae
agctggaaaaatgccgtctgaagcggcttcagacggcatctgccttgcggttatcccttgaggtaatgcacgaatgtatatgcaacgcctttgctgctgacacggcgttccgtccgctctgcttctctccaatgcgtccggtctatttctgggaaaaatgcatctccttccacagacaaatccacttcggttatccgcaaatcggtcgctaatggcatcgcttgtccgtatatctgcgcgccgcccataatgacggcttcttccgcgccggcgcacaatgccaatgccacctccaaacttgccaccgtttccgcgcctgccgcgcaataatccgcctgccggctgatgacgatgttcctccgtccgggcaggggtttgacgggcagggattcccacgttttccgccccataatgacgggtttgcccaaggtataggctttgaaaaatgcgaaatcttcggggatgtgccaaggcatagcattgcccgccccgatgcacaggttttccgcacacgccgcaattatggttattttgagcatattttctccacaa

SEQ ID NO: 958 - protein, 6 aa, Neisseria gonorrhoeae
SWKNAV

SEQ ID NO: 959 - DNA, 294 bp, Neisseria gonorrhoeae
atggcatactctgcggacttaagaaacaaagctttaaaccatagcggattaacaaaaatcaggacaaggcggcgggccgcaggcagtacaaatggtacggaaccgatccgcccggcgctccatcaccttagggaatcgttccctttgagccggggcggggcaacgccgtaccggtttttgttaatccgctatattacggacaatgcaaaaacaccggccaaaccgcagcaacgtttaacttgtcaagaaacacgctttacctgcggattcgccttaaaaaacaaacaggcagcc

SEQ ID NO: 960 - protein, 98 aa, Neisseria gonorrhoeae
MAYSADLRNKALNHSGLTKIRTRRRAAGSTNGTEPIRPALHHLRESFPLSRGGATPYRFLLIRYITDNAKTPAKPQQRLTCQETRFTCGFALKNKQAA

SEQ ID NO: 961 - DNA, 540 bp, Neisseria gonorrhoeae
atgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccg

SEQ ID NO: 962 - protein, 180 aa, Neisseria gonorrhoeae
MTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 963 - DNA, 423 bp, Neisseria gonorrhoeae
gtgccacggcttctgcattccggcgtggaaactcggtttctcgccgccccagatggtgtcaatgtcgtagaagtcgcgcacggcagggagcatgacgtggacgacgaggtctcctgcatcaaccaacgtccattcgccgctgtctccttcggtactgaggatttcaaaaccggcttctttcaaatcgacggcaacgttgttggccagtgctttgacttggcgcgtactgtcgccgctggcgataatcattctggcaaacagcgaagttttgtcttgcgtttcgagaacggaaatgtctttggctttgatgtcttcgagggcattgacggcgaccccgaccattttttgcaggtcttgcagttcttgttcgttcattgttttcctaacgggatgttttcagacggcattatagcctctccttac

SEQ ID NO: 964 - protein, 141 aa, Neisseria gonorrhoeae
VPRLLHSGVETRFLAAPDGVNVVEVAHGREHDVDDEVSCINQRPFAAVSFGTEDFKTGFFQIDGNVVGQCFDLARTVAAGDNHSGKQRSFVLRFENGNVFGFDVFEGIDGDPDHFLQVLQFLFVHCFPNGMFSDGIIASPY

SEQ ID NO: 965 - DNA, 468 bp, Neisseria gonorrhoeae
ttgaacattaccgtcttggcagtcggcaccaaaatgccgcgttgggttgatgaggccgtcgccgaatacgccaaacgcttcggacgcgacgccgcctacgcattcaaagaaatcaaacccgaaaaacgcggcgcgggcgtgaatgccgtccaaggtatggcggcggaagaaaaacgcatccttgaagccattccgcaaggcgcgttcctcgtcgttcttgacgaacgcggcaaagcaccgacctccgtcgagctggcggaacacctcaaaagctggcggcaaaacggcgaacacgtctgcttcgtcatcggcggcgcggacggcatgaccgaccgcctcaaacaacaagcccgcatgatgatgcgcctgtccagcctcaccctgccgcacggcatggtgcgcgtccttctgaccgagcagctctaccgggccgtttccatcctgcacaaccatccttatcatcgggaa

SEQ ID NO: 966 - protein, 156 aa, Neisseria gonorrhoeae
LNITVLAVGTKMPRWVDEAVAEYAKRFGRDAAYAFKEIKPEKRGAGVNAVQGMAAEEKRILEAIPQGAFLVVLDERGKAPTSVELAEHLKSWRQNGEHVCFVIGGADGMTDRLKQQARMMMRLSSLTLPHGMVRVLLTEQLYRAVSILHNHPYHRE

SEQ ID NO: 967 - DNA, 264 bp, Neisseria gonorrhoeae
atggcacgaatggtattctgcgtcaagctcaacaaagaagccgaaggcatgaaatttccgccgctgcccaacgaattgggcaaacgcatttttgaaaacgtatcgcaagaagcatgggcggcgtggacgcgccaccagaccatgctgattaacgaaaaccgcttaagccttgccgatccgcgcgcgcgcgaatacctggctcagcagatggagcagtatttcttcggcgacggcgcggatgccgtgcagggatacgttccgcaa

SEQ ID NO: 968 - protein, 88 aa, Neisseria gonorrhoeae
MARMVFCVKLNKEAEGMKFPPLPNELGKRIFENVSQEAWAAWTRHQTMLINENRLSLADPRAREYLAQQMEQYFFGDGADAVQGYVPQ

SEQ ID NO: 969 - DNA, 681 bp, Neisseria gonorrhoeae
atgcaacacgacgtttacgactacaccgcgcatacggtttctaaaaacaccgtcctgcagaaaacctaccgcctgctcggattttcattcattccggcagccgcaggcgcggcacttgccgccaatgccggtttcaatttttacgccgccttcggttcgcgctggataggatttgccgtcgtattggcgtttttctacggtatgatccacttcatcgaaaaaaaccgttacagcaataccggcgttaccctgctgatggtattcacattcggtatgggcgtattgatcggccccgtgctgcaatacgcactccatattgccgacggtgcgaaaatcgtcggcattgccgccgcgatgaccgccgccgtctttttaacgatgtccgcattggcacgccgaacccggctcgatatgaacgcgctcggacgcttcctgaccgtaggtgcggtcattctgatggtcgccgtggttgccaatctgtttttgggtattcccgcactcgccctgaccatttccgccggttttgtcttgttcagttccttaataattatgtggcaggtacgcaccgtcatcgacggcggcgaagacagttacatcagcgcggcactgacactgtttatctcgctttacaacatcttcagcagcctgctcaacatcctgctgtccttaaacggcgacgac

SEQ ID NO: 970 - protein, 227 aa, Neisseria gonorrhoeae
MQHDVYDYTAHTVSKNTVLQKTYRLLGFSFIPAAAGAALAANAGFNFYAAFGSRWIGFAVVLAFFYGMIHFIEKNRYSNTGVTLLMVFTFGMGVLIGPVLQYALHIADGAKIVGIAAAMTAAVFLTMSALARRTRLDMNALGRFLTVGAVILMVAVVANLFLGIPALALTISAGFVLFSSLIIMWQVRTVIDGGEDSYISAALTLFISLYNIFSSLLNILLSLNGDD

SEQ ID NO: 971 - DNA, 177 bp, Neisseria gonorrhoeae
gtgtattcggtaacatttgattcctcccggcttcatagccggctgtgtttttatgtgtttgcatccgtattgtatgcccaaaacaaaatgccgtctgaaaataagtgctttcagacggcatggtttgcatggtgtttcgcctacatcagtcgtcgccgtttaaggacagcaggatgt

SEQ ID NO: 972 - protein, 59 aa, Neisseria gonorrhoeae
VYSVTFDSSRLHSRLCFYVFASVLYAQNKMPSENKCFQTAWFAWCFAYISRRRLRTAGC

SEQ ID NO: 973 - DNA, 513 bp, Neisseria gonorrhoeae
atgttaccgaatacaccgcgccgcgccgtttatgccggcagtttcgatccgcccacattggggcatctgtggatgatacggcaggcgcaatctatgtttgacgaactcatcgtcgccatcggcatcaatcccgacaaacgcaacacctataccgtcgctgaaaggcaggatatgttgtgcgccattaccgacaacttcccaaacgtcagaattgaagtgtttcaaaaccggtttttggtgcattacgcccgtgaggtagatgcgggattcatcgtgcgcggcatccgttccacctccgattatgaatacgaacgctccatgcgccatatcaacagcgacctcgcacccgaaatatctaccgtattcctcatgccgccgcgcgaaatcgccgaagtgtcgtccactatgatcaaaggactggtcgggcccgagggctggatggaaaccgtcaaaagatatgtgccgccggccgtgtaccaaaaaatgattgcagaacatcacaacaacaatgcc

SEQ ID NO: 974 - protein, 171 aa, Neisseria gonorrhoeae
MLPNTPRRAVYAGSFDPPTLGHLWMIRQAQSMFDELIVAIGINPDKRNTYTVAERQDMLCAITDNFPNVRIEVFQNRFLVHYAREVDAGFIVRGIRSTSDYEYERSMRHINSDLAPEISTVFLMPPREIAEVSSTMIKGLVGPEGWMETVKRYVPPAVYQKMIAEHHNNNA

SEQ ID NO: 975 - DNA, 126 bp, Neisseria gonorrhoeae
ttgtatattatcaacggtttgaaaattatgcactttatcattggcgatatactcaataaaccgttatcgccacaaggctacatagcattcagacgtgcttctaatttctccaatcgtggctttaat

SEQ ID NO: 976 - protein, 42 aa, Neisseria gonorrhoeae
LYIINGLKIMHFIIGDILNKPLSPQGYIAFRRASNFSNRGFN

SEQ ID NO: 977 - DNA, 135 bp, Neisseria gonorrhoeae
ttgtttttaattgactataaaacaaatgggttaaaccagtatccatacatcagcttttttatcatcctactttttattcatccgatcgggcagacagatttcaaagatgaaaagcctattctattcacacccatt

SEQ ID NO: 978 - protein, 45 aa, Neisseria gonorrhoeae
LFLIDYKTNGLNQYPYISFFIILLFIHPIGQTDFKDEKPILFTPI

SEQ ID NO: 979 - DNA, 333 bp, Neisseria gonorrhoeae
gtgttcgacagccaaaacccgggcggcaacatcgtctgccgtatcgccgtcaagtatcggcacaatcccttgcgatacaatcgggccgcaatccagctcggccgtaacgaaatgaatcgtacagccggcaacgcggcaacctgcttccaaagcgcgttcgtgcgtatgaagcccggtgaacgagggcaggatggacggatggatgttcatcagcctgccttcgtaatgggcgcagaactcaggggtcagaatccgcataaaacctgccaaaaccaccaaatcgggttgatatgcgtcgattttttccatcatggccgtatcgaaggcaagtcg

SEQ ID NO: 980 - protein, 111 aa, Neisseria gonorrhoeae
VFDSQNPGGNIVCRIAVKYRHNPLRYNRAAIQLGRNEMNRTAGNAATCFQSAFVRMKPGERGQDGRMDVHQPAFVMGAELRGQNPHKTCQNHQIGLICVDFFHHGRIEGKS

SEQ ID NO: 981 - DNA, 588 bp, Neisseria gonorrhoeae
tcccttgaggtaatgcacgaatgtatatgcaacgcctttgctgctgacacggcgttccgtccgctctgcttctctccaatgcgtccggtctatttctgggaaaaatgcatctccttccacagacaaatccacttcggttatccgcaaatcggtcgctaatggcatcgcttgtccgtatatctgcgcgccgcccataatgacggcttcttccgcgccggcgcacaatgccaatgccacctccaaacttgccaccgtttccgcgcctgccgcgcaataatccgcctgccggctgatgacgatgttcctccgtccgggcaggggtttgacgggcagggattcccacgttttccgccccataatgacgggtttgcccaaggtataggctttgaaaaatgcgaaatcttcggggatgtgccaaggcatagcattgcccgccccgatgcacaggttttccgcacacgccgcaattatggttattttgagcatattttctccacaaaaatgccgtctgaacgcttcagacggcattttatgacattctgcgtcaaaaatctcaacctgcgcgcgccatacgttttgtgttcgcac

SEQ ID NO: 982 - protein, 52 aa, Neisseria gonorrhoeae
SLEVMHECICNAFAADTAFRPLCFSPMRPVYFWEKCISFHRQIHFGYPQIGR

SEQ ID NO: 983 - DNA, 1056 bp, Neisseria gonorrhoeae
ttggagaagcgtagcgaagacatccgcgtttatatggattatcagggcaagaaagaccgattggaagaagtcatcgggctttccgaagaccccgagctttggaacgacccgaaacgtgcccaagaaatcggcaaagagagcaaaatccttgaaggcatcgtgctgacgctcgacaacatcgcttcgggtatcgaagacaaccgtatgctgattgaaatggccgtcgaagaaaacgacgaagaaggttttgccgccgtgaaggaagacgtggcggggctggaaaaacagatggcggatttggagttcaaacggatgttcaaccagcccgccgacccgaacaactgctttatcgacatcaccgccggcgcgggcggtaccgaagcggaagactgggcggggatgctgttccgtatgtacagccgctatgccgagcgcaaaggcttcaaaatcgaaatccttgaggaagacgacggcgaaatcgcaggcatcaaccgcgccaccatccgagtggaaggcgaatacgcttatggtttgctgcgtaccgaaaccggcgttcaccgtctggtgcgctactcgccgtttgattcgaacaacaaacgccatacctcgtttgcctccgtgttcgtttaccctgaaatcgacgattccatcgaaatcgaaatcaaccccgccgatttgcgcatcgacacctatcgcgcatcgggtgcgggcggtcagcacatcaacaaaaccgactccgccgtgcgtattacccacgagccgacggggattgtggtgcaatgtcaaaacgaccgttctcaacacgccaacaaagccgccgcgatggaaatgttgaaatccaaactgtatgaattggaaatgcgcaaacgcaacgaagagaaacaggcattggaagaaggtaaatccgatgtgggttggggcagccaaatccgttcgtatgttttggattcctcacgcatcaaagacttgcgtacaggctacgaagtcggcaacaccaaagccgtattggacggcgacttggacggctttatcgaagccagcctgaaacagggtgtg

SEQ ID NO: 984 - protein, 352 aa, Neisseria gonorrhoeae
LEKRSEDIRVYMDYQGKKDRLEEVIGLSEDPELWNDPKRAQEIGKESKILEGIVLTLDNIASGIEDNRMLIEMAVEENDEEGFAAVKEDVAGLEKQMADLEFKRMFNQPADPNNCFIDITAGAGGTEAEDWAGMLFRMYSRYAERKGFKIEILEEDDGEIAGINRATIRVEGEYAYGLLRTETGVHRLVRYSPFDSNNKRHTSFASVFVYPEIDDSIEIEINPADLRIDTYRASGAGGQHINKTDSAVRITHEPTGIVVQCQNDRSQHANKAAAMEMLKSKLYELEMRKRNEEKQALEEGKSDVGWGSQIRSYVLDSSRIKDLRTGYEVGNTKAVLDGDLDGFIEASLKQGV

SEQ ID NO: 985 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttgccaaccatcgtttggccttggctgccgatggggttttcgagggccccgccgggccgggtggaagctatttcggcggacggcgtaaaggcagacgcggtcgcggcgcggcaggaaaagcggttgtcttcggcattccgaaacgcaacgggcgggcctataccgttgccgcggacaatgccgagcctgaaacgttgccccctgccgtcaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattggggatttttggaatcaggcaaaacgcgccttgcgaaaatacaacggaatcgatcgtaaaccttttccgccgttcttgagggaatgcgaatttcgacttaacttcggcacaccgtcccggcagctaaaaatcctgcgggatcggtgtggaatt

SEQ ID NO: 986 - protein, 217 aa, Neisseria gonorrhoeae
MKITHCKLKKEVQKEPLRSFVPEVTARSAADILGIHPDSAALFYRKIRTVANHRLALAADGVFEGPAGPGGSYFGGRRKGRRGRGAAGKAVVFGIPKRNGRAYTVAADNAEPETLPPAVKKKIMPDGIVYADSPGSRGKLDAGGFTRCRINRSKEFADRRNHINGIGDFWNQAKRALRKYNGIDRKPFPPFLRECEFRLNFGTPSRQLKILRDRCGI

SEQ ID NO: 987 - DNA, 843 bp, Neisseria gonorrhoeae
gtgaacgttcagacggcattccgaattccaaatgccgtccgaacccccgccaaacaacaacaaacctacgcccgacaagcatccgccatgattaccatccgcaacgtcagctaccgcatcggcacacaccccatcctcgacaacgtcagcctcgacatccccgaaggcggcattaccgcgctaatcggccccaacggtgcgggcaaatccaccctgttttcctttatggcgcggctgcgcccgcttgaaagcggcagcatcgcctaccgaggcaaaaaccttgccggcacccccaccgccgaactcgcccgcacgctctccatcctcacccaagaaaacagcatcatgagccgcatcaccgtgcgcgacctgctgatgttcggccgttacccctaccatcaaggcagaccgactgccgaatgccgccgtatcgttaacggtgcaatcgaagaattccacctgcaggacctctccgaccgctacctgaccgaactctccggcggacaacgccaacgcgccatgattgcgatggtgttctgccaaagcaccgactacgtccttttggacgaaccgctgaacaacctcgatatgtatcacgcccgctcgctcatgcagattctgcaaaagctcacgcacgaacacaaacgcaccaccgtcgccgtattgcacgacatcaaccaggccgccgcctacgccgaccacgtcgtcgccatgaaaaacggcaaagccgccctgaccggcacacccgaagaagtgttcaccgtacacaacatcaaagaactgttcgacatggacgtggacgtactcgactacgaaggcaaaaaactcatcgtccaccacatc

SEQ ID NO: 988 - protein, 281 aa, Neisseria gonorrhoeae
VNVQTAFRIPNAVRTPAKQQQTYARQASAMITIRNVSYRIGTHPILDNVSLDIPEGGITALIGPNGAGKSTLFSFMARLRPLESGSIAYRGKNLAGTPTAELARTLSILTQENSIMSRITVRDLLMFGRYPYHQGRPTAECRRIVNGAIEEFHLQDLSDRYLTELSGGQRQRAMIAMVFCQSTDYVLLDEPLNNLDMYHARSLMQILQKLTHEHKRTTVAVLHDINQAAAYADHVVAMKNGKAALTGTPEEVFTVHNIKELFDMDVDVLDYEGKKLIVHHI

SEQ ID NO: 989 - DNA, 624 bp, Neisseria gonorrhoeae
atgacgcaagaacgtttacccgaatttttcgaccgcgccccgacgctgaccgtacaagacccgcttgccgcattcctcggcgcggccgaaaacggcatcctcacttaccgctacgccgatgccgtgcgcctgtgcggacattcctgcccgaccgtcgcgggcgcgtacctgatggttatcaaaggcctgaaagcactttacggcgaagagctgcccgaacgcggcggcatcgaagccgccatgcagggaacgcgcgacgaaggcacggtcggcgtaaccgcgtccgtcgtccaactccttaccggcgcagcccccgaaaccggcttcggaggcatcggaatgcagggacgcttcgcccgccgcaacctattatcctttggtgcaggcgaaatcaacggcacactgaccctgcgccgcaaagacagcggcaaaaccgtcgccgtcagcctcaacgccgccctgcaaccctttgcacctcaaatgcgcgacatcatgcccaaagccgtcggcggcagcgcaagcgcaaaagaactcgaacgcttcggacaactttggcaggcacgcgttaaagcatttttgaccgaatcggcggacgacccgcagttcgtcatcgtccgcgaactg

SEQ ID NO: 990 - protein, 208 aa, Neisseria gonorrhoeae
MTQERLPEFFDRAPTLTVQDPLAAFLGAAENGILTYRYADAVRLCGHSCPTVAGAYLMVIKGLKALYGEELPERGGIEAAMQGTRDEGTVGVTASVVQLLTGAAPETGFGGIGMQGRFARRNLLSFGAGEINGTLTLRRKDSGKTVAVSLNAALQPFAPQMRDIMPKAVGGSASAKELERFGQLWQARVKAFLTESADDPQFVIVREL

SEQ ID NO: 991 - DNA, 972 bp, Neisseria gonorrhoeae
atgccgtctgaaaaaaatatcggttttatggcaggaagcagccgtccgttgcgggtcgcctttgcgctgttgctggtttcctgcatcctgtttatgacgctcaacgtcaaaggagattgggactttgtcttgcacctgcgcctgaccaagcttgccgcgctgctgatggtcgcctatgcggtcggcgtgtccactcaactcttccaaacgctgaccaacaacccgattctgaccccttcgattttgggtttcgattcgctgtatgtgtttttgcagaccttgctggtgtttacgttcggcggcgtgggctatacatccctgccgttgacgggcaaattcggctttgaactggttgttatgatgggcggctcgctgctgctgttttacacgctcatccgtcagggcgggcgcgatttgccgcacatgattttaatcggcgtgattttcgggattttgttccgcagcctttcctcgctgctttcgcgcatgatagaccccgaagaatttaccgccgcgcaggcgaatatgtttgccggattcaataccgtccgcagcgagcttttaggcataggcgcgctggtcctgctcgtcagcgcggcggtcgtttggcacgaacgctaccgctcggacgtacaccttttggggcgcgaccaagccgtcaatttgggcatcagctacacgcgcaacaccttatggatactgctttggattgccgcattggtggcgacggcgaccgccgttgtcggcccggtgagctttttcgggcttctcgccgcctcgcttgccaaccacttttccccgtccgtgcgccattccgtccgcctgccgatgacggtttgcgtcggcggcatcctcttggtcggcggacaaaccgtattcgaacacttcttgggcatgaaggcggtattaagcgtggtggtcgaatttgcgggcggactcgttttcctctatctcgttttaaaacacaaaaaa

SEQ ID NO: 992 - protein, 324 aa, Neisseria gonorrhoeae
MPSEKNIGFMAGSSRPLRVAFALLLVSCILFMTLNVKGDWDFVLHLRLTKLAALLMVAYAVGVSTQLFQTLTNNPILTPSILGFDSLYVFLQTLLVFTFGGVGYTSLPLTGKFGFELVVMMGGSLLLFYTLIRQGGRDLPHMILIGVIFGILFRSLSSLLSRMIDPEEFTAAQANMFAGFNTVRSELLGIGALVLLVSAAVVWHERYRSDVHLLGRDQAVNLGISYTRNTLWILLWIAALVATATAVVGPVSFFGLLAASLANHFSPSVRHSVRLPMTVCVGGILLVGGQTVFEHFLGMKAVLSVVVEFAGGLVFLYLVLKHKK

SEQ ID NO: 993 - DNA, 1053 bp, Neisseria gonorrhoeae
acctgcgcgcgccatacgttttgtgttcgcacccgccaacaatgccaacaattcttcagtcgcgccccaaccgatacacgcatcggtaatgctcttgccgtacacttccggcttgtcctgcctgccttcgaccaaatggctttccaccatcacgcccatgatattgccgccgtcctgttccaattggtcggcaatgtcttgtgccacttccatctgccgggtgtaatccttgcggctgttggcgtggctgcaatcgatcatcagcttgtcggttacccctgccgcacgcagttgttccaccgcctcgctgacgtgtcccgcatcataattcggctcttttccgccgcgcaaaatgacatgacagtcgggattgccgccggtatggacaatggcggaatgcccggccttggttacagacaagaaatgatgcgaatggctcgccgcaccgattgcgtcgatcgcaatcttcaaattgccgtccgtaccgtttttaaagccgacggggcaggacagaccgcttgccaattcgcggtggacttggctttcggtcgtccgcgcgccgattgccccccaagaaatcaggtcggcataatactggggtgtaatcatatccaaaaattcggtagaggcaggcatgcccatattattcagggacaacaacagactgcgcgcctgacgcaaaccgaaattgatgtcgaacgtaccgtccaaatgcgggtcgttaatcaaacctttccaacccaccgtcgttctcggcttctcgaaataaacgcgcatcacgatcaaaagctcgttttcataccgcttgcggagtttcaacagacgttccgcatattccaacgccgctttcggatcgtgaatcgaacacggcccgataatgaccaacagccgcctgtccctgccgtgaaccaaatcggaaagttcctggcggatgcggtgaaccaagcccgaagcctctttggaaatcggcagctcgtaaagatgggcaatcggcggcaacaactctttaacttctttaatcttaatatcgtctgtggggtaatggtgtgtcat

SEQ ID NO: 994 - protein, 351 aa, Neisseria gonorrhoeae
TCARHTFCVRTRQQCQQFFSRAPTDTRIGNALAVHFRLVLPAFDQMAFHHHAHDIAAVLFQLVGNVLCHFHLPGVILAAVGVAAIDHQLVGYPCRTQLFHRLADVSRIIIRLFSAAQNDMTVGIAAGMDNGGMPGLGYRQEMMRMARRTDCVDRNLQIAVRTVFKADGAGQTACQFAVDLAFGRPRADCPPRNQVGIILGCNHIQKFGRGRHAHIIQGQQQTARLTQTEIDVERTVQMRVVNQTFPTHRRSRLLEINAHHDQKLVFIPLAEFQQTFRIFQRRFRIVNRTRPDNDQQPPVPAVNQIGKFLADAVNQARSLFGNRQLVKMGNRRQQLFNFFNLNIVCGVMVCH

SEQ ID NO: 995 - DNA, 837 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattc

SEQ ID NO: 996 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 997 - DNA, 720 bp, Neisseria gonorrhoeae
atgcccgaaacaggttttcgggcatttttacggcaaatgccgtctgaagccaccaaacagcggttcagacggcatccctttcaaaagcgcaccattatgaaaaacatcgtcatcctgatttccggacgcggcagcaatatgcaggcaatcgtcaatgccgccattcccaacgtccgcattgccgccgtgttgagcaacagcgaaacggctgccggtttgcaatgggcggccgaacgcggcatcccgaccgacagcctgaatcataaaaactttgaatcacgacttgccttcgatacggccatgatggaaaaaatcgacgcatatcaacccgatttggtggttttggcaggttttatgcggattctgacccctgagttctgcgcccattacgaaggcaggctgatgaacatccatccgtccatcctgccctcgttcaccgggcttcatacgcacgaacgcgctttggaagcaggttgccgcgttgccggctgtacgattcatttcgttacggccgagctggattgcggcccgattgtatcgcaagggattgtgccgatacttgacggcgatacggcagacgatgttgccgcccgggttttggctgtcgaacacaaactctatccgaaagccgttgccgatgttgccgccggccgcctgattatcgagggaaaccgtgtcagaaattcggaaaacgccgatgccgcccgtttcctgacggcg

SEQ ID NO: 998 - protein, 240 aa, Neisseria gonorrhoeae
MPETGFRAFLRQMPSEATKQRFRRHPFQKRTIMKNIVILISGRGSNMQAIVNAAIPNVRIAAVLSNSETAAGLQWAAERGIPTDSLNHKNFESRLAFDTAMMEKIDAYQPDLVVLAGFMRILTPEFCAHYEGRLMNIHPSILPSFTGLHTHERALEAGCRVAGCTIHFVTAELDCGPIVSQGIVPILDGDTADDVAARVLAVEHKLYPKAVADVAAGRLIIEGNRVRNSENADAARFLTA

SEQ ID NO: 999 - DNA, 912 bp, Neisseria gonorrhoeae
ttgtttgccgtcagcctgtcggtcggcattgccgatttccgctggtcggatgtgttttcgctgtccgacagccagcaagtgatgttcatcagccgcctgccgcgcacgtttgcgattgtgttgacgggcgcgtcgatggcggtggcggggatgattatgcagattctgatgcgcaaccgttttgtcgagccttctatggcgggtgcgggccaaagtgcggctttgggtttgcttctgatgtccctgctgctgcctgccgcgccgctgccggtcaaaatgtcggttgccgccgttgccgcgctgatcgggatgttggtctttatgctgctgatccgccgcctgccgccgacggcgcagctgatggtgccgctggtggggattattttcggcggcgtggttgaggcggtggcgacgtttgtcgcgtatgagtttgagatgctgcaaatgttgggcgtgtggcagcagggcgacttttcaagcgtgctgctggggcggtacgagctgctttggattacgggcggtttggcggtgtttgcctacctgattgccgaccggctgacgattttggggctgggcgagacggtgagcgtgaatttgggtttgaaccggacggcggtgttgtggtcgggtttgattattgtggcactgattacatcgctggtcattgtaacggtcggcaatattccgtttatcgggctggtcgtgccgaatatcgtcagccgcctgatgggcgacaggctgcgccaaagcctgcctgcggtcgccctcttgggcgcgtctttggttttattgtgcgacattatcggacgcatgattgtgtttccgtttgaaattccggtctccacggtttttggtgtgttgggtacggctttgtttttgtggcttttgttgaggaaacccgcctatgccgtc

SEQ ID NO: 1000 - protein, 304 aa, Neisseria gonorrhoeae
LFAVSLSVGIADFRWSDVFSLSDSQQVMFISRLPRTFAIVLTGASMAVAGMIMQILMRNRFVEPSMAGAGQSAALGLLLMSLLLPAAPLPVKMSVAAVAALIGMLVFMLLIRRLPPTAQLMVPLVGIIFGGVVEAVATFVAYEFEMLQMLGVWQQGDFSSVLLGRYELLWITGGLAVFAYLIADRLTILGLGETVSVNLGLNRTAVLWSGLIIVALITSLVIVTVGNIPFIGLVVPNIVSRLMGDRLRQSLPAVALLGASLVLLCDIIGRMIVFPFEIPVSTVFGVLGTALFLWLLLRKPAYAV

SEQ ID NO: 1001 - DNA, 111 bp, Neisseria gonorrhoeae
ttggccaggttgagggaaaaaggtttggcagtcataaacagaagggaaaagcgttacggcgtaggagattcaaacaaggcagtccgaaccgtcggagcggaaagccttgtt

SEQ ID NO: 1002 - protein, 37 aa, Neisseria gonorrhoeae
LARLREKGLAVINRREKRYGVGDSNKAVRTVGAESLV

SEQ ID NO: 1003 - DNA, 207 bp, Neisseria gonorrhoeae
atgaaacggcggcattcgatgccgtctgaaacacggatgcaaaccgcttcctgtgtttcagacggcattgcccgatacgggcgttatcgcgggaatggcggcaagcgttttgattggaacttgccccatcctctgcccgtccggaggtttcaaacaaggctttccgctccgacggttcggactgccttgtttgaatctcctacgccg

SEQ ID NO: 1004 - protein, 69 aa, Neisseria gonorrhoeae
MKRRHSMPSETRMQTASCVSDGIARYGRYRGNGGKRFDWNLPHPLPVRRFQTRLSAPTVRTALFESPTP

SEQ ID NO: 1005 - DNA, 966 bp, Neisseria gonorrhoeae
ttgcgtttgaccgcattgaccctctgcaccgtcctcgccttgggcgcgtgttcgccgcaaaattccgaccctgccccacaagccaaagaacaggcggtttccgccgcacaatccgaaagcgcgtccgttaccgtcaaaaccgcgcgcggcgacgttcaaataccgcaaaaccccgaacgcatcgccgtttacgatttgggtatgctcgacaccttgagcaaactgggcgtgaaaaccggtttgtccgtcgataaaaaccgcctgccgtatttagaggaatatttcaaaacgacaaaacctgccggaactttgttcgatccggattacgaaacactcaatgcctacaagccgcagctcatcatcatcggcagccgcgccgccaaggcgtttgacaaattgaacgaaatcgcgccgaccatcgagatgaccgccgacaccgccaacctcaaagaaagtgccaaagagcgcatcgacgcgctggcgcaaatcttcggcaaacaggcggaagccgacaagctgaaggcggaaatcgacgcgtcttttgaagcggcgaaaaccgccgcgcaaggcaaaggcaaaggcaaaggtttggtggttttggtcaacggcggcaagatgtcggctttcggcccgtcttcacgactgggcggctggctgcacaaagacatcggcgttcccgctgtcgatgaatcaattaaagaaggcagccacggccagcctatcagcttcgaatacttgaaagagaaaaatcccgactggctgttcgtcctcgaccgcagcgcggccatcggcgaagagggtcaggcggcgaaagacgtgttgaacaatccgctggttgccgaaacgaccgcatggaaaaaaggacaggtcgtttacctcgttcccgaaacttatttggcagccggcggcgcgcaagagctgctgaacgcaagcaaacaggttgcggatgcgttcaacgccgcgaaa

SEQ ID NO: 1006 - protein, 322 aa, Neisseria gonorrhoeae
LRLTALTLCTVLALGACSPQNSDPAPQAKEQAVSAAQSESASVTVKTARGDVQIPQNPERIAVYDLGMLDTLSKLGVKTGLSVDKNRLPYLEEYFKTTKPAGTLFDPDYETLNAYKPQLIIIGSRAAKAFDKLNEIAPTIEMTADTANLKESAKERIDALAQIFGKQAEADKLKAEIDASFEAAKTAAQGKGKGKGLVVLVNGGKMSAFGPSSRLGGWLHKDIGVPAVDESIKEGSHGQPISFEYLKEKNPDWLFVLDRSAAIGEEGQAAKDVLNNPLVAETTAWKKGQVVYLVPETYLAAGGAQELLNASKQVADAFNAAK

SEQ ID NO: 1007 - DNA, 144 bp, Neisseria gonorrhoeae
gtgcagagggtcaatgcggtcaaacgcaacatagggtgtctccaaaatggggatattggggcaaagccgccggtcggacaaaccggaacggctttagaaaggataaatgataatctatatcaaattatcaggacagatgccgtc

SEQ ID NO: 1008 - protein, 48 aa, Neisseria gonorrhoeae
VQRVNAVKRNIGCLQNGDIGAKPPVGQTGTALERINDNLYQIIRTDAV

SEQ ID NO: 1009 - DNA, 1020 bp, Neisseria gonorrhoeae
atggctttccaccatcacgcccatgatattgccgccgtcctgttccaattggtcggcaatgtcttgtgccacttccatctgccgggtgtaatccttgcggctgttggcgtggctgcaatcgatcatcagcttgtcggttacccctgccgcacgcagttgttccaccgcctcgctgacgtgtcccgcatcataattcggctcttttccgccgcgcaaaatgacatgacagtcgggattgccgccggtatggacaatggcggaatgcccggccttggttacagacaagaaatgatgcgaatggctcgccgcaccgattgcgtcgatcgcaatcttcaaattgccgtccgtaccgtttttaaagccgacggggcaggacagaccgcttgccaattcgcggtggacttggctttcggtcgtccgcgcgccgattgccccccaagaaatcaggtcggcataatactggggtgtaatcatatccaaaaattcggtagaggcaggcatgcccatattattcagggacaacaacagactgcgcgcctgacgcaaaccgaaattgatgtcgaacgtaccgtccaaatgcgggtcgttaatcaaacctttccaacccaccgtcgttctcggcttctcgaaataaacgcgcatcacgatcaaaagctcgttttcataccgcttgcggagtttcaacagacgttccgcatattccaacgccgctttcggatcgtgaatcgaacacggcccgataatgaccaacagccgcctgtccctgccgtgaaccaaatcggaaagttcctggcggatgcggtgaaccaagcccgaagcctctttggaaatcggcagctcgtaaagatgggcaatcggcggcaacaactctttaacttctttaatcttaatatcgtctgtggggtaatggtgtgtcatcttgcatctttcctgatgggtttttatacgctgcttaggttacatcgtttaccttgcacaaacaagtgcaacatattactacaaagctattttatttcaaaa

SEQ ID NO: 1010 - protein, 340 aa, Neisseria gonorrhoeae
MAFHHHAHDIAAVLFQLVGNVLCHFHLPGVILAAVGVAAIDHQLVGYPCRTQLFHRLADVSRIIIRLFSAAQNDMTVGIAAGMDNGGMPGLGYRQEMMRMARRTDCVDRNLQIAVRTVFKADGAGQTACQFAVDLAFGRPRADCPPRNQVGIILGCNHIQKFGRGRHAHIIQGQQQTARLTQTEIDVERTVQMRVVNQTFPTHRRSRLLEINAHHDQKLVFIPLAEFQQTFRIFQRRFRIVNRTRPDNDQQPPVPAVNQIGKFLADAVNQARSLFGNRQLVKMGNRRQQLFNFFNLNIVCGVMVCHLASFLMGFYTLLRLHRLPCTNKCNILLQSYFISK

SEQ ID NO: 1011 - DNA, 2139 bp, Neisseria gonorrhoeae
atgaacgccccgtttttccgcctcagcctgctctcgctcacacttgccgccggctttgcccacgcggcagaaaataatgccaatgtcgcattggataccgttaccgtaaaaggcgaccgccaaggcagcaaaatccgtaccaacatcgttacgcttcaacaaaaagacgaaagcaccgcaaccgatatgcgcgaactcttaaaagaagagccctccatcgatttcggcggcggcaacggcacgtcccaattcctgacgctgcgcggcatgggtcagaactctgtcgacatcaaggtggacaacgcctattccgacagccaaatcctttaccaccaaggcagatttattgtcgatcccgctttggttaaagtcgtttccgtacaaaaaggcgcgggttccgcctctgccggtatcggcgcgaccaacggcgcgattatcgccaaaaccgtcgatgcccaagacctgctcaaaggcttggataaaaactggggcgtgcgcctcaacagcggctttgccggcaacaacggcgtaagctacggcgcaagcgtattcggaaaagagggcaacttcgacggtttgttctcttacaaccgcaacgatgaaaaagattacgaagccggcaaaggcttccgcaatgtcaacggcggcaaaaccgtaccgtacagcgcgctggacaaacgcagctacctcgccaaaatcggaacaaccttcggcgacggcgaccaccgcatcgtattgagccatatgaaagaccaacaccggggcatccgcactgtgcgtgaagagtttgccgtcggcggcgaaaattcacggataactattaaacgccaagcccctgcctaccgcgaaaccacacaatccaacaccaatttggcgtacaccggcaaagatttgggctttgtcgaaaaactggatgccaacgcctatgtgctggaaaaaaaacgctattccgccgatgacaaagataacggctacgcaggcaatgtaaaaggccccaaccatacccgaatcgccactcggggcatgaacttcaacttcgacagccgccttgccgaacaaaccctgttgaaatacggcatcaactaccgccatcaggaaatcaaaccgcaagcgtttttgaattcacaatttaaaattgaagataaaaaagatgcaactgaggaagataaaaagaagaaccgtgaaaatgaaaaaattgccaaagcctaccgtctgaccaacccgaccaaaaccgataccggcgcgtatatcgaagccattcacgagattgacggctttaccctgaccggcgggctgcgttacgaccgcttcaaggtgaaaacccacgacggcaaaaccgtttcaagcagcagcctcaacccgagtttcggcgtgatttggcagccgcgcgaacactggagcttcagcgcgagccacaactacgccagccgcagcccgcgcctgtatgacgcgctgcaaacccacggcaaacgcggcatcatctcgattgccgacggcaccaaagccgaacgcgcgcgcaataccgaaatcggcttcaactacaacgacggcacgtttgccgcaaacggcagctacttccggcagaccatcaaagacgcgcttgccaatccgcaaaaccgccacgactctgtcgccgtccgcgaagccgtcaacgccggctacatcaaaaaccacggttacgaattgggcgcgtcctaccgcaccggcggcctgaccgccaaagtcggcgtaagccgcagcaaaccgcgcttttacgatacccatcctaaaaaactgttgagcgcgaaccccgagtttggcgcacaaaccggccgcacttggacggcctcccttgcctaccgcttcaaaaacccgaatctggaaatcggctggcgcggacgctatgttcaaaaagctacgggttcgatattggcggcagggcaaaaagaccgcgacggcaaattggaaaacgttgtacgccaaggtttcggtgtgaacgatgtcttcgccaactggaaaccgctgggcaaagacacgctcaatgttaatctttcggttaacaacgtgttcgacaagttctactatccgcacagccaacgctggaccaataccctgccgggcgtgggacgtgatgtacgcctgggcgtgaactacaagttc

SEQ ID NO: 1012 - protein, 713 aa, Neisseria gonorrhoeae
MNAPFFRLSLLSLTLAAGFAHAAENNANVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFAGNNGVSYGASVFGKEGNFDGLFSYNRNDEKDYEAGKGFRNVNGGKTVPYSALDKRSYLAKIGTTFGDGDHRIVLSHMKDQHRGIRTVREEFAVGGENSRITIKRQAPAYRETTQSNTNLAYTGKDLGFVEKLDANAYVLEKKRYSADDKDNGYAGNVKGPNHTRIATRGMNFNFDSRLAEQTLLKYGINYRHQEIKPQAFLNSQFKIEDKKDATEEDKKKNRENEKIAKAYRLTNPTKTDTGAYIEAIHEIDGFTLTGGLRYDRFKVKTHDGKTVSSSSLNPSFGVIWQPREHWSFSASHNYASRSPRLYDALQTHGKRGIISIADGTKAERARNTEIGFNYNDGTFAANGSYFRQTIKDALANPQNRHDSVAVREAVNAGYIKNHGYELGASYRTGGLTAKVGVSRSKPRFYDTHPKKLLSANPEFGAQTGRTWTASLAYRFKNPNLEIGWRGRYVQKATGSILAAGQKDRDGKLENVVRQGFGVNDVFANWKPLGKDTLNVNLSVNNVFDKFYYPHSQRWTNTLPGVGRDVRLGVNYKF

SEQ ID NO: 1013 - DNA, 105 bp, Neisseria gonorrhoeae
ttgttaatccactatacatttccgacaaaacctgtcaacaaaaaacaacgcttcgcaaataaaaacgataatcagctttacacaacccccccccccccgctaata

SEQ ID NO: 1014 - protein, 35 aa, Neisseria gonorrhoeae
LLIHYTFPTKPVNKKQRFANKNDNQLYTTPPPPLI

SEQ ID NO: 1015 - DNA, 288 bp, Neisseria gonorrhoeae
atgaccatccgtcctttacacgaccgcgtcgtcgtcaaacgcttggaagctgaagaaaaaaccgcctctggcatcgtcctgccgggcgcggccgccgaaaaacccgatatgggcgaagtcatcgccgtgggtgcgggcaaaatcggcaaagacggcgcgcgccgtccgctggatgtcaaagccggcgacaaaatcattttcggcaaatacagcggccaaaccgtaaaagccgacggcgaagagctgttggtaatgcgcgaagaagatattttcggcatcgttgaaaaa

SEQ ID NO: 1016 - protein, 96 aa, Neisseria gonorrhoeae
MTIRPLHDRVVVKRLEAEEKTASGIVLPGAAAEKPDMGEVIAVGAGKIGKDGARRPLDVKAGDKIIFGKYSGQTVKADGEELLVMREEDIFGIVEK

SEQ ID NO: 1017 - DNA, 321 bp, Neisseria gonorrhoeae
atgccgtctgaaggcggtttgccgtttcagacggcatcgtgtccgtatttatttttcaacgatgccgaaaatatcttcttcgcgcattaccaacagctcttcgccgtcggcttttacggtttggccgctgtatttgccgaaaatgattttgtcgccggctttgacatccagcggacggcgcgcgccgtctttgccgattttgcccgcacccacggcgatgacttcgcccatatcgggtttttcggcggccgcgcccggcaggacgatgccagaggcggttttttcttcagcttccaagcgtttgacgacgacgcggtcgtg

SEQ ID NO: 1018 - protein, 107 aa, Neisseria gonorrhoeae
MPSEGGLPFQTASCPYLFFNDAENIFFAHYQQLFAVGFYGLAAVFAENDFVAGFDIQRTARAVFADFARTHGDDFAHIGFFGGRARQDDARGGFFFSFQAFDDDAVV

SEQ ID NO: 1019 - DNA, 1632 bp, Neisseria gonorrhoeae
atggcagcaaaagacgtacaattcggcaatgaagtccgccaaaaaatggtaaacggcgtgaatattttggcaaacgccgtgcgcgtaaccttgggccccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtaaaagaagtcgcgtccaaaaccaacgacgtagccggcgacggtacgactaccgccaccgtattggcacaatccatcgttgccgaaggcatgaaatacgttaccgccggcatgaacccgaccgatctgaaacgcggcatcgacaaagccgttgccgctttggttgaagagctgaaaaacatcgccaaaccttgcgatacttccaaagaaatcgcccaagtcggctcgatttccgccaactccgacgaacaagtcggcgcgattatcgccgaagcgatggaaaaagtcggcaaagaaggcgtgattaccgttgaagacggcaaatctttggaaaacgagctggacgtggttgaaggtatgcagttcgaccgcggctacctgtccccttactttatcaacgacgcggaaaaacaaatcgccggtctggacaatccgtttgttttgctgttcgacaaaaaaatcagcaacatccgcgacctgctgcccgtgttggaacaagtggcgaaagccagccgcccgctgttgattatcgctgaagacgtagaaggcgaagccttggcgactttggtcgtgaacaacatccgcggcatcctgaaaaccgttgccgtcaaagcccccggcttcggcgaccgccgcaaagcgatgctgcaagacatcgccatcctgaccggcggcgtagtgatttccgaagaagtcggcctgtctttggaaaaagcgactttggacgacttgggtcaagccaaacgcatcgaaatcggtaaagaaaacactaccgtcatcgacggcttcggcgacgcagcccaaatcgaagcgcgtgttgccgaaatccgccaacaaatcgaaaccgcgaccagcgattacgacaaagaaaaactgcaagagcgcgttgccaaactggcaggaggcgtggcagtgatcaaagtcggcgcggcgaccgaagtcgaaatgaaagagaaaaaagaccgcgtggaagacgcgctgcacgctacccgcgcagccgttgaagaaggcgtggttgcaggcggcggcgtagccctgttgcgcgcccgtgccgctttggaaaacctgcacaccggcaatgccgaccaagacgcaggcgtacaaatcgtattgcgcgccgttgagtctccgctgcgccaaatcgttgccaacgcaggcggagaacccagcgtggtggtgaacaaagtgttggaaggcaaaggcaactacggttacaacgcaggctccggcgaatacggcgacatgatcggaatgggcgtactcgaccctgccaaagtaacccgttccgcgctgcaacacgccgcgtctatcgccggtctgatgctgacgaccgactgcatgattgccgaaatccctgaagaaaaaccggctgtgcccgatatggggggaatgggcggtatgggcggcatgatg

SEQ ID NO: 1020 - protein, 544 aa, Neisseria gonorrhoeae
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 1021 - DNA, 1716 bp, Neisseria gonorrhoeae
ttgttgtctgaaggtttcagacggcattgcttacatcatgccgcccataccgcccattccccccatatcgggcacagccggtttttcttcagggatttcggcaatcatgcagtcggtcgtcagcatcagaccggcgatagacgcggcgtgttgcagcgcggaacgggttactttggcagggtcgagtacgcccattccgatcatgtcgccgtattcgccggagcctgcgttgtaaccgtagttgcctttgccttccaacactttgttcaccaccacgctgggttctccgcctgcgttggcaacgatttggcgcagcggagactcaacggcgcgcaatacgatttgtacgcctgcgtcttggtcggcattgccggtgtgcaggttttccaaagcggcacgggcgcgcaacagggctacgccgccgcctgcaaccacgccttcttcaacggctgcgcgggtagcgtgcagcgcgtcttccacgcggtcttttttctctttcatttcgacttcggtcgccgcgccgactttgatcactgccacgcctcctgccagtttggcaacgcgctcttgcagtttttctttgtcgtaatcgctggtcgcggtttcgatttgttggcggatttcggcaacacgcgcttcgatttgggctgcgtcgccgaagccgtcgatgacggtagtgttttctttaccgatttcgatgcgtttggcttgacccaagtcgtccaaagtcgctttttccaaagacaggccgacttcttcggaaatcactacgccgccggtcaggatggcgatgtcttgcagcatcgctttgcggcggtcgccgaagccgggggctttgacggcaacggttttcaggatgccgcggatgttgttcacgaccaaagtcgccaaggcttcgccttctacgtcttcagcgataatcaacagcgggcggctggctttcgccacttgttccaacacgggcagcaggtcgcggatgttgctgatttttttgtcgaacagcaaaacaaacggattgtccagaccggcgatttgtttttccgcgtcgttgataaagtaaggggacaggtagccgcggtcgaactgcataccttcaaccacgtccagctcgttttccaaagatttgccgtcttcaacggtaatcacgccttctttgccgactttttccatcgcttcggcgataatcgcgccgacttgttcgtcggagttggcggaaatcgagccgacttgggcgatttctttggaagtatcgcaaggtttggcgatgtttttcagctcttcaaccaaagcggcaacggctttgtcgatgccgcgtttcagatcggtcgggttcatgccggcggtaacgtatttcatgccttcggcaacgatggattgtgccaatacggtggcggtagtcgtaccgtcgccggctacgtcgttggttttggacgcgacttcttttaccatttgcgcgcccatattttcaaacttgtctttcagttcgatttctttggcgacggttacgccgtctttggtgatgtgcgggccgccgaaagcgcggtcaaccaccacgttgcggcctttggggcccaaggttacgcgcacggcgtttgccaaaatattcacgccgtttaccattttttggcggacttcattgccgaattgtacgtcttttgctgccatttcaattctccaaaaatcttaaaactgtctgataaaaccgtttatgccgtc

SEQ ID NO: 1022 - protein, 572 aa, Neisseria gonorrhoeae
LLSEGFRRHCLHHAAHTAHSPHIGHSRFFFRDFGNHAVGRQHQTGDRRGVLQRGTGYFGRVEYAHSDHVAVFAGACVVTVVAFAFQHFVHHHAGFSACVGNDLAQRRLNGAQYDLYACVLVGIAGVQVFQSGTGAQQGYAAACNHAFFNGCAGSVQRVFHAVFFLFHFDFGRRADFDHCHASCQFGNALLQFFFVVIAGRGFDLLADFGNTRFDLGCVAEAVDDGSVFFTDFDAFGLTQVVQSRFFQRQADFFGNHYAAGQDGDVLQHRFAAVAEAGGFDGNGFQDAADVVHDQSRQGFAFYVFSDNQQRAAGFRHLFQHGQQVADVADFFVEQQNKRIVQTGDLFFRVVDKVRGQVAAVELHTFNHVQLVFQRFAVFNGNHAFFADFFHRFGDNRADLFVGVGGNRADLGDFFGSIARFGDVFQLFNQSGNGFVDAAFQIGRVHAGGNVFHAFGNDGLCQYGGGSRTVAGYVVGFGRDFFYHLRAHIFKLVFQFDFFGDGYAVFGDVRAAESAVNHHVAAFGAQGYAHGVCQNIHAVYHFLADFIAELYVFCCHFNSPKILKLSDKTVYAV

SEQ ID NO: 1023 - DNA, 276 bp, Neisseria gonorrhoeae
ttgttaatccgctatatttcccgccatcccaaaaacgaagagcggcaggaatttatcggaaaaacagcaacctttccgccgtcattcccgcgaaagcgggaatctaggttcgtccggtttcggttatttccgatagattcctgccgcgttgggggtctggattcccgcctgcgcgggaatgaccggactttaggtttctgtttttgtttttctgtttttgcgggaatgacggggaagttggcggttgtttcttatggagtggtttttgtatttgga

SEQ ID NO: 1024 - protein, 92 aa, Neisseria gonorrhoeae
LLIRYISRHPKNEERQEFIGKTATFPPSFPRKRESRFVRFRLFPIDSCRVGGLDSRLRGNDRTLGFCFCFSVFAGMTGKLAVVSYGVVFVFG

SEQ ID NO: 1025 - DNA, 105 bp, Neisseria gonorrhoeae
ttgaaaacgaaaaattttttatccaaatacaaaaaccactccataagaaacaaccgccaacttccccgtcattcccgcaaaaacagaaaaacaaaaacagaaacc

SEQ ID NO: 1026 - protein, 35 aa, Neisseria gonorrhoeae
LKTKNFLSKYKNHSIRNNRQLPRHSRKNRKTKTET

SEQ ID NO: 1027 - DNA, 174 bp, Neisseria gonorrhoeae
ttggataaaaaatttttcgttttcaagccttcaccgcttgccatcggcgttaaaattttttacgataagcacatagattgtaaacaatcggccacaagccggtttgttttttcagaagacattatccctgtcagacgctgtttctatatatgtttgcctataacggcttgtttt

SEQ ID NO: 1028 - protein, 58 aa, Neisseria gonorrhoeae
LDKKFFVFKPSPLAIGVKIFYDKHIDCKQSATSRFVFSEDIIPVRRCFYICLPITACF

SEQ ID NO: 1029 - DNA, 159 bp, Neisseria gonorrhoeae
ttgataaaaacaatacccgccattcattcgggcaaaaccgcacggaacatccgttttcccgtttccacgacaatccggtacaggacaccccgctgccgattccgcctgcacatccggcaaaatttcatacgcaaggaaaatgttgaaaacaaaaagaac

SEQ ID NO: 1030 - protein, 53 aa, Neisseria gonorrhoeae
LIKTIPAIHSGKTARNIRFPVSTTIRYRTPRCRFRLHIRQNFIRKENVENKKN

SEQ ID NO: 1031 - DNA, 120 bp, Neisseria gonorrhoeae
ttgaaaataccggattatctccaagaaaactccccttgtgccgccatacgccgcctgccggcgcaagataacctttgccaatttgcagaatttacgttaaccttacgttttccgcaccca

SEQ ID NO: 1032 - protein, 40 aa, Neisseria gonorrhoeae
LKIPDYLQENSPCAAIRRLPAQDNLCQFAEFTLTLRFPHP

SEQ ID NO: 1033 - DNA, 1002 bp, Neisseria gonorrhoeae
ttgaaccccgccacttggacatctgtccttcggggcggtagaatcaaaccttattttggaaggttcaatcccttccaaaacagggcaacacacagattgacgctttatgtgtcatcctgtgtgttgaaacattcaaactcggctataatcccgtttttccgactttatcgacagcgaagatccatcatgaacaccattttcaaaatcagcgcactgaccctttccgccgctttggcactttccgcctgcggcaaaaaagaagccgcccccgcatctgcatccgaacctgccgccgcttctgccgcgcagggcgacacctcttcaatcggcagcacgatgcagcaggcaagctatgcaatgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccaaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaat

SEQ ID NO: 1034 - protein, 334 aa, Neisseria gonorrhoeae
LNPATWTSVLRGGRIKPYFGRFNPFQNRATHRLTLYVSSCVLKHSNSAIIPFFRLYRQRRSIMNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 1035 - DNA, 105 bp, Neisseria gonorrhoeae
gtgttgacgggcaacatatcatctgcgcggaaagttaccgtatcggcaaacgcgactgaaaaagacagcgtgttcggcgatgcggtgcacattgtgattgcgact

SEQ ID NO: 1036 - protein, 35 aa, Neisseria gonorrhoeae
VLTGNISSARKVTVSANATEKDSVFGDAVHIVIAT

SEQ ID NO: 1037 - DNA, 1179 bp, Neisseria gonorrhoeae
atgaccgaaccgacctcccgccgccgttttctgaaaacctgcaccgccgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgccggttttaccgtaaccaaccaacaggcgggcagccgccgtttccaacggtttgccggcacggacgcgcaacgcgcggcagatttccaagaggtcgcctccggccgcgtcgccacgcctaaagtgctgatgggcttgcgcggcggttacggtgcggcgcggattctgccgcatatcgattttgcctcgctcggcgcaaggatgcgcgaacacggcacgctgtttttcggattcagcgacgtatgcgccgtccaactggcattgttggcaaaaggcaatatgatgagttttgccggcccgatggcttatagcgattttggcaaacctgcccccggtgcgtttacgatggatgcctttatcaagggggcaacccaaaaccgcctgaccgttgatgttccttatatccaacgcgccgatgtcgaaaccgaaggcacgttgtggggcggcaacttaagcgtcctcgcctcgctcgccggtacgccttatatgcccgacatcgacggcggcattttgttcctcgaagatgtcggcgaacagccctaccgcatcgaacgtatgctcaatacgctgtatctttcgggtattttgggcaaacagcgcgccatcgtgttcggcgatttccgtatggaaaaaattcgagatctctatgattcgtcttatgatttttccgccgttgccaagcatatttcgcgcacggcgaaaatccccgtgctgacgggcttcccgttcggacacattgccgacaaaatcactttccctctgggcgcgcacacccgaatccgtatgaacggaaacggcggctattcggtcgcgtttgaaggctaccccacactcgatgcgtccgccctgactttggataccctgctcccaccgccggatttgcctatcttccccgaaagcggtgttgccgatatttcggaa

SEQ ID NO: 1038 - protein, 393 aa, Neisseria gonorrhoeae
MTEPTSRRRFLKTCTAAGAGLLQACGTSATSVPPLPSSHSVVKARTVPLQTPRRQSSDGNLLRVVASSGFAEDTNRVNTALTRLYNAGFTVTNQQAGSRRFQRFAGTDAQRAADFQEVASGRVATPKVLMGLRGGYGAARILPHIDFASLGARMREHGTLFFGFSDVCAVQLALLAKGNMMSFAGPMAYSDFGKPAPGAFTMDAFIKGATQNRLTVDVPYIQRADVETEGTLWGGNLSVLASLAGTPYMPDIDGGILFLEDVGEQPYRIERMLNTLYLSGILGKQRAIVFGDFRMEKIRDLYDSSYDFSAVAKHISRTAKIPVLTGFPFGHIADKITFPLGAHTRIRMNGNGGYSVAFEGYPTLDASALTLDTLLPPPDLPIFPESGVADISE

SEQ ID NO: 1039 - DNA, 180 bp, Neisseria gonorrhoeae
atgatagtgtggttcttccatgcgaaagtaggtcactgccaaacaccctttcagaaaacccccggatatccgggggtttttgctttgcccggaaaaaatgtcggggatggcgggacggcatctgtacggtgtccggtcgggtttgcggaggaacggcttgaaactttgggatattcattt

SEQ ID NO: 1040 - protein, 60 aa, Neisseria gonorrhoeae
MIVWFFHAKVGHCQTPFQKTPGYPGVFALPGKNVGDGGTASVRCPVGFAEERLETLGYSF

SEQ ID NO: 1041 - DNA, 1584 bp, Neisseria gonorrhoeae
atgtttgcctataacggcttgtttttaataaataattcaagaggtatcaacgtgtctgattccaaaacgaaagaacgcgccacattcggcacgcgccgcgcgtttatgattgccgccatcgggtccgccgtcggcttgggcaatatttggcgtttcccctatattgcttttgaaaacggcggcggcgcgttcatcctgccctatctggtcgcgcttctgacggcgggcatcccgctgctgctgctcgattatgccatcggccaccgttaccggggttctgcgcccttggctttccgccgcctcggacgctggttcgagccggtcggctggtggaacgtgatgaccaatatcgtcatctgcatctattacgcagtgattatcggttgggcggcaagctatacctattattcggtcaacgccgcctggggtgcggatccgcagggttttttctttaaggacttcctgcaaatggcgggcccggaagccttgggtttggattttgtcggcaaagtcgccggccctttggcgggcgtgtgggtttttaccgccgccattatggctttgggcgtgcaaaagggcgtggcgcgcgcctcgtcgttctttatgccgctgcttttggtgatgtttttgattatggtcggcatttcgctgacgctgccgggtgcggcaaagggcttggacgcattgtttacgcccgactggtcgaaactcgccgattccaaggtctgggtggcggcatacgggcagattttcttttcgctttccatctgcttcggcattatggttacctattcttcttatttgaagaaaaaaaccgacttgggcggaacggggctggtggtcggttttgccaacagcagcttcgaactgctcgcgggcatcggcgtgtttgccgcattgggctttatggcgcaggcgggcggcaaggcggtcaacgaggttgcctccggcggcatcggtttggcgtttatcgcctttccgaccattatcaaccaggcgccgatgggctggctgatcggcatattgtttttcggttcgctggtgttcgccggcgttacgtcgatgatttccatccttgaagtgattgtggcggcgattcaggacaagctgaacatcgggcgcgtcaacgccacgctgctggtctgcattccgatgggcattgtttccacgctgctgttcggtacggcgacggggctgcctgttttggacgtgatggacaaattcgtcaacacctacggcattgttgccgccggctttgtttatgttgccgccatcatcatcggcggcaggttgccggaattacgcaggcacctgaacgccttgtcctccatccgcgtcggcggcttgtggacggcctgcgtcgtgtttaccgtcgtgatgctcggctatatgctgtatcaggacaccgccggattgttggaaaaaaactacggcgattatccggatggtttcctcaatattttcggctgggggatgtcggcggcgttaatcatgttcgggctgctgctgtcgctgctgccttggaaacacggtcaggattttaatgtcaaagacgaacacgaacatgaacaaggaggagaaaaa

SEQ ID NO: 1042 - protein, 528 aa, Neisseria gonorrhoeae
MFAYNGLFLINNSRGINVSDSKTKERATFGTRRAFMIAAIGSAVGLGNIWRFPYIAFENGGGAFILPYLVALLTAGIPLLLLDYAIGHRYRGSAPLAFRRLGRWFEPVGWWNVMTNIVICIYYAVIIGWAASYTYYSVNAAWGADPQGFFFKDFLQMAGPEALGLDFVGKVAGPLAGVWVFTAAIMALGVQKGVARASSFFMPLLLVMFLIMVGISLTLPGAAKGLDALFTPDWSKLADSKVWVAAYGQIFFSLSICFGIMVTYSSYLKKKTDLGGTGLVVGFANSSFELLAGIGVFAALGFMAQAGGKAVNEVASGGIGLAFIAFPTIINQAPMGWLIGILFFGSLVFAGVTSMISILEVIVAAIQDKLNIGRVNATLLVCIPMGIVSTLLFGTATGLPVLDVMDKFVNTYGIVAAGFVYVAAIIIGGRLPELRRHLNALSSIRVGGLWTACVVFTVVMLGYMLYQDTAGLLEKNYGDYPDGFLNIFGWGMSAALIMFGLLLSLLPWKHGQDFNVKDEHEHEQGGEK

SEQ ID NO: 1043 - DNA, 90 bp, Neisseria gonorrhoeae
atgagtacttccgccattgtgatgatggttgccgccatcgcggtgatttggggcgggctgctgctttccctgttaaggctgccggaagag

SEQ ID NO: 1044 - protein, 30 aa, Neisseria gonorrhoeae
MSTSAIVMMVAAIAVIWGGLLLSLLRLPEE

SEQ ID NO: 1045 - DNA, 420 bp, Neisseria gonorrhoeae; identical to SEQ ID NO: 235

SEQ ID NO: 1046 - protein, 140 aa, Neisseria gonorrhoeae; identical to SEQ ID NO: 236

SEQ ID NO: 1047 - DNA, 1218 bp, Neisseria gonorrhoeae
atgaccctgttttgcgaacaagtcccctacccccgccttgccgaagaattcggcacgccgctttatgtgtacagccaatccgcgctgaccggagcatttgaaaactatcaaaccgcctttgccgctttgaacccgcttgtctgctacgccgtcaaggcaaacggcaacctgagcattatcaaacactttgcttctttgggcagcggttttgacattgtgtcgggcggcgaattggcacgcgttttggcggcaggcggcgatgcggcgaaaacgattttttccggcgtaggcaaaagcgaggcggaaatcgagttcgcgctgaatgccggcgtaaaatgcttcaatatggaaagcatccccgaaatcgaccgcattcagaaaattgccgcgcgtttgggcaaaaccgcgcccgtctccctgcgcgtcaatcccgatgtcgatgcaaaaacccatccctacatctccacaggtctgaaagccaacaaattcggcatcgcctacgccgacgcgctcgaagcctaccgccatgccgcacaacagcccaatttgaaaatcatcggcatcgactgccacatcggttcgcaactgaccgacttaagcccactggtcgaagcctgcgaacgcattttgattttggttgacgctcttgccgccgaaggcattgttttggaacatttggacttaggcggcggcgtcggcattgtttacaaagacgaaggcgtccccgatttgggtgcgtatgcccgagcggttcaaaaactgatggggacacgccgtctgaaactcattcttgagccaggccgcagcttggtcggcaacgcaggtgcattgctgacgcgcgtcgaatttgtcaaacacggtgaagagaaaaactttgtgatggtcgatgcggcgatgaacgatttgatgcgcccagccctatacgatgcctaccaccacatcgaagcggttgaaaccaaaaacattgagcctctgaccgccaacatcgtcggcccgatttgtgaaaccggcgacttcctcggcaaagaccgcaccatcgcctgcgaagaaggcgatttgctgcttatccgcagcgcgggcgcatacggggccagtatggctagcaattacaacacgcgcaaccgtgcggcggaggtgttggttgacggcggcggatacaaactcatccgccggcgcgaaaccttggaacagcaaatggcaaacgaactcgcctgccta

SEQ ID NO: 1048 - protein, 406 aa, Neisseria gonorrhoeae
MTLFCEQVPYPRLAEEFGTPLYVYSQSALTGAFENYQTAFAALNPLVCYAVKANGNLSIIKHFASLGSGFDIVSGGELARVLAAGGDAAKTIFSGVGKSEAEIEFALNAGVKCFNMESIPEIDRIQKIAARLGKTAPVSLRVNPDVDAKTHPYISTGLKANKFGIAYADALEAYRHAAQQPNLKIIGIDCHIGSQLTDLSPLVEACERILILVDALAAEGIVLEHLDLGGGVGIVYKDEGVPDLGAYARAVQKLMGTRRLKLILEPGRSLVGNAGALLTRVEFVKHGEEKNFVMVDAAMNDLMRPALYDAYHHIEAVETKNIEPLTANIVGPICETGDFLGKDRTIACEEGDLLLIRSAGAYGASMASNYNTRNRAAEVLVDGGGYKLIRRRETLEQQMANELACL

SEQ ID NO: 1049 - DNA, 168 bp, Neisseria gonorrhoeae
atgaaatacggcgtattttttgcggcggcaaccgccctcctgctttccgcctgcggttacaaaggcggcctctacctgcccaaagaaggcgatacggcgcgtttcggcgtgatccaaaccggtttgcagcttcaaggcaaaccgcaatccgccccaccaacccaaaaa

SEQ ID NO: 1050 - protein, 56 aa, Neisseria gonorrhoeae
MKYGVFFAAATALLLSACGYKGGLYLPKEGDTARFGVIQTGLQLQGKPQSAPPTQK

SEQ ID NO: 1051 - DNA, 273 bp, Neisseria gonorrhoeae
ttgttcgcaaaacagggtcatattttcgttttcatttttgggttggtggggcggattgcggtttgccttgaagctgcaaaccggtttggatcacgccgaaacgcgccgtatcgccttctttgggcaggtagaggccgcctttgtaaccgcaggcggaaagcaggagggcggttgccgccgcaaaaaatacgccgtatttcatcggtaaacttccttcataagcgcgaatgtggcaagattcggcatcttaaacaaaaaacacgcaaaaagcta

SEQ ID NO: 1052 - protein, 91 aa, Neisseria gonorrhoeae
LFAKQGHIFVFIFGLVGRIAVCLEAANRFGSRRNAPYRLLWAGRGRLCNRRRKAGGRLPPQKIRRISSVNFLHKRECGKIRHLKQKTRKKL

SEQ ID NO: 1053 - DNA, 321 bp, Neisseria gonorrhoeae
atgatgaccgaaagcgagtttatccgcgcgagcgaagcattatttgaacacatcgaagaccaaatcgacgaaaacggctgggatttcgactgccggtttgccggaaacgtcctgaccatcgaagccggagacggcacgcaaatcatcgtcaaccgccacacgcccaaccaagaattgtggattgccgcaaaaagcggcggctaccatttcgccgaacaaaacggcaaatggctggcaacgcgcgacagccgcgatttttacgacgttttaaacgaagccctgagcgcggcttcgggcgaagcggttgagattgccgaattg

SEQ ID NO: 1054 - protein, 107 aa, Neisseria gonorrhoeae
MMTESEFIRASEALFEHIEDQIDENGWDFDCRFAGNVLTIEAGDGTQIIVNRHTPNQELWIAAKSGGYHFAEQNGKWLATRDSRDFYDVLNEALSAASGEAVEIAEL

SEQ ID NO: 1055 - DNA, 426 bp, Neisseria gonorrhoeae
gtgatgttcgatggcaaaaccgcttcggcggtaggcggtaaagcgttcgcgcgcgtcggcgagatcttccaggctgttgccgacgatttccaaaacgcgcgcgggcaagaccgaagcggtgttccaaaaaccgtcggacaggttcaaaacggccatgccttcgggaattcggggcagattgccgtcgcaggcaagcaggacggatgtgtcagacggcatggcttcttccgtttcccaaatttcgtgcggaataaaactctcggcctcgtattgccaaagcattttgtccaattcctgaagccgtccgaacgagtcggaccacaccagtatcctgccgccgtctcggatagcgcgcgcaatcaaccgacaggtaaaaagggggatttggtcaacatgggtataaaaggtaactttcggcatattgtt

SEQ ID NO: 1056 - protein, 142 aa, Neisseria gonorrhoeae
VMFDGKTASAVGGKAFARVGEIFQAVADDFQNARGQDRSGVPKTVGQVQNGHAFGNSGQIAVAGKQDGCVRRHGFFRFPNFVRNKTLGLVLPKHFVQFLKPSERVGPHQYPAAVSDSARNQPTGKKGDLVNMGIKGNFRHIV

SEQ ID NO: 1057 - DNA, 225 bp, Neisseria gonorrhoeae
tttcaaagaaaaagaaacagattgataaaaacaatacccgccattcattcgggcaaaaccgcacggaacatccgttttcccgtttccacgacaatccggtacaggacaccccgctgccgattccgcctgcacatccggcaaaatttcatacgcaaggaaaatgttgaaaacaaaaagaactaattgcttgaaaaaagatttaattggaatgcgggtatttcccac

SEQ ID NO: 1058 - protein, 60 aa, Neisseria gonorrhoeae
FQRKRNRLIKTIPAIHSGKTARNIRFPVSTTIRYRTPRCRFRLHIRQNFIRKENVENKKN

SEQ ID NO: 1059 - DNA, 1191 bp, Neisseria gonorrhoeae
atgtaccgacacatcgaatactatcccggcgacccgattttgagtttggtcgaaaccttcaaaaacgacccgcgccccgaaaaagtcaatttgagcataggcatttatttcgacgacgaaggcagaatgcccgtattggaatccgtaagccgtgccgaaaccgcccgtgccgccgcgccagcgccgtcgccctacctgccgatggagggtttggacgtttaccgcagcgcggtgcagcatttgttgttcggcaaaggcaaccccgcgctcgcgcagggacgcatcgttaccgtacagactctgggcggctcgggcgcgctcaaagtcggggcggatttcctgcaccgctggtttcccgaagcgcgcgcctacgtcagcgatccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctcatcctccatccctgctgccacaacccgaccggcgtggatatgtcggaacggcaatgggacgaagtgttgcagatcatcaaaacgcgcaaactgattccgtttatggacatcgcctaccaaggcttcggcggcgatttggacagcgatgcctacgccgtccgcaaagcggtggaaatggatttgccgctgtttgtcagcaattcgttttcaaaaaacctgtcgctctacggcgaacgcgtcggcggcttaagcgtggtttgccccaataaagaagaagcggatttggtgttcggacaactcaaattcaccgtccgccgcatctactccagcccgcccgcgcacggcgcgtatatcgccgccgacgtgatgaacagctccgaactttacgccttgtggcaaaacgaagtttatatgatgcgcgaccgcatccgtgcgatgcggcagaaactttacggcgtattgaccgcccgaatccccgaccgcgatttcacttatttcatcaaacagcgcggaatgttcggctacacggggttgagcgtggggcaagtccgcaggttgcgcgacgaatttgccgtttacctgctggattccggcaggatgtgcgtcgccgggctgaatacatcaaatatcacttatgtcgccgatgcgcttgccgaagtgttgaaa

SEQ ID NO: 1060 - protein, 397 aa, Neisseria gonorrhoeae
MYRHIEYYPGDPILSLVETFKNDPRPEKVNLSIGIYFDDEGRMPVLESVSRAETARAAAPAPSPYLPMEGLDVYRSAVQHLLFGKGNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLQIIKTRKLIPFMDIAYQGFGGDLDSDAYAVRKAVEMDLPLFVSNSFSKNLSLYGERVGGLSVVCPNKEEADLVFGQLKFTVRRIYSSPPAHGAYIAADVMNSSELYALWQNEVYMMRDRIRAMRQKLYGVLTARIPDRDFTYFIKQRGMFGYTGLSVGQVRRLRDEFAVYLLDSGRMCVAGLNTSNITYVADALAEVLK

SEQ ID NO: 1061 - DNA, 144 bp, Neisseria gonorrhoeae
atgattggggatatgtttgtcggatacatcttcgacattgtagatgtgcaaggcatccaaaatcccctcttgcgaagcggcatagaagtagcccgtgttgccatcatcttcaaagacaacaccataagggatatgtttggaaaa

SEQ ID NO: 1062 - protein, 48 aa, Neisseria gonorrhoeae
MIGDMFVGYIFDIVDVQGIQNPLLRSGIEVARVAIIFKDNTIRDMFGK

SEQ ID NO: 1063 - DNA, 417 bp, Neisseria gonorrhoeae
atggcacaattacctctatatcggactgccgaaatcggaaattttactgtcggcacgcctaaagttttagaatcattttccaaacatatcccttatggtgttgtctttgaagatgatggcaacacgggctacttctatgccgcttcgcaagaggggattttggatgccttgcacatctacaatgtcgaagatgtatccgacaaacatatccccaatcatgtcttgattttatgggatggcgcctgcaccatagccgcattgtgtatcaacgactacatccatgccgtctatgattttgtcgaacaggcaggatattgccgcaacggcttccctgaagcaggcggcgaatgggtaaaagtcgaaaaccgcgtcttggacgatgaattgctggacaaaatcctatcccgaaaacctaca

SEQ ID NO: 1064 - protein, 139 aa, Neisseria gonorrhoeae
MAQLPLYRTAEIGNFTVGTPKVLESFSKHIPYGVVFEDDGNTGYFYAASQEGILDALHIYNVEDVSDKHIPNHVLILWDGACTIAALCINDYIHAVYDFVEQAGYCRNGFPEAGGEWVKVENRVLDDELLDKILSRKPT

SEQ ID NO: 1065 - DNA, 504 bp, Neisseria gonorrhoeae
atgcccctgttagacagtttcaaagtcgatcacacccgtatgcacgcccctgccgtacgcgtggcgaaaaccatgaccacgcccaaaggcgacaccattactgtattcgacctgcgcttttgcatccccaataaagaaatcctgcccgaaaaaggcatccacacgctggagcatttgtttgccggctttatgcgcgaccacttgaacggcgccggcgtggaaatcatcgacatttccccgatgggctgccgcaccggtttttatatgagccttatcggcacgccttccgaacagcaggttgccgatgcgtggttggcttcgatgcaggatgttttgaatgtcaaagaccaaagtaaaatccccgagttgaacgaataccaatgcggcacttatctgatgcactcgctcgccgaagcgcaacaaatcgcgcaaaacgtgttggcgcgcaaagtggcggttaaccgaaacggcgatttggctttggatgaaagcctgctgaacgct

SEQ ID NO: 1066 - protein, 168 aa, Neisseria gonorrhoeae
MPLLDSFKVDHTRMHAPAVRVAKTMTTPKGDTITVFDLRFCIPNKEILPEKGIHTLEHLFAGFMRDHLNGAGVEIIDISPMGCRTGFYMSLIGTPSEQQVADAWLASMQDVLNVKDQSKIPELNEYQCGTYLMHSLAEAQQIAQNVLARKVAVNRNGDLALDESLLNA

SEQ ID NO: 1067 - DNA, 213 bp, Neisseria gonorrhoeae
atgctgtctgaacaagggtttcagacggcatttgccttttccgttataatccggggttgtacgggggcgggttttaagccggcatcgtccttccctattttttctgtcccttatcggtttcaagcgggttttttatgtccaacagacctacactcctcctcgttgacggctcttcctatctctaccgcgcgtatcacgcgatggggcaaaacc

SEQ ID NO: 1068 - protein, 71 aa, Neisseria gonorrhoeae
MLSEQGFQTAFAFSVIIRGCTGAGFKPASSFPIFSVPYRFQAGFLCPTDLHSSSLTALPISTARITRWGKT

SEQ ID NO: 1069 - DNA, 2724 bp, Neisseria gonorrhoeae
atggggcaaaacctgactgcgcctgacggtgcgccgacgggtgcgctgtatggcgtattgaatatgttgcgccgtttgcggtcggaatatccgcacgattattgcgcggtggtttttgatgcgaaaggcaaaaatttccgccatcaaatgtttgaagaatacaaggcgacgcgcccgccgatgccggacgatttgcgcccgcaggcggaagccctgccggatttggtgcgcctgacgggctggccggtattggtgattgggcaagtggaggcggacgatgtgatcggcacgctggcgaaacagggggcggaacatggtttgcgagtcattgtttcgacgggcgataaggatatggcgcagttggtggatgagcgcgttacgctggtgaacacgatgagcggagaaacgctggatattgaaggcgtgaaggcaaaattcggcgttcgccccgaccaaatccgtgattatctcgcgctgatcggcgacaaggtggacaacgtaccgggcgtggaaaaatgcggcccgaaaacggcggtgaaatggctggaagcctacggttcgttgcaaggcgtgatggaacacgctccggaaatcaaaggcaaggtcggcgaaaacctgcaagccgcgctgccccaactgccgctgtcgtatgatttggtcacgattaaaaccgatgtggacttgcacaccgagctttcagacggcatcgaaagcctgcgccgtaccgcgccgaaatgggcgcagcttgcggttgatttcaaacgctggggcttccgtacttggctgaaagaagcggaatcaaacatgaataccggctcgaccgatgatttgttcggtagcgacagcatcggcgagcaggcggctttgaatgcggaaataccgtctgaaaaacgagctgaaaaagccaccgcccctgaaaaactggattatcaagccgttaccaccgaagctcagtttgccgccttgttggacaaactagcgaaggcggacacaatcggcattgatacggaaaccacgtcattagatgcgatgaatgccgagctggtcggcatcagcattgcgttccaagcaggcgaagcggtttacatccccgtaggccacagcctgactgccgcgcccgaacagcttgatttgcaagacgtattaggccgtctgaagccgcatttggaaaaccccgccctgaaaaaaatcggtcaaaacctcaaatacgaccaacacgttttcgccaactacggcatcgcgttaaacaacattgccggcgacgcgatgctcgcttcctacatcatcgagagccatctcggacacggcttggacgaattgtccggacgctggctcggtttagaaaccattacctacgaatcgctgtgcggcaaaggcgcgaagcaaatcagttttgccgatgtcgccatcgggcaggcgaccgaatacgccgcccaagatgccgatttcgccctgcgcctcgaagcgcgcctgcgcgcgcaaatggacgacaaacaacttgaaatgtatgaaaaaatggagcttcccgtcgcgcaggtattgtttgaaatggaatgcaacggcgtgcaaatcgaccgcgccgaactcgcccgccaaagcgcggaactcggcgcggagctgatgaagctcgaacaggaagcctacgccgctgcaggtcaaccgtttaacctcaactcgcccaaacagctgcaagaaatcctgttcgacaaaatgggcatcccgacaaaagggctgaaaaaaaccgccaaaggcggcatttccaccaacgaagccgtgctcgaacagctcgcgcccgactaccccctgcccaaaatcatcctgcaaaaccgcagcctggcgaaactcaaatccacctacaccgacaaactgcccgaaatgatttcgccccgggataaccgcgtgcataccacctatgcccaagccgtcgccattaccggccgcctcgccagcaacaaccccaacctgcaaaacatccccattcgcaccgccgaaggccgccgcgtgcgccgcgccttcactgcaccgccgggcagcgtcatcgtttccgccgactattcccaaatcgagctgcgcattatggcgcacctctccggtgacaaaaccctcattgccgcatttcaaagcggcgaagacgtacaccgccgcaccgccgccgaagtgttcggcactgcgcccgaaaacgtctcgcccgagcaacgccgctacgccaaaaccatcaacttcggcttaatctacggtatggggcaatacggtttggcaaaatcattgggcatcgacaacctttccgccaaaaactttatcgaccgctacttcgcccgttatcccggcgttgccgaatacatgcagcgcaccaaagaacaagccgccgcccaaggctacgtcgaaaccctgttcggcagaaggctctatttgcccgacatccgcaacaaaaacgccaacgcccgcgcaggagccgagcgtgccgccatcaacgcccccatgcaaggcaccgcttccgacctcatcaaacgcgccatgataaacgtgcgaaactggctttcagacggcatcggcagcaaactggtcatgcaggtgcatgacgaactggtgctggaagtcgttgaaaccgaactggattttgtcaaagaaaaactgccgcagattatggcgaaagtggacggcggattattggatgtaccgctggtggctgaggttggcgtaggggagaattgggaagaggcacat

SEQ ID NO: 1070 - protein, 908 aa, Neisseria gonorrhoeae
MGQNLTAPDGAPTGALYGVLNMLRRLRSEYPHDYCAVVFDAKGKNFRHQMFEEYKATRPPMPDDLRPQAEALPDLVRLTGWPVLVIGQVEADDVIGTLAKQGAEHGLRVIVSTGDKDMAQLVDERVTLVNTMSGETLDIEGVKAKFGVRPDQIRDYLALIGDKVDNVPGVEKCGPKTAVKWLEAYGSLQGVMEHAPEIKGKVGENLQAALPQLPLSYDLVTIKTDVDLHTELSDGIESLRRTAPKWAQLAVDFKRWGFRTWLKEAESNMNTGSTDDLFGSDSIGEQAALNAEIPSEKRAEKATAPEKLDYQAVTTEAQFAALLDKLAKADTIGIDTETTSLDAMNAELVGISIAFQAGEAVYIPVGHSLTAAPEQLDLQDVLGRLKPHLENPALKKIGQNLKYDQHVFANYGIALNNIAGDAMLASYIIESHLGHGLDELSGRWLGLETITYESLCGKGAKQISFADVAIGQATEYAAQDADFALRLEARLRAQMDDKQLEMYEKMELPVAQVLFEMECNGVQIDRAELARQSAELGAELMKLEQEAYAAAGQPFNLNSPKQLQEILFDKMGIPTKGLKKTAKGGISTNEAVLEQLAPDYPLPKIILQNRSLAKLKSTYTDKLPEMISPRDNRVHTTYAQAVAITGRLASNNPNLQNIPIRTAEGRRVRRAFTAPPGSVIVSADYSQIELRIMAHLSGDKTLIAAFQSGEDVHRRTAAEVFGTAPENVSPEQRRYAKTINFGLIYGMGQYGLAKSLGIDNLSAKNFIDRYFARYPGVAEYMQRTKEQAAAQGYVETLFGRRLYLPDIRNKNANARAGAERAAINAPMQGTASDLIKRAMINVRNWLSDGIGSKLVMQVHDELVLEVVETELDFVKEKLPQIMAKVDGGLLDVPLVAEVGVGENWEEAH

SEQ ID NO: 1071 - DNA, 96 bp, Neisseria gonorrhoeae
ttgagatggcaggcttttgtcggatacaagtatccgacctacggcttgctattgatttccaatcattcgaatcgggtattttacttccttaaattt

SEQ ID NO: 1072 - protein, 32 aa, Neisseria gonorrhoeae
LRWQAFVGYKYPTYGLLLISNHSNRVFYFLKF

SEQ ID NO: 1073 - DNA, 249 bp, Neisseria gonorrhoeae
atgcggatatttcacgggatgacaaaacgggcgcaaaaaagcccgattggaaaatccgaatcaggcttttttgtgatgttctgttcgatttgtgcgctaactgccgaccggagcgtccgcgcccggtttggcaggtcggattctcgaatccgactgctatttgagatggcaggcttttgtcggatacaagtatccgacctacggcttgctattgatttccaatcattcgaatcgggtattttacttcct

SEQ ID NO: 1074 - protein, 83 aa, Neisseria gonorrhoeae
MRIFHGMTKRAQKSPIGKSESGFFVMFCSICALTADRSVRARFGRSDSRIRLLFEMAGFCRIQVSDLRLAIDFQSFESGILLP

SEQ ID NO: 1075 - DNA, 183 bp, Neisseria gonorrhoeae
atgattttgcattatttttgttatgcggatatttcacgggatgacaaaacgggcgcaaaaaagcccgattggaaaatccgaatcaggcttttttgtgatgttctgttcgatttgtgcgctaactgccgaccggagcgtccgcgcccggtttggcaggtcggattctcgaatccgactgctatt

SEQ ID NO: 1076 - protein, 61 aa, Neisseria gonorrhoeae
MILHYFCYADISRDDKTGAKKPDWKIRIRLFCDVLFDLCANCRPERPRPVWQVGFSNPTAI

SEQ ID NO: 1077 - DNA, 126 bp, Neisseria gonorrhoeae
ttgaaaaaagatttaattggaatgcgggtatttcccacactttctccatttatttatcctcattataaaaacatgaaaaaaaacccctgcttgcactctcacttgcagccgtgtccgccgttacgg

SEQ ID NO: 1078 - protein, 42 aa, Neisseria gonorrhoeae
LKKDLIGMRVFPTLSPFIYPHYKNMKKNPCLHSHLQPCPPLR

SEQ ID NO: 1079 - DNA, 498 bp, Neisseria gonorrhoeae
ttgccacaatgccgtctgaagcttttcagacggcatcatcctgtcaaatgctcaaacaatatgccgaaagttaccttttatacccatgttgaccaaatccccctttttacctgtcggttgattgcgcgcgctatccgagacggcggcaggatactggtgtggtccgactcgttcggacggcttcaggaattggacaaaatgctttggcaatacgaggccgagagttttattccgcacgaaatttgggaaacggaagaagccatgccgtctgacacatccgtcctgcttgcctgcgacggcaatctgccccgaattcccgaaggcatggccgttttgaacctgtccgacggtttttggaacaccgcttcggtcttgcccgcgcgcgttttggaaatcgtcggcaacagcctggaagatctcgccgacgcgcgcgaacgctttaccgcctaccgccgaagcggttttgccatcgaacatcacggcatggagggcaaggca

SEQ ID NO: 1080 - protein, 166 aa, Neisseria gonorrhoeae
LPQCRLKLFRRHHPVKCSNNMPKVTFYTHVDQIPLFTCRLIARAIRDGGRILVWSDSFGRLQELDKMLWQYEAESFIPHEIWETEEAMPSDTSVLLACDGNLPRIPEGMAVLNLSDGFWNTASVLPARVLEIVGNSLEDLADARERFTAYRRSGFAIEHHGMEGKA

SEQ ID NO: 1081 - DNA, 114 bp, Neisseria gonorrhoeae
atgcaaaatcatgacaaaaccggcgcgaggttacacaaacggatgaaatcaaccgatattcaaacacagccatttttagcgcattttcagcgtatctttatgcggaaaatttcg

SEQ ID NO: 1082 - protein, 38 aa, Neisseria gonorrhoeae
MQNHDKTGARLHKRMKSTDIQTQPFLAHFQRIFMRKIS

SEQ ID NO: 1083 - DNA, 693 bp, Neisseria gonorrhoeae
gtgtttcccgacaaatacaagttgagtttggaagaaaatatttttctggcaaagaaagtattggttgctcaaattcacaacctcagccgttttgagaattgtcagacgaccttgttgcagaccgagcaaattatcaatgacaaaaatgtagcctccgcgtcactggaagacatccaaaccatcttgaacctgaaacgtgcctatcaatatgtgatttcgcatatttcaaacggcgaaccggtcaatatttcactccttaaaagaatcaacaacattgttgccaaggacgattctttggtacccgtggatttccgtaccggttcggtcggcgtaacgctattggacggttcccgtcatgccccgaatccggtgaaggaaattgaagtggcccgcgtgttgcaaaatatcggactgcaaagcggttcgacgacggaaacagccgttcgtttcatgctctattgtatgcggcagcaggttttttgggacggcaacaaacggacggcaaccctatttgccaacggcctgatgatggcggggggctgcggtatcctggaaatctccgaaatgcagatgccgcgattcaatgaaaaactatccgcattctatcgcaccggcgacgataccgatatttccaagtttgtgtatcaaaattgtatatcgggcatagactatttcggcgcggacgaagatata

SEQ ID NO: 1084 - protein, 231 aa, Neisseria gonorrhoeae
VFPDKYKLSLEENIFLAKKVLVAQIHNLSRFENCQTTLLQTEQIINDKNVASASLEDIQTILNLKRAYQYVISHISNGEPVNISLLKRINNIVAKDDSLVPVDFRTGSVGVTLLDGSRHAPNPVKEIEVARVLQNIGLQSGSTTETAVRFMLYCMRQQVFWDGNKRTATLFANGLMMAGGCGILEISEMQMPRFNEKLSAFYRTGDDTDISKFVYQNCISGIDYFGADEDI

SEQ ID NO: 1085 - DNA, 165 bp, Neisseria gonorrhoeae
ttgcctcgccttgccgtactatttttactgtctgcggcttcgccgccttgtcctgatttaaatttaatccactatagatttccccgactcgccgaacatgggctaaaaatcaatttgacggttatcagacgatggagtaggcacaaggtggcagaaaaaggggtt

SEQ ID NO: 1086 - protein, 55 aa, Neisseria gonorrhoeae
LPRLAVLFLLSAASPPCPDLNLIHYRFPRLAEHGLKINLTVIRRWSRHKVAEKGV

SEQ ID NO: 1087 - DNA, 4404 bp, Neisseria gonorrhoeae
atgaaaacaaccgacaaacggacaaccgaaacacaccgcaaagcccctaaaaccggccgcatccgcttctcgcccgcttacttagccatatgcctgtcgttcggcattctgccccaagcccgggcgggacacacttatttcggcatcaactaccaatactatcgcgactttgccgaaaataaaggcaagtttgcagtcggggcgaaagatattgaggtttacaacaaaaaaggggagttggtcggcaaatcgatgacgaaagccccgatgattgatttttctgtggtatcgcgtaacggcgtggcggcattggcgggcgatcaatatattgtgagcgtggcacataacggcggctataacaatgttgattttggtgcggagggaagcaatcccgatcagcaccgcttttcttaccaaattgtgaaaagaaataattataaagcagggactaacggccatccttatggcggcgattatcatatgccgcgtttgcacaaatttgtcacagatgcagaacctgttgagatgaccagttatatggatgggtggaaatacgctgatttaaataaataccctgatcgtgttcgaatcggagcaggcagacaatattggcggtctgatgaagacgaacccaataaccgcgaaagttcatatcatattgcaagcgcatattcttggctcgtcggtggcaatacctttgcacaaaatggatcaggtggtggcacagtcaacttaggtagcgaaaaaattaaacatagcccatatggttttttaccaacaggaggctcatttggcgacagtggctcaccaatgtttatctatgatgcccaaaagcaaaagtggttaattaatggggtattgcaaacaggcaacccctatataggaaaaagcaatggcttccagctagttcgtaaagattggttctatgatgaaatctttgctggagatacccattcagtattctacgaaccacatcaaaatgggaaatacttttttaacgacaataataatggcgcaggaaaaatcgatgccaaacataaacactattctctaccttatagattaaaaacacgaaccgttcaattgtttaatgtttctttatccgagacagcaagagaacctgtttatcatgctgcaggtggggtcaacagttatcgacccagactgaataatggagaaaatatttcctttattgacaaaggaaaaggtgaattgatacttaccagcaacatcaaccaaggcgcgggcggtttgtattttgagggtaattttacggtctcgcctaaaaacaacgaaacgtggcaaggcgcgggcgttcatatcagtgatggcagtaccgttacttggaaagtaaacggcgtggcaaacgaccgcctgtccaaaatcggcaaaggcacgctgctggttcaagccaaaggggaaaaccaaggctcggtcagcgtgggcgacggtaaagtcatcttagatcagcaggcggacgatcaaggcaaaaaacaagcctttagtgaaatcggcttggtcagcggcagggggacggtgcaactgaatgccgataatcagttcaaccccgacaaactctatttcggctttcgcggcggacgtttggatttgaacgggcattcgctttcgttccaccgcattcaaaataccgatgaaggggcgatgattgtcaaccacaatcaagacaaagaatccaccgttaccattacaggcaataaagatattactacaaccggcaataacaacaacttggatagcaaaaaagaaattgcctacaacggttggtttggcgagaaagatgcaaccaaaacgaacgggcggctcaatctgaattaccaaccggaagaagcggatcgcactttactgctttccggcggaacaaatttaaacggcaatatcacgcaaacaaacggcaaactgtttttcagcggcagaccgacaccgcacgcctacaatcatttaggaagcgggtggtcaaaaatggaaggtatcccacaaggagaaatcgtgtgggacaacgattggatcgaccgcacatttaaagcggaaaacttccatattcagggcggacaagcggtggtttcccgcaatgttgccaaagtggaaggcgattggcatttaagcaatcacgcccaagcagttttcggtgtcgcaccgcatcaaagccacacaatctgtacacgttcggactggacgggtctgacaagttgtaccgaaaaaaccattaccgacgataaagtgattgcttcattgagcaagaccgacatcagaggcaatgtcagccttgccgatcacgctcatttaaatctcacaggacttgccacactcaacggcaatcttagtgcaggcggagacacgcactatacggttacgcgcaacgccacccaaaacggcaacctcagcctcgtgggcaatgcccaagcaacatttaatcaagccacattaaacggcaacacatcggcttcggacaatgcttcatttaatctaagcaacaacgccgtacaaaacggcagtctgacgctttccgacaacgctaaggcaaacgtaagccattccgcactcaacggcaatgtctccctagccgataaggcagtattccattttgaaaacagccgctttaccggaaaaatcagcggcggcaaggatacggcattacacttaaaagacagcgaatggacgctgccgtcgggcacggaattaggcaatttaaaccttgacaacgccaccattacactcaattccgcctatcgacacgatgcggcaggcgcgcaaaccggcagtgcggcagatgcgccgcgccgccgttcgcgccgttccctattatccgttacgccgccaacttcggcagaatcccgtttcaacacgctgacggtaaacggcaaattgaacggtcagggaacattccgctttatgtcggaactcttcggctaccgcagcggcaaattgaagctggcggaaagttccgaaggcacttacaccttggctgtcaacaataccggcaacgaacccgtaagtctcgagcaattgacggtagtggaaggaaaagacaacacaccgctgtccgaaaatcttaatttcaccctgcaaaacgaacacgtcgatgccggcgcatggcgttatcagcttatccgcaaagacggcgagttccgcctgcataatccggtcaaagaacaagagctttccgacaaactcggcaaggcgggagaaacagaggccgccttgacggcaaaacaggcacaacttgccgccaaacaacaggcggaaaaagacaacgcgcaaagccttgacgcgctgattgcggccgggcgcaatgccaccgaaaaggcagaaagcgttgccgaaccggcccggcaggcaggcggggaaaatgccggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaaccgcagccccaaccgcaaccccaaccgcagcgcgacctgatcagccgttatgccaatagcggtttgagtgaattttccgccacgctcaacagcgttttcgccgtacaggacgaattggaccgcgtgtttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccggaaacaccttcgacgacggcatcggcaactcggcacggcttgcccacggtgccgttttcgggcaatacggcatcggcaggttcgacatcggcatcagcgcgggcgcgggttttagtagcggcagcctttcagacggcatcagaggcaaaatccgccgccgcgtgctgcattacggcattcaggcaagataccgcgcaggtttcggcggattcggcatcgaaccgcacatcggcgcaacgcgctatttcgtccaaaaagcggattaccgatacgaaaacgtcaatatcgccaccccgggccttgcattcaaccgctaccgcgcgggcattaaggcagattattcattcaaaccggcgcaacacatttccatcacgccttatttgagcctgtcctataccgatgccgcttccggcaaagtccgaacgcgcgtcaataccgccgtattggcgcaggatttcggcaaaacccgcagtgcggaatggggcgtaaacgccgaaatcaaaggtttcacgctgtccctccacgctgccgccgccaaggggccgcaattggaagcgcagcacagcgcgggcatcaaattaggctaccgctgg

SEQ ID NO: 1088 - protein, 1468 aa, Neisseria gonorrhoeae
MKTTDKRTTETHRKAPKTGRIRFSPAYLAICLSFGILPQARAGHTYFGINYQYYRDFAENKGKFAVGAKDIEVYNKKGELVGKSMTKAPMIDFSVVSRNGVAALAGDQYIVSVAHNGGYNNVDFGAEGSNPDQHRFSYQIVKRNNYKAGTNGHPYGGDYHMPRLHKFVTDAEPVEMTSYMDGWKYADLNKYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPHQNGKYFFNDNNNGAGKIDAKHKHYSLPYRLKTRTVQLFNVSLSETAREPVYHAAGGVNSYRPRLNNGENISFIDKGKGELILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGRLNLNYQPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDIRGNVSLADHAHLNLTGLATLNGNLSAGGDTHYTVTRNATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTGNTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 1089 - DNA, 165 bp, Neisseria gonorrhoeae
atgccgtctgaagtccgacggttcggctttcagatggcattgccggcttgtgtaaaacgatattccgacaccgcacggcacaaaaccctgccccgcattccgcctccggtcggtttttaccgccgaaaacggcggggttccgaccgaaaaggaacggggataaag

SEQ ID NO: 1090 - protein, 55 aa, Neisseria gonorrhoeae
MPSEVRRFGFQMALPACVKRYSDTARHKTLPRIPPPVGFYRRKRRGSDRKGTGIK

SEQ ID NO: 1091 - DNA, 372 bp, Neisseria gonorrhoeae
ttgggagggcgcggcttccgcttccgggcggcgcgcgggatgtggctatatgtgcggttcggcgtattttgccgcttctgttcggagatggtgcagggaagggcgggaaggaaaaaaaggggatttttatcaactcgccggagcaatcgatgggttgcacataaaggcatcattttgaatacgaaatcatatcacactttactttatccccgttccttttcggtcggaaccccgccgttttcggcggtaaaaaccgaccggaggcggaatgcggggcagggttttgtgccgtgcggtgtcggaatatcgttttacacaagccggcaatgccatctgaaagccgaaccgtcggacttcagacggcatttgcta

SEQ ID NO: 1092 - protein, 124 aa, Neisseria gonorrhoeae
LGGRGFRFRAARGMWLYVRFGVFCRFCSEMVQGRAGRKKRGFLSTRRSNRWVAHKGIILNTKSYHTLLYPRSFSVGTPPFSAVKTDRRRNAGQGFVPCGVGISFYTSRQCHLKAEPSDFRRHLL

SEQ ID NO: 1093 - DNA, 111 bp, Neisseria gonorrhoeae
gtgtccgccgttacggtagccgatattcccgagtctaacggcaaaggcgaatacaaagtctttaccgcttatgttaaaggcaaagccactgccggcaatttgaaagaaaaa

SEQ ID NO: 1094 - protein, 37 aa, Neisseria gonorrhoeae
VSAVTVADIPESNGKGEYKVFTAYVKGKATAGNLKEK

SEQ ID NO: 1095 - DNA, 1344 bp, Neisseria gonorrhoeae
atgtcggataacgttccaacgattgcggcagtcgcgaccgcgcccggacgcggcggcgtgggcgtgatacgcatatcggggaaaaacctgttgccgatggcgcaggctttgtgtgggaaaacgcccgagccgcgcgtggcaacctatgctgattttacggacgcggacggacaggcaatcgatagcgggctgctactgttttttgccgcgccggcaagttttacgggcgaagatgtcatcgagcttcagggacacggcgggccggtagtgatggagatgctgctgaaccgctgtttggaactgggcgcgcgccttgccgagccgggcgagtttaccaaacgtgcgtttttaaacgacaaactggacttggcacaggcggaaggcgtggcggatttgattgacgcatccggccgttcggcggcgcgtctggcgttgcgctcgctcaagggcgatttttcgcggcggatacacggtttggtcgaaggcttgattaccttgcggatgctggtcgaagcggcgctggattttcccgaggaagacatcgattttctcgaagcggcggacgcacgcggcaaactggacggcttgcgccgcgccgtggatgatgtgcttgccaacgcgcagcagggcgcgattttacgcgaaggtctgaatgtcgtattggtcggtgcgccgaatgtcggcaagtccagcctgttgaacgcgctggcgggcgacgaagtggcgattgttaccgatattgccggaacgacgcgcgacgcggtcagggaacgtatcctgattgacggcgtgccggtgcatattgtcgatacggcaggtttgcgcgagacggacgacgtggtcgaacgcatcggcatcgaacgcagccgcaaagccgtatccgaagccgatgtcgcgctggtgttggtcgatccgcgcgagggtttgaatgaaaagacgcggatgattttggatacgttgccgtcggatttgaaacgcattgaaatccacagcaaatccgatttgcacgcacacgcggcaggcgggttcggtacgggcgcggaaaccgtcatcgcgctgtcggcgaaaaccggcgacggcttggacgcgctgaaacggacgctgttgtgcgaggccggttggcagggcgaaagcgaagggctgtttttggcgcggacgcggcacgtcaacgcactcaaggcggcgcaggaagaattgtcgctggccgctttgtgcggcaaccatcaaatcgagctgtttgccgaacacttgcggctggctcaggtcgcgtgcggcgaaattacgggggaatttacggcggacgacctgctcggcgtgattttttcgaggttttgcatcggaaaa

SEQ ID NO: 1096 - protein, 448 aa, Neisseria gonorrhoeae
MSDNVPTIAAVATAPGRGGVGVIRISGKNLLPMAQALCGKTPEPRVATYADFTDADGQAIDSGLLLFFAAPASFTGEDVIELQGHGGPVVMEMLLNRCLELGARLAEPGEFTKRAFLNDKLDLAQAEGVADLIDASGRSAARLALRSLKGDFSRRIHGLVEGLITLRMLVEAALDFPEEDIDFLEAADARGKLDGLRRAVDDVLANAQQGAILREGLNVVLVGAPNVGKSSLLNALAGDEVAIVTDIAGTTRDAVRERILIDGVPVHIVDTAGLRETDDVVERIGIERSRKAVSEADVALVLVDPREGLNEKTRMILDTLPSDLKRIEIHSKSDLHAHAAGGFGTGAETVIALSAKTGDGLDALKRTLLCEAGWQGESEGLFLARTRHVNALKAAQEELSLAALCGNHQIELFAEHLRLAQVACGEITGEFTADDLLGVIFSRFCIGK

SEQ ID NO: 1097 - DNA, 93 bp, Neisseria gonorrhoeae
atgacgatatttcagttttctgtttttgatttttttgtttttacaggaatgacggggctttcagtattgaaaaaagttgccgtaccgcgccga

SEQ ID NO: 1098 - protein, 31 aa, Neisseria gonorrhoeae
MTIFQFSVFDFFVFTGMTGLSVLKKVAVPRR

SEQ ID NO: 1099 - DNA, 168 bp, Neisseria gonorrhoeae
atgacgaattttaggtttctgtttttggttttctgtccttgtgggaatgatgaaattttaagttttaggaatttatcggaaaaaacagaaaccgctccgccgtcattcccgcgcaggcgggaatccagccccgtcggtacggaaacttatcggataaaacggtttctt

SEQ ID NO: 1100 - protein, 56 aa, Neisseria gonorrhoeae
MTNFRFLFLVFCPCGNDEILSFRNLSEKTETAPPSFPRRRESSPVGTETYRIKRFL

SEQ ID NO: 1101 - DNA, 285 bp, Neisseria gonorrhoeae
atgatttgggtttcagacggcattttttacggtcgcaccgccgccccctttcaggcttgtaccaagcccaatcccgcaactctccgtcattcccgcaactctccgtcattcccagggaagtgggaatctagaaacgcaaagccacaggaacttatccgaaacaacagcaacctaaaattcgtcattcccacgaaagtgggaatccagttcgttgagtttcagttatttaaaataaattttgaaactttaatcccatcattcccgcgaaagcgggaatccggaacg

SEQ ID NO: 1102 - protein, 95 aa, Neisseria gonorrhoeae
MIWVSDGIFYGRTAAPFQACTKPNPATLRHSRNSPSFPGKWESRNAKPQELIRNNSNLKFVIPTKVGIQFVEFQLFKINFETLIPSFPRKRESGT

SEQ ID NO: 1103 - DNA, 153 bp, Neisseria gonorrhoeae
atgtgccaatgccgtctgaaacccgatgatttgggtttcagacggcattttttacggtcgcaccgccgccccctttcaggcttgtaccaagcccaatcccgcaactctccgtcattcccgcaactctccgtcattcccagggaagtgggaatc

SEQ ID NO: 1104 - protein, 51 aa, Neisseria gonorrhoeae
MCQCRLKPDDLGFRRHFLRSHRRPLSGLYQAQSRNSPSFPQLSVIPREVGI

SEQ ID NO: 1105 - DNA, 2427 bp, Neisseria gonorrhoeae
atgcccattcccttcaaacccgtattggctgccgccgccatcgcccaagcgtttcccgcctttgcggcagaccccgcgccgcagtccgcccaaacgctgaacgaaatcaccgttaccggcacgcacaaaacccaaaaactcggcgaagaaaaaatccgccgcaaaaccttagacaagctcttggccaacgacgaacacggcctggtgcgctacgaccccggcatttccgtcgtcgaaggcggcagggcgggttctaacggctttaccatacgcggcgtggacaaagaccgcgtcgccatcaacgttgacgggctggcgcaggcggaaagccgctcttccgaagccttccaagaattgttcggcgcgtacggcaacttcaacgccaaccgcaacacttccgagccggaaaacttttccgaagtaaccatcaccaaaggcgcggactcgctcaaatccggcagcggcgcattgggcggcgcagtcaattaccaaaccaaatccgcaagcgactatgtttccgaagacaagccctaccatttggggataaagggcggcagcgtcggcaaaaacagccaaaaattcagcagcattaccgccgccggcaggctctttggtttggatgccttattggtttatacccgccgcttcggcaaagaaaccaaaaaccgctcgaccgagggcgatgtcgaaattaaaaacgacggatatgtctttgacccggccaacccctcgcccagcagataccttacctacaaagccacaggggttgctcgctcccaacccgacccgcaagaatgggtaaacaaaagcaccctgttcaagctgggctacaatttcaacgaccgcaaccgcatcggctggatttttgaagactcgcgcaccgaccgttttaccaacgagctgtctaatttgtggacgggtacgaccacgtctgccgcaacgggcgactaccgccaccgccaagacgtgagctaccgccgccgcaccggcgtcgaatacaaaaacgaattggaacacggcccgtgggacagcctcaagctgcgctacgacaagcagcgcatcgatatgaacacttggacttgggacatcccgaaaaattacgatacaaacggcatcaacggcgaggtttaccattcgttccggcatatccgccaaaacaccgcgcaatggactgccgattttgaaaaacaactcgacttttccaaagccgtttgggcggcgcaatacggcttaggcggcggcagaggggacaatgccaactcggattacagttatttcgcaaaactgtacgaccccaaaatcctcgcttccaaccaagccaaaatcacgatgctgatcgaaaaccggtcgaaatataaatttgcctattggaacaatgtgtttcacttgggcggcaacgaccgcttccgcctgaatgcgggcatacgctacgacaaaaacagcagcagcgcgaaagacgatccgaaatacaccaccgccatccgggggcagattccccatttgggttcggaacgcgcgcacgcgggcttcagctacggcacagggttcgactggcggtttaccaagcatctgcacttgttggcaaaatacagcaccggcttccgcgcaccgacttcggacgaaacctggctgctgttcccacaccccgatttctacctgaaaaccaatcccgaactgaaagcggaaaaagccaaaaactgggaattgggcctggcgggcagcggcaaagctggcagcttcaagctttcgggcttcaaaaccaaataccgcgactttatcgaattgacgtatatgggcgtttcgtcagacgataaaaacaaccccagatacgccccgctttcagacggcacggcattggtcagctcgcccgtttggcaaaaccaaaaccgcaccgccgcctgggtgaaaggcatagagtttaacggcacttggaacctcgacagcatcgggctgcccaaagggctgcacaccggcctcaacgtcagctacatcaagggcaaggcaacgcaaaacaacggcaaagaaacgcccatcaacgcgctttcgccgtggacggcggtttacagcctgggctatgacgcgccttccaaacgctggggcgtcaacgcctacgccgcgcgcaccgccgccaaaaagccgtccgacaccgtccacagcaacgacgacttgaacaaaccgtggccttatgccaaacacagcaaggcctatacgctgttcgacctttccgcctacctcaacatcggcaaacaggttacgctccgcgccgccgcgtacaacattaccaacaagcagtactacacttgggaatctttacgcagcatccgcgagttcggcacggtcaaccgcgtcaacaacaaaacccacgccggcatccaacgctttacctcgccgggcaggagctacaatttcaccatcgaagcgaagttc

SEQ ID NO: 1106 - protein, 809 aa, Neisseria gonorrhoeae
MPIPFKPVLAAAAIAQAFPAFAADPAPQSAQTLNEITVTGTHKTQKLGEEKIRRKTLDKLLANDEHGLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGDVEIKNDGYVFDPANPSPSRYLTYKATGVARSQPDPQEWVNKSTLFKLGYNFNDRNRIGWIFEDSRTDRFTNELSNLWTGTTTSAATGDYRHRQDVSYRRRTGVEYKNELEHGPWDSLKLRYDKQRIDMNTWTWDIPKNYDTNGINGEVYHSFRHIRQNTAQWTADFEKQLDFSKAVWAAQYGLGGGRGDNANSDYSYFAKLYDPKILASNQAKITMLIENRSKYKFAYWNNVFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKTNPELKAEKAKNWELGLAGSGKAGSFKLSGFKTKYRDFIELTYMGVSSDDKNNPRYAPLSDGTALVSSPVWQNQNRTAAWVKGIEFNGTWNLDSIGLPKGLHTGLNVSYIKGKATQNNGKETPINALSPWTAVYSLGYDAPSKRWGVNAYAARTAAKKPSDTVHSNDDLNKPWPYAKHSKAYTLFDLSAYLNIGKQVTLRAAAYNITNKQYYTWESLRSIREFGTVNRVNNKTHAGIQRFTSPGRSYNFTIEAKF

SEQ ID NO: 1107 - DNA, 150 bp, Neisseria gonorrhoeae
tgttaaaggcaaagccactgccggcaatttgaaagaaaaataacgcacaccgtccatcggttttcgttcaacgaacgccacgatatgcgttttaaggcagagtacgcccgaagcaaaaacgatgcagacgacaaaagagggaatgcacac

SEQ ID NO: 1108 - protein, 48 aa, Neisseria gonorrhoeae
RQSHCRQFERKITHTVHRFSFNERHDMRFKAEYARSKNDADDKRGNAH

SEQ ID NO: 1109 - DNA, 1086 bp, Neisseria gonorrhoeae
atgaatgactacacgcagcagcttcaaggtaaaaaagactaccttaaaaccctttttgcaggtttggatgttcctgagtgggaagtgtacgaatctccggacaaacactaccgcatgcgcgccgaattccgcatttggcacgaaggcggtgaaatgttttacgccatgtttgaaaaagggcagaaggctagcggggcaagcctgatccgttgcgaccgtttcgatgctgcttcagaggcagtcaactgcctgatgcccgaattgattgccgttgccgcccaatctgccgaactgagaaaccattggtatgccgtcgaatttctgtccacgctcagcggggaaatgctggttaccatgatttaccacaaaaggcttgatgatgagtggatgaaggcggcgcaagcgttacagcaacagttggatatttccgttatcgggcggagcagggggcagaaaatagtcttaaaacaggactatgtgacggaaaccctgcgcgtcggcgaccgcgatttccactaccgccaaatcgaaggcagctttacccagccgaatgccgctgtatgccggaaaatgctcgaatgggcgtgccgcgcggcggaaggcttgggcggcgacctgctcgaactgtattgcggcaacggcaatttcaccctgccgctgtcccgatatttccgacaggttttggcaaccgaaatctccaaaacctccgtcagtgcggcgcaatggaatattgaggcaaactggataggcaacatcaaaatcgcccgcctgtctgctgaggagtttaccgaagcctataccggaaaacgtgagtttacacgccttaaggagagcggtattgttttgacggattacgcattttccactattttcgtcgatccgccgcgtgccggcatcgatgaggaaactttgaagctggtgtcgcagttcgacaacatcatctacatttcctgcaatcccgaaacgctgcgcgccaatttggacaccttgacggaaacccatacggtcggacgtgccgccctgttcgaccaattcccgtttacgcaccatatcgaaagcggcgtactgttgaaaaagaaaatcctt

SEQ ID NO: 1110 - protein, 362 aa, Neisseria gonorrhoeae
MNDYTQQLQGKKDYLKTLFAGLDVPEWEVYESPDKHYRMRAEFRIWHEGGEMFYAMFEKGQKASGASLIRCDRFDAASEAVNCLMPELIAVAAQSAELRNHWYAVEFLSTLSGEMLVTMIYHKRLDDEWMKAAQALQQQLDISVIGRSRGQKIVLKQDYVTETLRVGDRDFHYRQIEGSFTQPNAAVCRKMLEWACRAAEGLGGDLLELYCGNGNFTLPLSRYFRQVLATEISKTSVSAAQWNIEANWIGNIKIARLSAEEFTEAYTGKREFTRLKESGIVLTDYAFSTIFVDPPRAGIDEETLKLVSQFDNIIYISCNPETLRANLDTLTETHTVGRAALFDQFPFTHHIESGVLLKKKIL

SEQ ID NO: 1111 - DNA, 1404 bp, Neisseria gonorrhoeae
gtggaatttagcacaaaaaccgaaatcttgcaggaacagcaggcaggcgcgcagttatttgtctgtgccgacaaagcacccgagcacaacaccgccgcacatgcgctcttctctgctttggaagagggtcagaatttttccgacaccaaaatcccgacggacaacggtttgcaggcagtcgccgtcgtccgcctcgaaaaaaccgaccgcgccgcgctgaacaaagccgccgccgaagccgccaaatgggcgcaaaatcaagaaacggtcaatgtggacgttcacgcctttgatgaggcgcaagcagcagccgttgccgaagcttttgccatcgcgttcggcaacgctgcatatcgtttcgaccgctacaaaaaagaagccaagcccgccaaattttcgcaagccgtgttccacagcgcacacgaagccgccgtcaaagaagccctgcgcgttgccgaagcacaagtttacggacaaagcctctgccgcgacttaggcaatgccgcaccgaacgaatgcacgcctgagttcctcgcgcgtaccgccaaagccgaagccgagaaactgggcgcgcacgccaaaatcatcgaaaaagactacatcaaagaaaacatgggttcgttttggtcggttgccaaaggcagcgtcgaagacccatatttggttgaactgagctatttcggtgcggccgacaaagaagccgcgcctgtggtattggtcggcaaaggcattaccttcgacaccggcggcatttccctcaaacccggcctgaacatggacgaaatgaagtttgacatgtgcggcgcggcaaccgtcatcagcaccttctgcgccgccgtcaaactgcaactgccgatcaatctgattgccatcgtcgccacttgtgaaaacatgccttccggcgcggcaaacaaaccgggcgatgttgtgaaaagtatgaaagggctgacgattgaagtgttgaacaccgatgccgaaggccgtctgattttgtgcgacgcgctcacttacgccgagcagttcaaacccaaagccgtcatcgatgtcgccaccctgaccggcgcgtgcatcgtcgccttggggcacgatgtcagcggcgtgatgggcaataatcaggatttgatcgacagcctgcttgccgcttcctacaacgtggacgacaaagcgtggcaactgccgctctttgaaacctacaaagaccagctcaaatccaactttgccgacatccccaatatcggcacgcccggcgcgggcacgattaccgccgcaacattcctgtcctatttcaccgaaggctacccgtgggcgcaccttgacatcgcgggtacggcgtggaaatccggagcggaaaaaggtgcgaccggccgccccgtaccgctgctgatgaactatctgcggaatctt

SEQ ID NO: 1112 - protein, 468 aa, Neisseria gonorrhoeae
VEFSTKTEILQEQQAGAQLFVCADKAPEHNTAAHALFSALEEGQNFSDTKIPTDNGLQAVAVVRLEKTDRAALNKAAAEAAKWAQNQETVNVDVHAFDEAQAAAVAEAFAIAFGNAAYRFDRYKKEAKPAKFSQAVFHSAHEAAVKEALRVAEAQVYGQSLCRDLGNAAPNECTPEFLARTAKAEAEKLGAHAKIIEKDYIKENMGSFWSVAKGSVEDPYLVELSYFGAADKEAAPVVLVGKGITFDTGGISLKPGLNMDEMKFDMCGAATVISTFCAAVKLQLPINLIAIVATCENMPSGAANKPGDVVKSMKGLTIEVLNTDAEGRLILCDALTYAEQFKPKAVIDVATLTGACIVALGHDVSGVMGNNQDLIDSLLAASYNVDDKAWQLPLFETYKDQLKSNFADIPNIGTPGAGTITAATFLSYFTEGYPWAHLDIAGTAWKSGAEKGATGRPVPLLMNYLRNL

SEQ ID NO: 1113 - DNA, 993 bp, Neisseria gonorrhoeae; identical to SEQ ID NO: 237

SEQ ID NO: 1114 - protein, 331 aa, Neisseria gonorrhoeae; identical to SEQ ID NO: 238

SEQ ID NO: 1115 - DNA, 105 bp, Neisseria gonorrhoeae
gtgcggttcggctacccccccccggcacaggcggcaagggcggcggcaagcggcagtaagggcagggctttgtatttcatcgcatactcaatcttgatgatgtat

SEQ ID NO: 1116 - protein, 35 aa, Neisseria gonorrhoeae
VRFGYPPPAQAARAAASGSKGRALYFIAYSILMMY

SEQ ID NO: 1117 - DNA, 132 bp, Neisseria gonorrhoeae
gtgcctgcgtttgtctgccgcgtttctacctttgttttttatagcggattaacaaaaaccggtacggcgttgcctcgccttgccgtactatctgtactgtctgcggcttcgtcgccttgtcctgatttttgt

SEQ ID NO: 1118 - protein, 44 aa, Neisseria gonorrhoeae
VPAFVCRVSTFVFYSGLTKTGTALPRLAVLSVLSAASSPCPDFC

SEQ ID NO: 1119 - DNA, 132 bp, Neisseria gonorrhoeae
ttgccgtactatctgtactgtctgcggcttcgtcgccttgtcctgatttttgttaatccactatatgatgcgccgcgtccgccgcgcgtggggcttgcggcgtttctgccgccgccgtccggcggtgttttt

SEQ ID NO: 1120 - protein, 44 aa, Neisseria gonorrhoeae
LPYYLYCLRLRRLVLIFVNPLYDAPRPPRVGLAAFLPPPSGGVF

SEQ ID NO: 1121 - DNA, 1500 bp, Neisseria gonorrhoeae
gtggctcaaagccagcgagacattccattcgcggttacgctgcgcctccgtcgaaaatgccgcaatgcctttgtagttgcggtgggcgtaagacgcggcaatccggctgttcaaaccgcccgtcccgccccactcctgcgcccaaccgatatggacggcgttgcggcggtaggcggcattgttgaccgcgccgcccaccgtttcgcgtttcggcacaaaccgcgcaaactgccagccgccgaacacggttgccgagccgcccaaccgccttgccagcgacacataaagcccgtcctgccaaccgtcgttgcgttccgcccggccttgttcgcggtagcgttggcggtaacgttccagcgacaccgaaagctgcgaccggcggctcaggcggtaagaatgcgccaactgcacacccgccccgtgcgccagcatatacggcgcaagccggcggtcggcaggcggtttcgttttcgcatcaaagccgtcgctacccgacaattgcgcctgataaaacggcaaaacccccaccgtctgccgcgcatttttatactgccagcccaaataagccctgccgaaagcatcgtcataagccgatttgcggctgaaataatagcttgtgcccccgacattggcgcggaacagcagataatggttgtccgccagcgcagtcagcttttccgccccggcctcataatccaaccctgccgcacggacaggtccggtaacgctgcatatccggctgccgccgccctgcaggcagtattgcggcgcggcattgttggcgtttttgttcacagaagggctgatgccgcccgaaaaatgccagcccgtcagcccctccgtttttttccggaaacgccccacattttccaaaaccggcgccggcaaatccaattttgccgcctccgcaaaatgcagccctgccgacttcagccggaaatcgtcaaactccgccgccgccaaatccagcaaaacccgctcgtctgccgcattatccctgtgcaacgcccgatagcgcgccaccgcctccgccggccttcccgccaatttcgccagcaaagcccgcgccctgccgtacaacaccgcatcataatccggcagcttggcatacaaatccgccaacgaagcgatcaaatccgcctgattgccgttgagcgcgtcgcgcaaaacgtgttccaacaactgcgggcgcgacagcaggaaatccccgtcgattacgcgcgaaccgccgtttgcggcagaatccccttccggcggcattcccgcccaaccctccgcagccgcacgctgggcgcgcaacgccgccgcatcgtcccgaacgtcgggcaagccggcggcatacgcgccgaccgcaccccaaacacacagcgcggcacacagccggcatacccgatacacactatccttcaatttgccttccttaaaaaacaccgccggacggcggcggcagaaacgccgcaagccccacgcgcggcggacgcggcgcatcatatagtggat

SEQ ID NO: 1122 - protein, 500 aa, Neisseria gonorrhoeae
VAQSQRDIPFAVTLRLRRKCRNAFVVAVGVRRGNPAVQTARPAPLLRPTDMDGVAAVGGIVDRAAHRFAFRHKPRKLPAAEHGCRAAQPPCQRHIKPVLPTVVAFRPALFAVALAVTFQRHRKLRPAAQAVRMRQLHTRPVRQHIRRKPAVGRRFRFRIKAVATRQLRLIKRQNPHRLPRIFILPAQISPAESIVISRFAAEIIACAPDIGAEQQIMVVRQRSQLFRPGLIIQPCRTDRSGNAAYPAAAALQAVLRRGIVGVFVHRRADAARKMPARQPLRFFPETPHIFQNRRRQIQFCRLRKMQPCRLQPEIVKLRRRQIQQNPLVCRIIPVQRPIARHRLRRPSRQFRQQSPRPAVQHRIIIRQLGIQIRQRSDQIRLIAVERVAQNVFQQLRARQQEIPVDYARTAVCGRIPFRRHSRPTLRSRTLGAQRRRIVPNVGQAGGIRADRTPNTQRGTQPAYPIHTILQFAFLKKHRRTAAAETPQAPRAADAAHHIVD

SEQ ID NO: 1123 - DNA, 1554 bp, Neisseria gonorrhoeae
gtgttttttaaggaaggcaaattgaaggatagtgtgtatcgggtatgccggctgtgtgccgcgctgtgtgtttggggtgcggtcggcgcgtatgccgccggcttgcccgacgttcgggacgatgcggcggcgttgcgcgcccagcgtgcggctgcggagggttgggcgggaatgccgccggaaggggattctgccgcaaacggcggttcgcgcgtaatcgacggggatttcctgctgtcgcgcccgcagttgttggaacacgttttgcgcgacgcgctcaacggcaatcaggcggatttgatcgcttcgttggcggatttgtatgccaagctgccggattatgatgcggtgttgtacggcagggcgcgggctttgctggcgaaattggcgggaaggccggcggaggcggtggcgcgctatcgggcgttgcacagggataatgcggcagacgagcgggttttgctggatttggcggcggcggagtttgacgatttccggctgaagtcggcagggctgcattttgcggaggcggcaaaattggatttgccggcgccggttttggaaaatgtggggcgtttccggaaaaaaacggaggggctgacgggctggcatttttcgggcggcatcagcccttctgtgaacaaaaacgccaacaatgccgcgccgcaatactgcctgcagggcggcggcagccggatatgcagcgttaccggacctgtccgtgcggcagggttggattatgaggccggggcggaaaagctgactgcgctggcggacaaccattatctgctgttccgcgccaatgtcgggggcacaagctattatttcagccgcaaatcggcttatgacgatgctttcggcagggcttatttgggctggcagtataaaaatgcgcggcagacggtgggggttttgccgttttatcaggcgcaattgtcgggtagcgacggctttgatgcgaaaacgaaaccgcctgccgaccgccggcttgcgccgtatatgctggcgcacggggcgggtgtgcagttggcgcattcttaccgcctgagccgccggtcgcagctttcggtgtcgctggaacgttaccgccaacgctaccgcgaacaaggccgggcggaacgcaacgacggttggcaggacgggctttatgtgtcgctggcaaggcggttgggcggctcggcaaccgtgttcggcggctggcagtttgcgcggtttgtgccgaaacgcgaaacggtgggcggcgcggtcaacaatgccgcctaccgccgcaacgccgtccatatcggttgggcgcaggagtggggcgggacgggcggtttgaacagccggattgccgcgtcttacgcccaccgcaactacaaaggcattgcggcattttcgacggaggcgcagcgtaaccgcgaatggaatgtctcgctggctttgagccacgacaagttgtcatacaaaggcatcgtgccgacgttgaactaccgcttcggtaagacggaaagcaatgtgccgtatgcaaaacgccgcaacagcgaggtgtttgtgtcggcggattggcggttt

SEQ ID NO: 1124 - protein, 518 aa, Neisseria gonorrhoeae
VFFKEGKLKDSVYRVCRLCAALCVWGAVGAYAAGLPDVRDDAAALRAQRAAAEGWAGMPPEGDSAANGGSRVIDGDFLLSRPQLLEHVLRDALNGNQADLIASLADLYAKLPDYDAVLYGRARALLAKLAGRPAEAVARYRALHRDNAADERVLLDLAAAEFDDFRLKSAGLHFAEAAKLDLPAPVLENVGRFRKKTEGLTGWHFSGGISPSVNKNANNAAPQYCLQGGGSRICSVTGPVRAAGLDYEAGAEKLTALADNHYLLFRANVGGTSYYFSRKSAYDDAFGRAYLGWQYKNARQTVGVLPFYQAQLSGSDGFDAKTKPPADRRLAPYMLAHGAGVQLAHSYRLSRRSQLSVSLERYRQRYREQGRAERNDGWQDGLYVSLARRLGGSATVFGGWQFARFVPKRETVGGAVNNAAYRRNAVHIGWAQEWGGTGGLNSRIAASYAHRNYKGIAAFSTEAQRNREWNVSLALSHDKLSYKGIVPTLNYRFGKTESNVPYAKRRNSEVFVSADWRF

SEQ ID NO: 1125 - DNA, 204 bp, Neisseria gonorrhoeae
atggctgccgtgtatgccggttatacctacacccaaccgggcggcgaatccacacgtttccgtggcggtttggagcgtgtccaagttaaacgttatctgggagaaaaatgctgcggctacgcctgtccaaaaagcgaacgcttcaccctgcaagcagatggtgaaatccgtcaaaaccttggcgaaggctggtttctgaagcta

SEQ ID NO: 1126 - protein, 68 aa, Neisseria gonorrhoeae
MAAVYAGYTYTQPGGESTRFRGGLERVQVKRYLGEKCCGYACPKSERFTLQADGEIRQNLGEGWFLKL

SEQ ID NO: 1127 - DNA, 174 bp, Neisseria gonorrhoeae
gtgctaaattccacgtttattctcctgattgagacggttgtcggtagttttcagacggcctttcgctcaaaagaccgtctgaagacggctggcacgattgtaccccattttttgaagcaccgtctgaaaccttgcgcggacaatccgcctgcgccgaaccgcttaccgcccccc

SEQ ID NO: 1128 - protein, 58 aa, Neisseria gonorrhoeae
VLNSTFILLIETVVGSFQTAFRSKDRLKTAGTIVPHFLKHRLKPCADNPPAPNRLPPP

SEQ ID NO: 1129 - DNA, 1887 bp, Neisseria gonorrhoeae
ttgccccgaattgccatgccttatttcgccctgtttgacgatgccgtcagccgacgcgcaaaactctatcaaaatcatgtggaaagccgttttttccgtcccgaagaactcgatgctttagacggcgcgctgcaatcgggatggcaaaaagggctgcattcggtgttgtttgcagactacgaattcggtttgccgctgatggggatggaatccgaacgcggcggcaacattgccctgcactggtttgccgactgcgccgacaccgatgccgaaagctggcttgcccgacattcagacggcctccccgccggcatttccacgccgcaatcctccgtatccgaaaccgattacctcgaccgcatccgccaaatccacgaagccatccggcgcggcgacacctatcaaatcaactacaccacccgcctgcacctgcaagcctacggcaaccccgtcagcctctaccgccgcctgcgccagcccgtcccctatgccgtattgtcccacctgcccgatgaagccgggcaatccgcgtggacgctgtgtttctcgcccgaactcttcctcaacatcgcttcagacggcaccatcagcaccgaaccgatgaaaggcaccgcgccgattttgggcgacggacaagacgaacgccgcgccgccgagttacaaaccgacccgaaaaaccgcgccgaaaacgtgatgattgtcgatttgctgcgcaacgacctcggcaaaatcgcccaaaccggtaaagtatgcgtacccgagccgtttaaagtatcgcgtttcggcagcgtctggcagatgaccagcaccatccgggcgcaagccctgccggacacctcgttcgccgacaccctccgcgccgccttcccctgcggcagcatcaccggcgcgcccaaaaaaatgagtatgcagattatcgaatcgctcgaaaccgaagcgcgcgggctttatacgggcagcatcggctatttgaacccgtgttccggcggcttggggtttgaaggcgcgttcaacgtcgtcatccgcaccctgtcgctcaaacccgtttcagacggcattgtttcaggcatcggcggcacggattcaaacgcgcaagcccgaacggcaggacaaggcggggaaacgccgcatccgtttgaagccaatccgccgtatcggggcgtgtacggtgtcggttccggcatcgtcatcgacagcgaccccgccgccgaatatcgcgaatgcggctggaaagcccgattcctcaacgaactgcgccccgatttcggcatttttgaaaccctgcgcgcggaaaacaggcaatgcgccctgctcgaccgccacctatgccgtctgaaaacctccgcccaagccctcaacctgcccctgcccgacggctgcgaaaatcaaatcaaacaatacattgccgacttgcccgacggcgcgttccgcatcaaagccctgctcgcttcagacggcatcagcctgtcccacgccgttttaaaccgtctgaccgacaaacagcgcgtcatcatttcgccgaccatcctgcccgcacaaaactacctgcgccgcttcaaaaccacacaccgcgccatcttcgaccaagcgtggcaaaccgccgaaacgcaaggcgcgttcgacagcctgtttttcaattcggacggcatcctactcgaaggcggcaggagcaacgtgttcgtcaaacatcgcggacaatggctcacgccctctttagatttagacattttaaacggcataatgcgccaagccgtgtcggacgaaccgcaaaaatatttgcacacaaatcaagtgattgaaacacacatcacacaaaaaacactgcaaggagccgaagaaatccgcctctccaacgccttgcgcggcgtatttgccgccgtccttgcc

SEQ ID NO: 1130 - protein, 629 aa, Neisseria gonorrhoeae
LPRIAMPYFALFDDAVSRRAKLYQNHVESRFFRPEELDALDGALQSGWQKGLHSVLFADYEFGLPLMGMESERGGNIALHWFADCADTDAESWLARHSDGLPAGISTPQSSVSETDYLDRIRQIHEAIRRGDTYQINYTTRLHLQAYGNPVSLYRRLRQPVPYAVLSHLPDEAGQSAWTLCFSPELFLNIASDGTISTEPMKGTAPILGDGQDERRAAELQTDPKNRAENVMIVDLLRNDLGKIAQTGKVCVPEPFKVSRFGSVWQMTSTIRAQALPDTSFADTLRAAFPCGSITGAPKKMSMQIIESLETEARGLYTGSIGYLNPCSGGLGFEGAFNVVIRTLSLKPVSDGIVSGIGGTDSNAQARTAGQGGETPHPFEANPPYRGVYGVGSGIVIDSDPAAEYRECGWKARFLNELRPDFGIFETLRAENRQCALLDRHLCRLKTSAQALNLPLPDGCENQIKQYIADLPDGAFRIKALLASDGISLSHAVLNRLTDKQRVIISPTILPAQNYLRRFKTTHRAIFDQAWQTAETQGAFDSLFFNSDGILLEGGRSNVFVKHRGQWLTPSLDLDILNGIMRQAVSDEPQKYLHTNQVIETHITQKTLQGAEEIRLSNALRGVFAAVLA

SEQ ID NO: 1131 - DNA, 96 bp, Neisseria gonorrhoeae
atggcaattcggggcaaatgttttgattatacgccccttttacacggacaaaatgtaattttatgtagagaaagcggtggcgaaagtgtaaaattg

SEQ ID NO: 1132 - protein, 32 aa, Neisseria gonorrhoeae
MAIRGKCFDYTPLLHGQNVILCRESGGESVKL

SEQ ID NO: 1133 - DNA, 927 bp, Neisseria gonorrhoeae
atggcagaccgccagttgcaaccgtttgaaaacgtagaattaggcgaaaagcaagaccagttccaggtatttgaaaaagctgttttggaacacgaaggcaaaggttctgccgaagattccggcacggtcccgctgcccgaaaactacccctgccgcaaacgtatgctccgcgccgcctacgaagccgaaaaagccaaactgcaaatcgaattgctgaaagtgcaaagctgggtcaaagattccggccagcgcatcgtcagcctgtttgaaggccgggatgcggcaggtaagggcggcaccatcaaacgctttatggaacatttaaacccgcgtggcgcgcgcgtggttgctttggagaaaccaaccactaccgaacgcggacaatggtatttccaacgctacatccaaaacctgccgactgcgggcgaaatggtattcttcgaccgctcgtggtacaaccgcgccggcgtggaacgcgtgacgggcttctgcgaacccaacgaatatatgctctttatgtgccaagcccctgagttggaacgtatgcttgtcgccagcggcatccacctgttcaaattctggttctccgtatcccgcgaagaacaactgcgccgcttcatctcccgccgcgacgacgccctgaaacactggaaactttcccccgtggacatccagtcgctcgaccgctgggacgactacaccgaagccaaaaacgcgatgttcttccacacccacaccggcgacgcgccttgggtcatcatccgttcggacgacaaaaaacgcgcccgtttgaactgtatccgctacttcctgcaccagttggactacccgggtaaagacgtgaaagccatcggcaaagtggacgataaaatcgttcttgttcccgatacgcgttacaaagagaaaaccatcgatatcggtcatgac

SEQ ID NO: 1134 - protein, 309 aa, Neisseria gonorrhoeae
MADRQLQPFENVELGEKQDQFQVFEKAVLEHEGKGSAEDSGTVPLPENYPCRKRMLRAAYEAEKAKLQIELLKVQSWVKDSGQRIVSLFEGRDAAGKGGTIKRFMEHLNPRGARVVALEKPTTTERGQWYFQRYIQNLPTAGEMVFFDRSWYNRAGVERVTGFCEPNEYMLFMCQAPELERMLVASGIHLFKFWFSVSREEQLRRFISRRDDALKHWKLSPVDIQSLDRWDDYTEAKNAMFFHTHTGDAPWVIIRSDDKKRARLNCIRYFLHQLDYPGKDVKAIGKVDDKIVLVPDTRYKEKTIDIGHD

SEQ ID NO: 1135 - DNA, 1236 bp, Neisseria gonorrhoeae
ttgcgtaaaatcgcccaaggcatacgcggacgcgccgacgagctgaccgacaccatcgttgccgaaggcggcaaaaccaaagacttggcgcgtgtggaagtgatgttcactgccgactatctcgattaccaagccgaatgggcgcgccgttacgaaggcgaaatcatccaaagcgaccgcccgcgcgaaaacattttatcgttcaaacgtccgctgggcgtgattgccggcattttgccgcggaacttccccttcttcctgatcgcccgcaaaatgggcccggatctggttacgggcaacaccatcgtcgtcaaacccagcagcgtaaccccgatcaactgccacatcttcgccgaaatcatcgatgcggtcggactgcccgcaggcgtgttcaacgtggtggacggtccgggtgcggaaatcggcaacgccttgtccgcccatccgcaagtcgatatggtcagcctgaccggctcggttgaagcgggtcgccaagtgatggaagccgcttccgccaacatcaccaaagtctcgctggaactcggcggcaaagcccccgccatcgtgttgaaagacgcggatttggatttagcggtgaaatccatcttggcttcgcgcgtcggcaacaccggtcaaatctgcaactgcgccgagcgcgtctatgtccacagcagcctgaaagacgcgttcattgaaaaaatgaccgccgcgatgaaaggcgtgcgctacggcaaccctgccgaagccgaagcaggcgcgccggaaatgggcacgctgattgaagagcgcgccgtcaaagccgttgccgaaaaagtggaacgggccgtcaaacaaggtgcgaaattggtttgcggcggcaaacgcaccgaaggacgcggctatttcttcgagcctaccctgctgaccgacaccgacaacagtatggacattatgaaagaagaaactttcggcctcgtgctgcccgtttccgctttcgacacgctcgaccaggtcatcgccctggcaaacgactgcgaattcggtctgaccagctccgtgtacaccaccaacctgaacgaagccttctacgttacccgccgcctgcaattcggcgaaacctacatcaaccgcgaaaacttcgaagccatgcagggcttccacgcgggctgggaaaaatccggcatcggcggcgcggacggcaaacacggtttggaagaatacctgcaaacccaagtcatttatctggaaaccgacatc

SEQ ID NO: 1136 - protein, 412 aa, Neisseria gonorrhoeae
LRKIAQGIRGRADELTDTIVAEGGKTKDLARVEVMFTADYLDYQAEWARRYEGEIIQSDRPRENILSFKRPLGVIAGILPRNFPFFLIARKMGPDLVTGNTIVVKPSSVTPINCHIFAEIIDAVGLPAGVFNVVDGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGAPEMGTLIEERAVKAVAEKVERAVKQGAKLVCGGKRTEGRGYFFEPTLLTDTDNSMDIMKEETFGLVLPVSAFDTLDQVIALANDCEFGLTSSVYTTNLNEAFYVTRRLQFGETYINRENFEAMQGFHAGWEKSGIGGADGKHGLEEYLQTQVIYLETDI

SEQ ID NO: 1137 - DNA, 198 bp, Neisseria gonorrhoeae
atgaaacaattggccatgtacatcaacggacgctttgaaaacgatttcaacggcgaatggcgcgacgtattgaacccgtccaccgaagaaaccatcgcccgcgaacccaaaggcggcagggcggacgttgaccgcggcgcgcgcggcgcaaccggcttgggagcgtctgcctgcggtcgaacgcggcgcgtatttgcg

SEQ ID NO: 1138 - protein, 66 aa, Neisseria gonorrhoeae
MKQLAMYINGRFENDFNGEWRDVLNPSTEETIAREPKGGRADVDRGARGATGLGASACGRTRRVFA

SEQ ID NO: 1139 - DNA, 90 bp, Neisseria gonorrhoeae
ttggtttattcccaaataaattaccgtacaagtttctttacacgcggattttgggtttcaagtcaaatacggcttaccggttttcttttt

SEQ ID NO: 1140 - protein, 30 aa, Neisseria gonorrhoeae
LVYSQINYRTSFFTRGFWVSSQIRLTGFLF

SEQ ID NO: 1141 - DNA, 174 bp, Neisseria gonorrhoeae
ttgtttcatttcgggccctccagttttgtagtcggatgtagttttggtttattcccaaataaattaccgtacaagtttctttacacgcggattttgggtttcaagtcaaatacggcttaccggttttcttttttagtttccgcaggcgtgctgccgaaatattgcctgaatgcc

SEQ ID NO: 1142 - protein, 58 aa, Neisseria gonorrhoeae
LFHFGPSSFVVGCSFGLFPNKLPYKFLYTRILGFKSNTAYRFSFLVSAGVLPKYCLNA

SEQ ID NO: 1143 - DNA, 765 bp, Neisseria gonorrhoeae
gtggagggcagctaccgtttcgatactttgtccaacggcatttccatccacggcggtacggtaacggcacggtgcgatttttgcagcagccgcctcgccgaaccttatgtgtcgttcgtgctgttgctggaagggcgtttggacttcggcatcaaccgccgccgcttccgcatcgatgcggacggcggcaagattgtcctaattgccgtcggggaagaagtcctgttcagccgctatctttatcgcggcggcaaaacggtcaaaatgaccattaaaggtatggaacaatggctgccgcgtccggaatacgcgcgtttcgcacccctgctttaccgcgaaccggtcaggatatgggatttgcccccaaacctgcgcggcttggcggcatcctgcctgcaaaccgtcccaaaggggcatttgggcgaaacattgcgccgcgaggcggacgtgttgcggctgctgtcggatttgtgggacacggtttcagacggcatcgagccggcggcggggcaaacggcggaagcagacgctatgccgtctgaagacttcagccgcaccctgaatgccgcgttcgacggcggcgcacaccaagtcaaccggctgacagccgcgctgaacatcagcgaaaggacgctgcaacgccgtatgcgcgaccatttcggcattacggcaagcgagtggctgcaccacaaacaaatgcagcacgcgctctatctgttgcaaaacgggggcaaaaacgtgggcgaaaccgcgtatttgtgcggc

SEQ ID NO: 1144 - protein, 255 aa, Neisseria gonorrhoeae
VEGSYRFDTLSNGISIHGGTVTARCDFCSSRLAEPYVSFVLLLEGRLDFGINRRRFRIDADGGKIVLIAVGEEVLFSRYLYRGGKTVKMTIKGMEQWLPRPEYARFAPLLYREPVRIWDLPPNLRGLAASCLQTVPKGHLGETLRREADVLRLLSDLWDTVSDGIEPAAGQTAEADAMPSEDFSRTLNAAFDGGAHQVNRLTAALNISERTLQRRMRDHFGITASEWLHHKQMQHALYLLQNGGKNVGETAYLCG

SEQ ID NO: 1145 - DNA, 237 bp, Neisseria gonorrhoeae
atgagcggggtggctgtctatctccgcaacaaaaacagaatagcaattgcctcccaagatgccaacctaaactccaaaggccggttcgtcagcagcggtctgaatgtgggcaaacaactgaccggcagtctcggcgtagagtttgacccatactaccgccaccgcgcaatccgcaagtctgccgaatttgtctcgaacactaccaaaaccaaaacagacagcgaaaagtttaacgag

SEQ ID NO: 1146 - protein, 79 aa, Neisseria gonorrhoeae
MSGVAVYLRNKNRIAIASQDANLNSKGRFVSSGLNVGKQLTGSLGVEFDPYYRHRAIRKSAEFVSNTTKTKTDSEKFNE

SEQ ID NO: 1147 - DNA, 180 bp, Neisseria gonorrhoeae
ttgataaatcataaaatcgcggtcaggggggcggtaagcggttcggcgcaggcggattgtccgcgcaaggtttcagacggtgcttcaaaaaatggggtacaatcgtgccagccgtcttcagacggtcttttgagcgaaaggccgtctgaaaactaccgacaaccgtctcaatcaggagaa

SEQ ID NO: 1148 - protein, 60 aa, Neisseria gonorrhoeae
LINHKIAVRGAVSGSAQADCPRKVSDGASKNGVQSCQPSSDGLLSERPSENYRQPSQSGE

SEQ ID NO: 1149 - DNA, 798 bp, Neisseria gonorrhoeae
atgagcccatccccctttatcgaaatgaaagacgtcgccttcgcgtatggcgaccgcccgattctgaacgacatcaatttcagcattccgcaaggcaattttgccgccgtgatgggcggttcgggcagcggcaaaaccacgctgatgaggctgattacaggacagattcgtccgcagtccgggcaggttttgattgaaggacgggatttggcgggtttttcggctgacgaactctacgaacaccgccgccgtatgggcgtattgttccaacacggcgcgctgtttaccgatttgtcggtattcgacaatatcgcttttccgatgcgcgaactgacgcaacttccggaagcggttattcgcgatttggttttgttgaaattgaacgcggtcggtctgcgcggcgtggaaaacctgatgccgtccgagttgtccggcgggatgtcgcgccgcgtcgcgctggcacgcacaatcgcgctcgaccccgaaattatgttgtacgacgaaccgtttaccggcctcgacccgatttccttgggcgtgattgcccacttgatcagccgcgtcaacaaggccttgcgttcgaccagcattatggtaacgcacgacattgaaaaatctttggaaatcgtcgatcaggtaattttcttggcgcacggcgaaattatgttctccggctcgccgcaggaaatgcgcgaactggattcgccttgggtgcgccagtttgtcggcgggctggcagacggccccgtggcataccgctatccggcgcaaacgtcgttgcagcaggatttgctcggg

SEQ ID NO: 1150 - protein, 266 aa, Neisseria gonorrhoeae
MSPSPFIEMKDVAFAYGDRPILNDINFSIPQGNFAAVMGGSGSGKTTLMRLITGQIRPQSGQVLIEGRDLAGFSADELYEHRRRMGVLFQHGALFTDLSVFDNIAFPMRELTQLPEAVIRDLVLLKLNAVGLRGVENLMPSELSGGMSRRVALARTIALDPEIMLYDEPFTGLDPISLGVIAHLISRVNKALRSTSIMVTHDIEKSLEIVDQVIFLAHGEIMFSGSPQEMRELDSPWVRQFVGGLADGPVAYRYPAQTSLQQDLLG

SEQ ID NO: 1151 - DNA, 123 bp, Neisseria gonorrhoeae
gtgtattttaaggcttatcgggaagacgggcaattttcagacggcatacggacggcaagtgttgtgaaaatgcctttgtcggcggcggattgtttgctgtggcgaaaaatgttatctttcaaa

SEQ ID NO: 1152 - protein, 41 aa, Neisseria gonorrhoeae
VYFKAYREDGQFSDGIRTASVVKMPLSAADCLLWRKMLSFK

SEQ ID NO: 1153 - DNA, 774 bp, Neisseria gonorrhoeae
atgaattttatccgttccgtcggggcgaaaaccctcggccttattcaatccttcggcagtatcacgctgtttctgctgaacattttggcgaaatccggcacggctttcgcccgtccgcgcctgagcgtgcgccaagtgtattttgccggcgtgctgtcggtgctgattgttgccgtttcggggctgttcgtcggtatggttttgggtttgcagggctatacgcagttgtcgaaattcaaatccgccgatattttgggctatatggtcgcggcttctctgttgcgcgaactgggtcccgtgttggcggcgattctgtttgccagcagcgcgggcggtgcgatgaccagcgaaatcggtttgatgaaaacgaccggacagctcgaagcgatgaacgtgatggcggtcaaccccgtcgcccgcgtggttgccccgcgtttttgggcgggcgtgttttctatgccgcttttggcttcgattttcaacgtcgcgggcattttcggcgcgtatttggtcggcgtgagctggctgggtttggacagcggtattttctggccgcagatgcagaacaacattacgatacattacgatgtaatcaacggtttgatcaaatccgccgcgttcggcgtggcggtaacgctgattgccgtgcatcagggcttccactgcatcccgacttcggaaggcattttgcgcgccagcacgcgcacggtggtttcgtccgccctgacgattttggcggtcgattttatattgaccgcgtggatgtttacagat

SEQ ID NO: 1154 - protein, 258 aa, Neisseria gonorrhoeae
MNFIRSVGAKTLGLIQSFGSITLFLLNILAKSGTAFARPRLSVRQVYFAGVLSVLIVAVSGLFVGMVLGLQGYTQLSKFKSADILGYMVAASLLRELGPVLAAILFASSAGGAMTSEIGLMKTTGQLEAMNVMAVNPVARVVAPRFWAGVFSMPLLASIFNVAGIFGAYLVGVSWLGLDSGIFWPQMQNNITIHYDVINGLIKSAAFGVAVTLIAVHQGFHCIPTSEGILRASTRTVVSSALTILAVDFILTAWMFTD

SEQ ID NO: 1155 - DNA, 561 bp, Neisseria gonorrhoeae
gtggatgtttacagattgacagactgtctgaagacgaaacgcggaacatcggatattcaaggaactttaatgaaaaagaacatattggaattttgggtcggactgttcgtcttgatcggcgcggcggcggttgcctttctcgctttccgcgtggcgggcggcgcggcgttcggcggttcggacaaaacttacgccgtttatgccgatttcggcgacatcggcggtttgaaggtcaatgcccccgtcaaatccgcaggcgtattggtcgggcgcgtcggcgctatcgggcttgacccgaaatcctatcaggcgagggtgcgccttgatttggacggcaagtatcagttcagcagtgacgtttccgcgcaaatcctgacttcgggacttttgggcgaacagtacatcgggctgcagcagggcggcgatacggaaaaccttgctgccggcgacaccatctccgtaaccagttctgcaatggttctggaaaacctgatcggtaaattcatgaccagcttcgccgagaaaaacgctgagggcggcaatgcggaaaaagccgcagaa

SEQ ID NO: 1156 - protein, 187 aa, Neisseria gonorrhoeae
VDVYRLTDCLKTKRGTSDIQGTLMKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAE

SEQ ID NO: 1157 - DNA, 588 bp, Neisseria gonorrhoeae
atgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaa

SEQ ID NO: 1158 - protein, 196 aa, Neisseria gonorrhoeae
MKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 1159 - DNA, 1161 bp, Neisseria gonorrhoeae
ttgttcgaaaaacccataccgccctcggacggtatggtttgtcggttatttgccgccgtttttggctttcaactcggcaatcagcccgtcgatgcctttggctttgatgatttcgccgaattggttgcggtacacggtaaccaggctcgtgccttcgatggcgacgttgtaggtacggtatttgccgccgctttggtaggtggtaaagtccatattgacgggcttctgaccggggatgccgacttcggcacggacgacgatttccttgccgcccttattgacgatgggattgtctttgacgttgacggtcgcgtttttgaatttcagcatcgtgccggaataggtgcggatcagcagggtttgaaattctttggccaacgcttgtttttgcgcgtcggacgcggtacgccaagggttgccgaccgccaatgcggtcatacgttggaaatcgaaatagggaaccgcataggcttcggcttttgggcgtgcagaagccgcgtcgccgcttttgaggatggtcaaaacctgtgtggcgttttggcggatttgtcccactgcgtcggccggggaggcaaatgccatgccgatgctcaaaataccgatgcccaatgcgctgatgaaggaggattttttcatgatgtctttcctgaaaatggatgtgtatgtttattctgcggctttttccgcattgccgccctcagcgtttttctcggcgaagctggtcatgaatttaccgatcaggttttccagaaccattgcagaactggttacggagatggtgtcgccggcagcaaggttttccgtatcgccgccctgctgcagcccgatgtactgttcgcccaaaagtcccgaagtcaggatttgcgcggaaacgtcactgctgaactgatacttgccgtccaaatcaaggcgcaccctcgcctgataggatttcgggtcaagcccgatagcgccgacgcgcccgaccaatacgcctgcggatttgacgggggcattgaccttcaaaccgccgatgtcgccgaaatcggcataaacggcgtaagttttgtccgaaccgccgaacgccgcgccgcccgccacgcggaaagcgagaaaggcaaccgccgccgcgccgatcaagacgaacagtccgacccaaaattccaatatgttctttttcat

SEQ ID NO: 1160 - protein, 387 aa, Neisseria gonorrhoeae
LFEKPIPPSDGMVCRLFAAVFGFQLGNQPVDAFGFDDFAELVAVHGNQARAFDGDVVGTVFAAALVGGKVHIDGLLTGDADFGTDDDFLAALIDDGIVFDVDGRVFEFQHRAGIGADQQGLKFFGQRLFLRVGRGTPRVADRQCGHTLEIEIGNRIGFGFWACRSRVAAFEDGQNLCGVLADLSHCVGRGGKCHADAQNTDAQCADEGGFFHDVFPENGCVCLFCGFFRIAALSVFLGEAGHEFTDQVFQNHCRTGYGDGVAGSKVFRIAALLQPDVLFAQKSRSQDLRGNVTAELILAVQIKAHPRLIGFRVKPDSADAPDQYACGFDGGIDLQTADVAEIGINGVSFVRTAERRAARHAESEKGNRRRADQDEQSDPKFQYVLFH

SEQ ID NO: 1161 - DNA, 276 bp, Neisseria gonorrhoeae
atgcatacagaactcaaaaacggaacactgcacatcggcggcgacatcaccgtcaaaaccctgaccggggacgcatttgggcgtttccggcaacaatgccgtctgaaagaaaccattgccgtcgatttcggaggtgtcaaacgtgccgattccgcctgcatgtcgctgctgctcgaagtgctgcgcggctgcaaaggcagcgtcaggctgaccggcattcccgaatccgtgcgcgcgctgtccgaactgtacgaaatcaaagactggctgaaatca

SEQ ID NO: 1162 - protein, 92 aa, Neisseria gonorrhoeae
MHTELKNGTLHIGGDITVKTLTGDAFGRFRQQCRLKETIAVDFGGVKRADSACMSLLLEVLRGCKGSVRLTGIPESVRALSELYEIKDWLKS

SEQ ID NO: 1163 - DNA, 1098 bp, Neisseria gonorrhoeae
atggcaggcaacactttcggacaaatcttcaccgtgaccaccttcggcgaaagccacggcgcgggtttgggctgcatcatcgacggctgcccgcccggcttggaattaagcgaagcggatatccaatttgacctcgaccggcgcaaacccggcaccagccgccacgttacccaacgccgcgaagccgaccaagtcgaaatcctctccggcgtattcgaaggcaaaaccaccggcacacccatcgccctcctaatccgcaacaccgaccagcgcagcaaagactacggcaacatcgccaccgccttccgccccggacacgccgactatacctattggcacaaatacggtacgcgcgactaccggggcggcggcaggagttccgcccgcgaaaccgcagcccgcgttgccgccggagccgttgccaaaaaatggctgaaagaaaaattcggcacggaaatcaccgcctacgttacccaagtcggcgaaaaaaaaatccggtttgaaggcagcgaacacatttcccaaaatcctttttttgccgccaaccaaagccaaatcgccgaactggaacactatatggacggtgtgcgcaaatccttggattccgtcggcgcgaaactgcatatcgaagccgccaacgtccccgtcggtttgggcgaacccgttttcgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccattcgggcggcatcctcggcggcatcagcaccgggcaagacatctgcgtcaatatcgccatcaaacccaccagctccatcgccacaccgcgccgaagcatcgacattcacggcaaccccgtcgaactcgccacccgcggcaggcacgatccctgcgtcggcttgcgcaccgcgccgattgccgaagctatgctcgccttggttttaatcgaccacgccctgcgccatcgtgcgcaaaatgcggatgttgccgcggatacgcccgatatttcccgctcggacaag

SEQ ID NO: 1164 - protein, 366 aa, Neisseria gonorrhoeae
MAGNTFGQIFTVTTFGESHGAGLGCIIDGCPPGLELSEADIQFDLDRRKPGTSRHVTQRREADQVEILSGVFEGKTTGTPIALLIRNTDQRSKDYGNIATAFRPGHADYTYWHKYGTRDYRGGGRSSARETAARVAAGAVAKKWLKEKFGTEITAYVTQVGEKKIRFEGSEHISQNPFFAANQSQIAELEHYMDGVRKSLDSVGAKLHIEAANVPVGLGEPVFDRLDAEIAYAMMGINAVKGVEIGAGFDSVTQRGSEHGDELTPQGFLSNHSGGILGGISTGQDICVNIAIKPTSSIATPRRSIDIHGNPVELATRGRHDPCVGLRTAPIAEAMLALVLIDHALRHRAQNADVAADTPDISRSDK

SEQ ID NO: 1165 - DNA, 1113 bp, Neisseria gonorrhoeae
atgatttatcaaagaaacctcatcaaagaactctcttttaccgccgtcggcattttcgtcgtcctcttggcggtgttggtgtccacgcaggcgatcaacctgcttggccgcgcagctgacgggcgtgtcgccatcgatgccgtgttggccttagtcggcttctgggtcatcggtatgaccccgcttttgctggtgttgaccgcattcatcagcacgctgaccgtattgacccgctactggcgcgacagcgaaatgtcggtctggctatcctgcggattggcgttgaaacagtggatacgccccgtcatgcagtttgccgtgccgtttgccatcctgattgccgtcatgcagctttgggtgataccgtgggcagagctgcgcagccgcgaatatgccgaaattttgaagcagaagcaggaattgtctttggtggaagccggcgagttcaataacttgggcaagcgcaacggcagggtttatttcgtcgaaacctttgacaccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaacttatcgaccccgtttcccaccgccgcaccatttcgaccgcccaactgattggcagcagcaatccgcaacatcaggcagaattgatgtggcgcatctcgctgaccgtcagcgtcctcctgctctgcctactcgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacatcatcatgttcgtcatcgcaatcgtacttctgcgcgtccgcagtatgcccagccagcccttctggcaggcggttggcaaaagtctgacattgaaaggcggaaaa

SEQ ID NO: 1166 - protein, 371 aa, Neisseria gonorrhoeae
MIYQRNLIKELSFTAVGIFVVLLAVLVSTQAINLLGRAADGRVAIDAVLALVGFWVIGMTPLLLVLTAFISTLTVLTRYWRDSEMSVWLSCGLALKQWIRPVMQFAVPFAILIAVMQLWVIPWAELRSREYAEILKQKQELSLVEAGEFNNLGKRNGRVYFVETFDTESGIMKNLFLREQDKNGGDNIIFAKEGNFSLNDNKRTLELRHGYRYSGTPGRADYNQVSFQKLNLIISTTPKLIDPVSHRRTISTAQLIGSSNPQHQAELMWRISLTVSVLLLCLLAVPLSYFNPRSGHTYNILIAIGLFLIYQNGLTLLFEAVEDGKIHFWLGLLPMHIIMFVIAIVLLRVRSMPSQPFWQAVGKSLTLKGGK

SEQ ID NO: 1167 - DNA, 141 bp, Neisseria gonorrhoeae
ttgtttcacacaaaccgaaaatgccgtcttaaaaccaattttcagacggcatttgtcccttaaaacacgttttttcaagcgcgaccataccaaacacccacaggttgccttccacccttcgtacaacctttgctccatcaa

SEQ ID NO: 1168 - protein, 20 aa, Neisseria gonorrhoeae
LFHTNRKCRLKTNFQTAFVP

SEQ ID NO: 1169 - DNA, 831 bp, Neisseria gonorrhoeae
atgaaaaaaaccgcctacgccatcctcctgctgatcgggttcgcttccgcccctgcatttgcagaaacccgccccgccgacccttatgaaggctacaaccgcgccgtttccaaattcaacgaccaagccgaccgctacattttcgcccctgccgcgcgcggctaccgcaaagttacgccgaaacccgtccgcgccggcgtgtccaatttttttaacaacctgcgcgacgtggtcagtttcggcagcaatatcttgcgtttggacatcaaacgcgcaagcgaagacctcgtccgcgtcggcatcaataccaccttcggtttgggcgggctcattgatattgccggcgcgggcggcgttcccgacaataaaaacactttgggcgacacgtttgcctcgtggggctggaaaaacagcaattatttcgtgttgcccgtcttaggcccgtccaccgtccgcgacgcgctcggcacgggcattacctctgtttatccgcccaagaatatcgttttccatacccctgccggacgctggggcacgactgccgctgccgccgtcagtacgcgcgaaggcctgctcgatttgaccgacagtctggacgaagccgccatcgacaaatacagctacacgcgcgacctctatatgaaagtccgcgcacggcagaccggtgcaacacctgccgaaggtacggaagataacatcgacatcgacatcgacgaattggtcgaaagtgccgaaaccggcgcggcagagcccgccgttcacgaagattccgtatccgaaacacaggcagaagcagcaggggaagccgaaacgcaacctggaacacaaccc

SEQ ID NO: 1170 - protein, 277 aa, Neisseria gonorrhoeae
MKKTAYAILLLIGFASAPAFAETRPADPYEGYNRAVSKFNDQADRYIFAPAARGYRKVTPKPVRAGVSNFFNNLRDVVSFGSNILRLDIKRASEDLVRVGINTTFGLGGLIDIAGAGGVPDNKNTLGDTFASWGWKNSNYFVLPVLGPSTVRDALGTGITSVYPPKNIVFHTPAGRWGTTAAAAVSTREGLLDLTDSLDEAAIDKYSYTRDLYMKVRARQTGATPAEGTEDNIDIDIDELVESAETGAAEPAVHEDSVSETQAEAAGEAETQPGTQP

SEQ ID NO: 1171 - DNA, 480 bp, Neisseria gonorrhoeae
atgccgtctgaaaatccgtgttcggacggcattcccttccgtcggaacggacagtccgacactacagattgggctataatcccttttttgcgcataccgcgcgacagcaaaggaaaaaccatgtacgaagtcaaccgcagcgtattcgtcctcatccctttagaacctttttggaactggctgcaaaccctgccgggcaaccacctcgacggactgaccctcgaagacatccaagccgatgccaattcctaccttgtccgcccgtgcgaaaccgccgacgaagtatgggacgaaatcgaagcccgtttcgaagacattttcgccgccgaacttgccgactggtgcgaagacgaacgcgagtggcccgcactcgatgccgacattttcaacgaatggttcgacatccagctttctaccgtcatcaccgacctcgaacacgaaccgcttgcccgcgaagccttccaacccatcaacctgaac

SEQ ID NO: 1172 - protein, 160 aa, Neisseria gonorrhoeae
MPSENPCSDGIPFRRNGQSDTTDWAIIPFLRIPRDSKGKTMYEVNRSVFVLIPLEPFWNWLQTLPGNHLDGLTLEDIQADANSYLVRPCETADEVWDEIEARFEDIFAAELADWCEDEREWPALDADIFNEWFDIQLSTVITDLEHEPLAREAFQPINLN

SEQ ID NO: 1173 - DNA, 381 bp, Neisseria gonorrhoeae
atgaagctgaccgtccgcaattaccatctcgacggctacggtcatgtcaacaatgcacgctacctcgaatttctcgaggaagcgcgctgggcgttttttgaaaaacgcggactgatgcacgagttggcaggcctcatactgattgtcgcccgcatcgacatccgatacagccgtcccgccgtcgaaggcgacgtattgcagttttcatgccgcctgaaaacccccggcatgcgccgcattgtgctgacccagacgattacactgccaaacggcaaaaccgccgcagaagccgacatcaccctgatgcccgtccacgccgccacacaacgcaccgtcagcctgcccgccacccttgcccgcgcactggaagccttgtccgaa

SEQ ID NO: 1174 - protein, 127 aa, Neisseria gonorrhoeae
MKLTVRNYHLDGYGHVNNARYLEFLEEARWAFFEKRGLMHELAGLILIVARIDIRYSRPAVEGDVLQFSCRLKTPGMRRIVLTQTITLPNGKTAAEADITLMPVHAATQRTVSLPATLARALEALSE

SEQ ID NO: 1175 - DNA, 486 bp, Neisseria gonorrhoeae
atgaaaaaaatactcaccgccgccgccgtcgcactgatcggcatcctccttgccaccgtcctcatccccgacagtaaaaccgcgcccgccttctccctgcccgacctgcacggaaaaaccgtttccaacgccgacctgcaaggcaaagtcaccctgattaatttttggtttccctcctgtccgggttgtgtgagcgaaatgcccaaagtcaccaaaacggcaaacgactacaaaaataaagatttccaagtcctcgccgttgcccagcccatcgatccgatagaaagcgtccgccaatacgtcaaagactacggactgccgtttaccgtcatttatgatgcggacaaagccgtcggacaggcattcggcacacaggtttatccgacttccgtccttatcggcaaaaaaggcgaaatcctcaaaacttatgtcggcgaacccgatttcggcaaactctaccaagaaatcgataccgcgctggcgcaa

SEQ ID NO: 1176 - protein, 162 aa, Neisseria gonorrhoeae
MKKILTAAAVALIGILLATVLIPDSKTAPAFSLPDLHGKTVSNADLQGKVTLINFWFPSCPGCVSEMPKVTKTANDYKNKDFQVLAVAQPIDPIESVRQYVKDYGLPFTVIYDADKAVGQAFGTQVYPTSVLIGKKGEILKTYVGEPDFGKLYQEIDTALAQ

SEQ ID NO: 1177 - DNA, 804 bp, Neisseria gonorrhoeae
ttgcgccagcgcggtatcgatttcttggtagagtttgccgaaatcgggttcgccgacataagttttgaggatttcgccttttttgccgataaggacggaagtcggataaacctgtgtgccgaatgcctgtccgacggctttgtccgcatcataaatgacggtaaacggcagtccgtagtctttgacgtattggcggacgctttctatcggatcgatgggctgggcaacggcgaggacttggaaatctttatttttgtagtcgtttgccgttttggtgactttgggcatttcgctcacacaacccggacaggagggaaaccaaaaattaatcagggtgactttgccttgcaggtcggcgttggaaacggtttttccgtgcaggtcgggcagggagaaggcgggcgcggttttactgtcggggatgaggacggtggcaaggaggatgccgatcagtgcgacggcggcggcggtgagtatttttttcattcggacaaggcttccagtgcgcgggcaagggtggcgggcaggctgacggtgcgttgtgtggcggcgtggacgggcatcagggtgatgtcggcttctgcggcggttttgccgtttggcagtgtaatcgtctgggtcagcacaatgcggcgcatgccgggggttttcaggcggcatgaaaactgcaatacgtcgccttcgacggcgggacggctgtatcggatgtcgatgcgggcgacaatcagtatgaggcctgccaactcgtgcatcagtccgcgtttttcaaaaaacgcccagcgcgcttcctcgagaaattcgagg

SEQ ID NO: 1178 - protein, 268 aa, Neisseria gonorrhoeae
LRQRGIDFLVEFAEIGFADISFEDFAFFADKDGSRINLCAECLSDGFVRIINDGKRQSVVFDVLADAFYRIDGLGNGEDLEIFIFVVVCRFGDFGHFAHTTRTGGKPKINQGDFALQVGVGNGFSVQVGQGEGGRGFTVGDEDGGKEDADQCDGGGGEYFFHSDKASSARARVAGRLTVRCVAAWTGIRVMSASAAVLPFGSVIVWVSTMRRMPGVFRRHENCNTSPSTAGRLYRMSMRATISMRPANSCISPRFSKNAQRASSRNSR

SEQ ID NO: 1179 - DNA, 534 bp, Neisseria gonorrhoeae
atgccgtctgaagcgcaaaaaacagaaacgatgttcctgttttttcagatcatccgccccgacacgttcagacggcattcaaccttccggcagattctttttcaccaccgcaggattgcctgccgccaaagagtagggcggaatgtcttttgtaaccaccgcgcctgcgcccacgaccgagccgcgtccgacggttacgcccgccatcacaatcaccctgcgccccggccagacatcgtcctccaacgtaatcggacggatttccgtgtagccctcaaagcgtttgttttcacggtcaaacttgtggttggtcgaatagagcaggcattccggccccatcatcacatttttgccgaccaccagcccacggcagatttcacagtttgccccgatgcccgagccgtcgcccaaaaccgtatccggaaacacatacgccccgcgttcgatattgaccccgcgtccgatatgcggagaaacccgccgcgccaaaaaaccgcgcacccgtctgccgacgatgccgatgccgcgcatata

SEQ ID NO: 1180 - protein, 178 aa, Neisseria gonorrhoeae
MPSEAQKTETMFLFFQIIRPDTFRRHSTFRQILFHHRRIACRQRVGRNVFCNHRACAHDRAASDGYARHHNHPAPRPDIVLQRNRTDFRVALKAFVFTVKLVVGRIEQAFRPHHHIFADHQPTADFTVCPDARAVAQNRIRKHIRPAFDIDPASDMRRNPPRQKTAHPSADDADAAHI

SEQ ID NO: 1181 - DNA, 513 bp, Neisseria gonorrhoeae
atggaatcaaaattctttttcctgctgctgcgttttgccggttcggtgttgccgccgtcatatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggggccggaatgcctgctctattcgaccaaccacaagtttgaccgtgaaaacaaacgctttgagggctacacggaaatccgtccgattacgttggaggacgatgtctggccggggcgcagggtgattgtgatggcgggcgtaaccgtcggacgcggctcggtcgtgggcgcaggcgcggtggttacaaaagacattccgccctactctttggcggcaggcaatcctgcggtggtgaaaaagaatctgccggaaggt

SEQ ID NO: 1182 - protein, 171 aa, Neisseria gonorrhoeae
MESKFFFLLLRFAGSVLPPSYMRGIGIVGRRVRGFLARRVSPHIGRGVNIERGAYVFPDTVLGDGSGIGANCEICRGLVVGKNVMMGPECLLYSTNHKFDRENKRFEGYTEIRPITLEDDVWPGRRVIVMAGVTVGRGSVVGAGAVVTKDIPPYSLAAGNPAVVKKNLPEG

SEQ ID NO: 1183 - DNA, 114 bp, Neisseria gonorrhoeae
aaaccaattttcagacggcatttgtcccttaaaacacgttttttcaagcgcgaccataccaaacacccacaggttgccttccacccttcgtacaacctttgctccatcaaacat

SEQ ID NO: 1184 - protein, 38 aa, Neisseria gonorrhoeae
KPIFRRHLSLKTRFFKRDHTKHPQVAFHPSYNLCSIKH

SEQ ID NO: 1185 - DNA, 96 bp, Neisseria gonorrhoeae
ttgattccatcaaaccttcctcaaaagaactttttacattttatcgaatatcctcttgacgaaacaacagaaaatagcgagaatgccgagcttgtc

SEQ ID NO: 1186 - protein, 32 aa, Neisseria gonorrhoeae
LIPSNLPQKNFLHFIEYPLDETTENSENAELV

SEQ ID NO: 1187 - DNA, 228 bp, Neisseria gonorrhoeae
ttgaaaggaaatcaaatgaaacaaggtattcacccgaactaccgcgaagttaacgttacctgctcttgcggcaacaaattcgtaaccaaatccgcaatggaaaaagaaaactttaacatcgaggtttgctccctgtgccacccgttctataccggcacccaaaaaatcgtcgataccaccggccgcgtggacaaattcaacaacaaattcggcaacctgttcaaacgc

SEQ ID NO: 1188 - protein, 76 aa, Neisseria gonorrhoeae
LKGNQMKQGIHPNYREVNVTCSCGNKFVTKSAMEKENFNIEVCSLCHPFYTGTQKIVDTTGRVDKFNNKFGNLFKR

SEQ ID NO: 1189 - DNA, 117 bp, Neisseria gonorrhoeae
ttgtttcatttgatttcctttcaaaaaagcgggcataggggatgtacctatgcctcagacaagctcggcattctcgctattttctgttgtttcgtcaagaggatattcgataaaatg

SEQ ID NO: 1190 - protein, 39 aa, Neisseria gonorrhoeae
LFHLISFQKSGHRGCTYASDKLGILAIFCCFVKRIFDKM

SEQ ID NO: 1191 - DNA, 105 bp, Neisseria gonorrhoeae
ttgttaatccactatatagataagaagtcagtgtgccaaatattaaaaagccctgccatcgaaatgatggcagggcttaattcttgcaaagcggcaatcagcgtt

SEQ ID NO: 1192 - protein, 35 aa, Neisseria gonorrhoeae
LLIHYIDKKSVCQILKSPAIEMMAGLNSCKAAISV

SEQ ID NO: 1193 - DNA, 639 bp, Neisseria gonorrhoeae
atgggatgttttatgattcaaaatgttgttacttcaataatcctgtattctgggacagccgtagacttacttacttatcctaatgttattttttgccaaaaaaaaagcagaaaagacatcattaacatctatttaggacaatttctaggctctgttagcctgatattgctaagtttgctttttgcatttgtcttagattatattcctagtaaagagattttaggtttgctcggcttgattccgattttcctaggcctcaaagttttgctgttaggagattccgatggagagtctattgccaaagagggtttgcgcaaagataataaaaacctgatttttctagtcgctatgattacttttgcaagttgtggcgctgacaatattggtgtctttgtcccatattttactaccttaaatttagcgaatttgatagtggctttacttacctttctagttatgatttatctcttggttttttctgcccaaaaattggcacaagtcccttctgtcggagaaactttggaaaaatatagcagatggtttgttgccgttgtttatttaggattggggatatatatcctgattgaaaacaacagttttgatatgctatggactgtgtcgggccaggaaaaaatatta

SEQ ID NO: 1194 - protein, 213 aa, Neisseria gonorrhoeae
MGCFMIQNVVTSIILYSGTAVDLLTYPNVIFCQKKSRKDIINIYLGQFLGSVSLILLSLLFAFVLDYIPSKEILGLLGLIPIFLGLKVLLLGDSDGESIAKEGLRKDNKNLIFLVAMITFASCGADNIGVFVPYFTTLNLANLIVALLTFLVMIYLLVFSAQKLAQVPSVGETLEKYSRWFVAVVYLGLGIYILIENNSFDMLWTVSGQEKIL

SEQ ID NO: 1195 - DNA, 1878 bp, Neisseria gonorrhoeae
ttgaaaacaacagttttgatatgctatggactgtgtcgggccaggaaaaaatattatgaaaaagatagtatctgcaaagactgccccgtgcagtcttttttgttgccggtctttttgtgtctgatgccgtctgaagcagtctctgcacgacctttgtgcgaatatttgctacacttggcaatccgtccatttcttctcacgcttatgctgacctataccccgcccgatgcccgcccgcccgccaaaacccacgaaaaaccgtggctgctgctgttgatggcgtttgcctggctgtggcccggcgtgttttcccacgatttgtggaatcctgccgaacctgccgtctataccgccgtcgaagcactggcaggcagccccacccccttggttgcccatctgttcggtcaaaccgatttcggcataccgcccgtgtatctttgggttgccgccgcattcaaacatttgctgtcgccgtgggcagccgacccgtatgatgccgcacgctttgcaggcgtattttttgccgttatcggactgacttcttgcggctttgccggtttcaactttttgggcagacaccacgggcgcagcgttgttttaatccatatcggctgtatcgggctgattccggttgcccatttcctcaatcccgccgccgccgcctttgccgccgccggactggtgctgcacggctactcgctggcacgccggcgcgtgattgccgcctctttcctgctcggtacgggttggacgttgatgtcgctggcggcagcttatccggcggcgtttgcgctgatgctgcccctgcccgtgctgatgtttttccgtccgtggcaaagcaggcgtttgatgttgacggcagtcgcctcgcttgcctttgccctgccgcttatgaccgtttacccgctgctcttggcaaaaacgcagcccgcgctgtttgcgcaatggctcaactatcacgttttcggtacgttcggcggcgtgcggcacattcagacggcattcagtttgttttactatctgaaaaatctgctttggttcgcactgcccgcgctgccgctggcggtttggacggtttgccgcacacgcctgttttcgaccgactgggggattttgggcattgtctggatgcttgccgttttggtgctgctcgcctttaatccgcagcgttttcaagacaacctcgtctggctgctgccgccgcttgccctgttcggcgcggcgcaactggacagcctgaggcgcggcgcggcggcttttgtcaactggttcggcattatggcgttcgggctgtttgccgtgttcctgtggacgggctttttcgccatgaattacggctggcccgccaagcttgccgaacgcgccgcctacttcagcccgtattacgttcccgacatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgcccgtcgtccggagtatggaggcatcgttttccccggaattaaaacgggagctttcagacggcatcgagtgtatcggcataggcggcggcgacctgcacacgcggattgtttggacgcagtacggcacattgccgcaccgcgtcggcgatgtccgttgccgctaccgtatcgtccgcctgccccaaaacgcggatgcgccgcaaggctggcagacggtctggcagggtgcgcgcccgcgcaacaaagacagtaagtttgcactgatacggaaaatcggggaaaatatattaaaaacaacagat

SEQ ID NO: 1196 - protein, 626 aa, Neisseria gonorrhoeae
LKTTVLICYGLCRARKKYYEKDSICKDCPVQSFLLPVFLCLMPSEAVSARPLCEYLLHLAIRPFLLTLMLTYTPPDARPPAKTHEKPWLLLLMAFAWLWPGVFSHDLWNPAEPAVYTAVEALAGSPTPLVAHLFGQTDFGIPPVYLWVAAAFKHLLSPWAADPYDAARFAGVFFAVIGLTSCGFAGFNFLGRHHGRSVVLIHIGCIGLIPVAHFLNPAAAAFAAAGLVLHGYSLARRRVIAASFLLGTGWTLMSLAAAYPAAFALMLPLPVLMFFRPWQSRRLMLTAVASLAFALPLMTVYPLLLAKTQPALFAQWLNYHVFGTFGGVRHIQTAFSLFYYLKNLLWFALPALPLAVWTVCRTRLFSTDWGILGIVWMLAVLVLLAFNPQRFQDNLVWLLPPLALFGAAQLDSLRRGAAAFVNWFGIMAFGLFAVFLWTGFFAMNYGWPAKLAERAAYFSPYYVPDIDPIPMAVAVLFTPLWLWAITRKNIRGRQAVTNWAAGVTLTWALLMTLFLPWLDAAKSHAPVVRSMEASFSPELKRELSDGIECIGIGGGDLHTRIVWTQYGTLPHRVGDVRCRYRIVRLPQNADAPQGWQTVWQGARPRNKDSKFALIRKIGENILKTTD

SEQ ID NO: 1197 - DNA, 144 bp, Neisseria gonorrhoeae
gtgccggaaatcgcgtataattgcgcgattaaacccttatatagtggattaaatttaaatcaggacaaggcgacgaagccgcagacagtacaaatagtacggcaaggcgaggcaacgccgtaccggtttaaatttaatccacta

SEQ ID NO: 1198 - protein, 48 aa, Neisseria gonorrhoeae
VPEIAYNCAIKPLYSGLNLNQDKATKPQTVQIVRQGEATPYRFKFNPL

SEQ ID NO: 1199 - DNA, 603 bp, Neisseria gonorrhoeae
atgatgaccctctattccggcattacctgccccttcagccaccgctgccgcttcgttttgtacgaaaaaggtatggattttgaaatcaaagatatcgatatttacaacaaacccgaagacctcgccgtcatgaacccgtacaaccaagtccccgtgctggtcgagcgcgatttggtgctgcacgagtccaacatcatcaacgaatacatcgacgaacgcttcccccatccgcagcttatgcccggcgatcccgttatgcgcggccgggggcggctggtgctgtaccgtatggaaaaagaattgttcaaccacgtccaagttttggaaaaccccgccgccgccaacaaggaacaggcaaaagcgcgcgaagccatcggcaacggcctgacgatgctttccccttcgttcagcaaaagcaaatacatcctcggcgaagatttttctatgattgatgttgccctggccccgctgttgtggcggctcgaccattacgatgtcaaactgggcaaaagtgccgcgccgctgctcaaatacgccgagcgtatcttccagcgcgaagcctttatcgaagcactgacacccgccgaaaaagccatgcgcaaa

SEQ ID NO: 1200 - protein, 201 aa, Neisseria gonorrhoeae
MMTLYSGITCPFSHRCRFVLYEKGMDFEIKDIDIYNKPEDLAVMNPYNQVPVLVERDLVLHESNIINEYIDERFPHPQLMPGDPVMRGRGRLVLYRMEKELFNHVQVLENPAAANKEQAKAREAIGNGLTMLSPSFSKSKYILGEDFSMIDVALAPLLWRLDHYDVKLGKSAAPLLKYAERIFQREAFIEALTPAEKAMRK

SEQ ID NO: 1201 - DNA, 786 bp, Neisseria gonorrhoeae
gtgcctgaatgtgaaaatgcctgcaaaacggcgggttttgcaagcatttcggacttatttgcgcatggctttttcggcgggtgtcagtgcttcgataaaggcttcgcgctggaagatacgctcggcgtatttgagcagcggcgcggcacttttgcccagtttgacatcgtaatggtcgagccgccacaacagcggggccagggcaacatcaatcatagaaaaatcttcgccgaggatgtatttgcttttgctgaacgaaggggaaagcatcgtcaggccgttgccgatggcttcgcgcgcttttgcctgttccttgttggcggcggcggggttttccaaaacttggacgtggttgaacaattctttttccatacggtacagcaccagccgcccccggccgcgcataacgggatcgccgggcataagctgcggatgggggaagcgttcgtcgatgtattcgttgatgatgttggactcgtgcagcaccaaatcgcgctcgaccagcacggggacttggttgtacgggttcatgacggcgaggtcttcgggtttgttgtaaatatcgatatctttgatttcaaaatccatacctttttcgtacaaaacgaagcggcagcggtggctgaaggggcaggtaatgccggaatagagggtcatcataataattgtcgctcctgtgtgatgcctgcaaaacggctgatttatagtggattaaatttaaaccggtacggcgttgcctcgccttgccgtactatttgtactgtctgcggcttcgtcgccttgtcc

SEQ ID NO: 1202 - protein, 262 aa, Neisseria gonorrhoeae
VPECENACKTAGFASISDLFAHGFFGGCQCFDKGFALEDTLGVFEQRRGTFAQFDIVMVEPPQQRGQGNINHRKIFAEDVFAFAERRGKHRQAVADGFARFCLFLVGGGGVFQNLDVVEQFFFHTVQHQPPPAAHNGIAGHKLRMGEAFVDVFVDDVGLVQHQIALDQHGDLVVRVHDGEVFGFVVNIDIFDFKIHTFFVQNEAAAVAEGAGNAGIEGHHNNCRSCVMPAKRLIYSGLNLNRYGVASPCRTICTVCGFVALS

SEQ ID NO: 1203 - DNA, 450 bp, Neisseria gonorrhoeae
ttgcaaaacccgccgttttgcaggcattttcacattcaggcacaccacacggaacccatcatgcccacctcaaccaaaccctacatcctccgcgcactttgcgaatggtgcagcgacaacagcctcacgccgcacatccttgtctgggtaaacgagcatacgcgcgtccccatgcagtacgtccgcgacaacgaaattatgctcaacatcggcgcgaccgccacgcaaaaccttcgaatcgacaacgattggatcagcttttccgcccgtttcggcggacaagcgcacgacatatggatacctgtcggacacgtcctcagccttttcgcacgggagaccggagaaggtatggggtttgaattggaggagtaccgccccgacacgccgtctgaaaacacctctgccgaaaccgcgccccggcccgccaaaaaaggtttgaaattggtcaaa

SEQ ID NO: 1204 - protein, 150 aa, Neisseria gonorrhoeae
LQNPPFCRHFHIQAHHTEPIMPTSTKPYILRALCEWCSDNSLTPHILVWVNEHTRVPMQYVRDNEIMLNIGATATQNLRIDNDWISFSARFGGQAHDIWIPVGHVLSLFARETGEGMGFELEEYRPDTPSENTSAETAPRPAKKGLKLVK

SEQ ID NO: 1205 - DNA, 465 bp, Neisseria gonorrhoeae
ttgcatcgattcattccccgatatagcgcaggtctttctccagccatttcccttccaaacaaagaacaaaaaagcgccggcggcagccgatgccccttcctttacaggttcccctattttttaaccgcaggcagcaccggtttggcggggccttttggtgcgggcgcgccgacggaagcctggtctttcagcttcgccagcaccgccggaccgatgcccttcaccttgatcaaatcgtccacagacttgaacgcgccgttttgcgcgcggtattccgcaatggccttcgccgggcctatgcccggcagcgcctccagcttctggtgggaaacccgattgaatgttaaccgccgaaagggagaaggcgcaggagaacagcatacagaacaatacaaacatttttttcatggtttttcctttaagggttgcaaacaacaaaccgcatcttgcgacgatatggcggat

SEQ ID NO: 1206 - protein, 155 aa, Neisseria gonorrhoeae
LHRFIPRYSAGLSPAISLPNKEQKSAGGSRCPFLYRFPYFLTAGSTGLAGPFGAGAPTEAWSFSFASTAGPMPFTLIKSSTDLNAPFCARYSAMAFAGPMPGSASSFWWETRLNVNRRKGEGAGEQHTEQYKHFFHGFSFKGCKQQTASCDDMAD

SEQ ID NO: 1207 - DNA, 423 bp, Neisseria gonorrhoeae
atgacacaagaaaccgctttgggcgcggcactgaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgattccgcactgattgcacgcgtcctcgccaaccactgccgccgtccgcgctatctgaaagccttggcgcgcggcggcaaacgtttcgatttgaacaaccgtttcaaaggcgaagttacccccgaagaacaggcgattgcgcaaaaccatcctttcgtgcagcaggctttgcaacagcagtccgcccaagctgccgccgaaacgccgtctgttgaagccgaagcagccgaatcttccgcagcagaa

SEQ ID NO: 1208 - protein, 141 aa, Neisseria gonorrhoeae
MTQETALGAALKSAVQTMSKKKQTEMIADHIYGKYDVFKRFKPLALGIDQDLIAALPQYDSALIARVLANHCRRPRYLKALARGGKRFDLNNRFKGEVTPEEQAIAQNHPFVQQALQQQSAQAAAETPSVEAEAAESSAAE

SEQ ID NO: 1209 - DNA, 1068 bp, Neisseria gonorrhoeae
atgaacctgatttcacgttacatcatccgccaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactcatgcccctcgccgtcctcatcggcggactggcctctctcagccagcttgccgccggcagcgaactggccgtcatcaaagccagcggcatgagcaccaaaaagctgctgttgattctgtctcagttcggttttatttttgctattgccgccgtcgcgctcggcgaatgggttgcgcccacgctgagccaaaaagccgaaaacatcaaagccgccgccattaacggcaaaatcagcaccggcaataccggcctttggctgaaagaaaaaaccagcattatcaatgtgcgcggaatgttgcccgaccatacgcttttgggcatcaaaatttgggcgcgcaacgataaaaacgaattggcagaggcagtggaagccgattccgccgttttgaacagcgacggcagctggcagttgaaaaacatccgccgcagcatcatgggtacagacaaaatcgaaacatccgccgccgccgaagaaacttggccgattgccgtcagacgcaacctgatggacgtattgctcgtcaagcccgaccaaatgtccgtcggcgagctgaccacctacatccgccacctccaaaacaacagccaaaacacccaaatctacgccatcgcatggtggcgtaaactcgtttaccccgtcgccgcatgggtcatggcgctcgttgccttcgcctttacgccgcaaaccacgcgccacggcaatatgggcttaaaactcttcggcggcatctgtctcggattgctgttccaccttgccggcaggctcttcgggtttaccagccaactctacggcaccccacccttcctcgccggcgcactgcctaccatagccttcgccttgctcgctgtttggctgatacgcaaacaggaaaaacgt

SEQ ID NO: 1210 - protein, 356 aa, Neisseria gonorrhoeae
MNLISRYIIRQMAVMAVYALLAFLALYSFFEILYETGNLGKGSYGIWEMLGYTALKMPARAYELMPLAVLIGGLASLSQLAAGSELAVIKASGMSTKKLLLILSQFGFIFAIAAVALGEWVAPTLSQKAENIKAAAINGKISTGNTGLWLKEKTSIINVRGMLPDHTLLGIKIWARNDKNELAEAVEADSAVLNSDGSWQLKNIRRSIMGTDKIETSAAAEETWPIAVRRNLMDVLLVKPDQMSVGELTTYIRHLQNNSQNTQIYAIAWWRKLVYPVAAWVMALVAFAFTPQTTRHGNMGLKLFGGICLGLLFHLAGRLFGFTSQLYGTPPFLAGALPTIAFALLAVWLIRKQEKR

SEQ ID NO: 1211 - DNA, 207 bp, Neisseria gonorrhoeae
gtgtttcagacggcattttgtccgatggggcgcaaacggaatccgtttgtcggcaaaacctgtttcggcgtatcgaaaccgtgttgcccctgccgattcgatattaggacattgaaaatgccgtctgaacctgcgatacgggcttcagacggcgttttgtccgatattcgggcaatcaggcggtcagtacggttttcaagattttgt

SEQ ID NO: 1212 - protein, 69 aa, Neisseria gonorrhoeae
VFQTAFCPMGRKRNPFVGKTCFGVSKPCCPCRFDIRTLKMPSEPAIRASDGVLSDIRAIRRSVRFSRFC

SEQ ID NO: 1213 - DNA, 540 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcc

SEQ ID NO: 1214 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 1215 - DNA, 210 bp, Neisseria gonorrhoeae
atgcctgcaatccgcgtaaaagagaatgaaccatttgaagtcgctatgcgccgtttcaaacgcgccgtagaaaaaaccggcctgctgaccgagctgcgcgcccgcgaagcctacgaaaaaccgactaccgaacgcaaacgcaaaaaagcggcagccgtaaaacgcctgcaaaaacgcctgcgcagccaacagctgccgcccaaaatgtac

SEQ ID NO: 1216 - protein, 70 aa, Neisseria gonorrhoeae
MPAIRVKENEPFEVAMRRFKRAVEKTGLLTELRAREAYEKPTTERKRKKAAAVKRLQKRLRSQQLPPKMY

SEQ ID NO: 1217 - DNA, 246 bp, Neisseria gonorrhoeae
ttggctgcgcaggcgtttttgcaggcgttttacggctgccgcttttttgcgtttgcgttcggtagtcggtttttcgtaggcttcgcgggcgcgcagctcggtcagcaggccggttttttctacggcgcgtttgaaacggcgcatagcgacttcaaatggttcattctcttttacgcggattgcaggcattttatttcctttaataaattcggttgtttcatctgcccatcatatcggtggaaaggg

SEQ ID NO: 1218 - protein, 82 aa, Neisseria gonorrhoeae
LAAQAFLQAFYGCRFFAFAFGSRFFVGFAGAQLGQQAGFFYGAFETAHSDFKWFILFYADCRHFISFNKFGCFICPSYRWKG

SEQ ID NO: 1219 - DNA, 1848 bp, Neisseria gonorrhoeae
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctgatgtactatggcgtgcgcagtcagtggacgctgtttgctcaggaatatgccaaactcaaacctgaagggggcgcccaagaagtcgaatgctacgccgattcgagccgcaacgactatacgcgtgccgccgaactagttaaaaatacgggcaaactgccttcgggctgcaccaaactgttggaacaggcaaccgcatccggcttgttgggcggcaacgatgcctggaggggcgtgcgcggactgctggccggccgcccaacgacggacgggcgcaaccttgccgccgcattgggcagcccgtttgatggcggtacacaaggttcgcgcgaatatgccctgttgaacgtcatcggcaaagaagcacgcaaatcgccgaatgccgccgccctgctgtccgaaatggaaagcggtttaagccccgaacaacgcagtttcgcgtggggcgtattggggcattatcagtcgcaaagcctcaatgtgcctgccgccttggactattacggcaaggttgccgaccgccgccaactgaccgacgaccaaatcgagtggtacgcccgcgccgccttgcgcgcccgacgttgggacgagctggcctccgtgatctcgcatatgcccgaaaaactgcaaaaaagcccgacctggctctactggctggcacgcagccgcgccgcaacgggcaacacgcaagaagcggaaaaactttacaaacaggcggcagcgacgggcaggaatttttatgccgtactggcaggggaagaattggggcgcaaaatcgatacgcgcaacaatgttcccgatgccggcaaaaacagcgtcctccgtatggcggaagacggcgcgattaagcgcgcgctggtgttgttccgaaacagccgaaccgccggcgatgcgaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttacggcctgattcgtcaggaaagccgcttcgttataggcgcgcaatcccgcgtaggcgcgcaggggctgatgcaggttatgcccgccaccgcgcgcgaaatcgccggcaaaatcggtatggatgccgcccagctctacaccgccgacggcaatatccgtatggggacgtggtatatggcggacaccaaacgccgcctgcaaaacaacgaaatcctcgccaccgcaggctataacgccggccccggcagagcgcgccgatggcaggcggacacacccctcgaaggcgcggtatatgccgaaaccatcccgttttccgaaacgcgcgactatgtcaaaaaagtgatgaccaatgccgcctactacgcctccctcttcggcgcgccgcacatcccgctcaaacagcgtatgggcaccgttcccgcacgc

SEQ ID NO: 1220 - protein, 616 aa, Neisseria gonorrhoeae
MYLPSMKHSLPLLAALVLAACSSTNTLPAGKTPADNIETADLSASVPTRPAEPEGKTLADYGGYPSALDAVKQNNDAAAAAYLENAGDSAMAENVRKEWLMYYGVRSQWTLFAQEYAKLKPEGGAQEVECYADSSRNDYTRAAELVKNTGKLPSGCTKLLEQATASGLLGGNDAWRGVRGLLAGRPTTDGRNLAAALGSPFDGGTQGSREYALLNVIGKEARKSPNAAALLSEMESGLSPEQRSFAWGVLGHYQSQSLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVLRMAEDGAIKRALVLFRNSRTAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADGNIRMGTWYMADTKRRLQNNEILATAGYNAGPGRARRWQADTPLEGAVYAETIPFSETRDYVKKVMTNAAYYASLFGAPHIPLKQRMGTVPAR

SEQ ID NO: 1221 - DNA, 183 bp, Neisseria gonorrhoeae
ttggaaaagacaaaatgccgtctgaacaggcgtttgcccgaattatatgccgaaactgcaccgcctttggaatgtttccgacataatttatatttttcaatcatttgccgtttgggtgcgaaccgctgcctttgcccgtttcagacggcattgtccgaaatggttgcccgcttcctgctttat

SEQ ID NO: 1222 - protein, 61 aa, Neisseria gonorrhoeae
LEKTKCRLNRRLPELYAETAPPLECFRHNLYFSIICRLGANRCLCPFQTALSEMVARFLLY

SEQ ID NO: 1223 - DNA, 183 bp, Neisseria gonorrhoeae
atgttaaccgccgaaagggagaaggcgcaggagaacagcatacagaacaatacaaacatttttttcatggtttttcctttaagggttgcaaacaacaaaccgcatcttgcgacgatatggcggattaacaaaaaccggtacggcgttgccccgccccggctcaaagggaacgattccctaagg

SEQ ID NO: 1224 - protein, 61 aa, Neisseria gonorrhoeae
MLTAEREKAQENSIQNNTNIFFMVFPLRVANNKPHLATIWRINKNRYGVAPPRLKGNDSLR

SEQ ID NO: 1225 - DNA, 159 bp, Neisseria gonorrhoeae
atgccgtccgaacctctcttcagacggcatttgttttcattgacacattcccgcagacatatagccgttccctattatagtggattaaatttaaaccggtacggcgttgcctcgccttgccgtactatttgtactgtctgcggcttcgccgccttgtcc

SEQ ID NO: 1226 - protein, 53 aa, Neisseria gonorrhoeae
MPSEPLFRRHLFSLTHSRRHIAVPYYSGLNLNRYGVASPCRTICTVCGFAALS

SEQ ID NO: 1227 - DNA, 555 bp, Neisseria gonorrhoeae
ttgccgcatacgaaaaaatgccgtctgaaaccaaatcggttttcagacggcatttcgtttggggatttattctgctgcggaagattcggctgcttcggcttcaacagacggcgtttcggcggcagcttgggcggactgctgttgcaaagcctgctgcacgaaaggatggttttgcgcaatcgcctgttcttcgggggtaacttcgcctttgaaacggttgttcaaatcgaaacgtttgccgccgcgcgccaaggctttcagatagcgcggacggcggcagtggttggcgaggacgcgtgcaatcagtgcggaatcgtattgcggcaaagcggcaatcaaatcctgatcgatgccgagcgccaacggtttgaagcgtttgaatacatcgtatttgccgtagatgtggtcggcgatcatttcggtctgtttctttttgctcatagtttggacggcggatttcagtgccgcgcccaaagcggtttcttgtgtcatttcggttgtattcctctaagaatcgtgcgttcagacggcacggcaatggtcggtattttagta

SEQ ID NO: 1228 - protein, 185 aa, Neisseria gonorrhoeae
LPHTKKCRLKPNRFSDGISFGDLFCCGRFGCFGFNRRRFGGSLGGLLLQSLLHERMVLRNRLFFGGNFAFETVVQIETFAAARQGFQIARTAAVVGEDACNQCGIVLRQSGNQILIDAERQRFEAFEYIVFAVDVVGDHFGLFLFAHSLDGGFQCRAQSGFLCHFGCIPLRIVRSDGTAMVGILV

SEQ ID NO: 1229 - DNA, 537 bp, Neisseria gonorrhoeae; identical to SEQ ID NO: 121

SEQ ID NO: 1230 - protein, 179 aa, Neisseria gonorrhoeae; identical to SEQ ID NO: 122

SEQ ID NO: 1231 - DNA, 93 bp, Neisseria gonorrhoeae
gtgatgagccgacatcgaggtgccaaactccgccgtcgatatgaactcttgggcggaatcaagcctgttatccccggagtaccttttatccgt

SEQ ID NO: 1232 - protein, 31 aa, Neisseria gonorrhoeae
VMSRHRGAKLRRRYELLGGIKPVIPGVPFIR

SEQ ID NO: 1233 - DNA, 105 bp, Neisseria gonorrhoeae
ttgacacagcttgcgggcataacagctaaagcgttccgacaatttcagctttatcttccgcgcccgttgtgtccgacatcgggctttgttgtatgggaaagacaa

SEQ ID NO: 1234 - protein, 35 aa, Neisseria gonorrhoeae
LTQLAGITAKAFRQFQLYLPRPLCPTSGFVVWERQ

SEQ ID NO: 1235 - DNA, 177 bp, Neisseria gonorrhoeae
ttgtcggaacgctttagctgttatgcccgcaagctgtgtcaaatcggcaggttaattttcgtaggatattatcgggaaagcgtttttttgtcaataaagcaggaagcgggcaaccatttcggacaatgccgtctgaaacgggcaaaggcagcggttcgcacccaaacggcaaatgat

SEQ ID NO: 1236 - protein, 59 aa, Neisseria gonorrhoeae
LSERFSCYARKLCQIGRLIFVGYYRESVFLSIKQEAGNHFGQCRLKRAKAAVRTQTAND

SEQ ID NO: 1237 - DNA, 102 bp, Neisseria gonorrhoeae
ttggaaaccttgtccaaaataatcattgtctttcccatacaacaaagcccgatgtcggacacaacgggcgcggaagataaagctgaaattgtcggaacgctt

SEQ ID NO: 1238 - protein, 34 aa, Neisseria gonorrhoeae
LETLSKIIIVFPIQQSPMSDTTGAEDKAEIVGTL

SEQ ID NO: 1239 - DNA, 624 bp, Neisseria gonorrhoeae
atgggctattccggcgcgggcaaatccactttgttgcgcctgatcaacctgttggaacgccccgacacgggcaaagtcaacgtctgcggacaagaactgaccgcgctcgatgccgccgcattgcgtcaggcgcggcagaatatcggcatggtgtttcagcagttcaaccttttaagcaaccgcaccgtcgccggcaacgttgcctttccactggaaatcgccggatggccgtctgaaaaaatcaaagcgcgcgttgccgagtgcctcgaaatcgtcggcttgaccgaacgcgccggccactaccccgcccagctttcaggcgggcagaaacaacgcgtcggaatcgcccgcgcgctcgcgcccaagccgcaagtcatcctcgccgacgaacccacttccgccctcgaccccgccaccacgcgcagtgtcttggaatgtttggaagacatcaacaaacgcttcaacgttaccatcgtcatcgtaacccacgaaatgagcgtcatcagacgattgtgcgaccgcgccgccctgttggataaagggaaagtggtggaaatcgtcgaagtacgcggcaaccaaatccacgctcaatccgaaatcgggcgcgaactgattcgggaggac

SEQ ID NO: 1240 - protein, 208 aa, Neisseria gonorrhoeae
MGYSGAGKSTLLRLINLLERPDTGKVNVCGQELTALDAAALRQARQNIGMVFQQFNLLSNRTVAGNVAFPLEIAGWPSEKIKARVAECLEIVGLTERAGHYPAQLSGGQKQRVGIARALAPKPQVILADEPTSALDPATTRSVLECLEDINKRFNVTIVIVTHEMSVIRRLCDRAALLDKGKVVEIVEVRGNQIHAQSEIGRELIRED

SEQ ID NO: 1241 - DNA, 684 bp, Neisseria gonorrhoeae
atggcagacttaacattcgaacaagccgtttccaccatcgtcggcatgaaagacgaaatcgtccgcgccttgggcgaaactttcgtgatggtcggcttgtccaccacattcgccgtcatcttcggcacgctcttgggcgtgttgctcttcgtaacttccagccgccaactgcattacaacaagccggtgaacttcctgctcgacaacctcgtcaacctcatgcgcgccttccccttcgtcatcctgatgattgcgatgatacccgccacacgcgccatcgtcggcagcaccatcggcccggttgccgcctcgctggtgttgagcgtgtcgggattgttttattttgcccgactggtggaacaaaacctgcgcgaagtcccaaaaggtgtgattgaagccgccgccgcgatgggtgcgccgccgattgccatcgtcctcaaagtcctcttgaacgaagcgcgcgcgggcatggtttccagcattaccgtgcttgccatcgggcttttgtcatacagcgcggcggcaggcatgataggcggcggcggcttgggcgacctcgccatccgctacggctactaccgctaccaaaccgaagtcatcgtcttcatcgtcgccctcctcgtgctgctggtcatcctgattcaaagcaccggcaacgcgttggcgcggaaactcgacaaacgt

SEQ ID NO: 1242 - protein, 228 aa, Neisseria gonorrhoeae
MADLTFEQAVSTIVGMKDEIVRALGETFVMVGLSTTFAVIFGTLLGVLLFVTSSRQLHYNKPVNFLLDNLVNLMRAFPFVILMIAMIPATRAIVGSTIGPVAASLVLSVSGLFYFARLVEQNLREVPKGVIEAAAAMGAPPIAIVLKVLLNEARAGMVSSITVLAIGLLSYSAAAGMIGGGGLGDLAIRYGYYRYQTEVIVFIVALLVLLVILIQSTGNALARKLDKR

SEQ ID NO: 1243 - DNA, 153 bp, Neisseria gonorrhoeae
atgccgtctgaacgccaaaaaccccgccgctatccgaaaaatgctataaaatccccctgttcgcggcaaatgccgtctgaacgccgaatccggacggcaggactccctgcctgtcatttttgtttgaaaccgccacaacatcaggagaaaata

SEQ ID NO: 1244 - protein, 51 aa, Neisseria gonorrhoeae
MPSERQKPRRYPKNAIKSPCSRQMPSERRIRTAGLPACHFCLKPPQHQEKI

SEQ ID NO: 1245 - DNA, 123 bp, Neisseria gonorrhoeae
ttgaagaaggttttcatattttctcctgatgttgtggcggtttcaaacaaaaatgacaggcagggagtcctgccgtccggattcggcgttcagacggcatttgccgcgaacagggggatttta

SEQ ID NO: 1246 - protein, 41 aa, Neisseria gonorrhoeae
LKKVFIFSPDVVAVSNKNDRQGVLPSGFGVQTAFAANRGIL

SEQ ID NO: 1247 - DNA, 864 bp, Neisseria gonorrhoeae
atgaaaaccttcttcaaaaccctttccgccgccgcactcgcgctcatcctcgcagcctgcggcggtcaaaaagacagcgcgcccgcagcctctgccgccgccccttctgccgataacggcgcggcgaaaaaagaaatcgtcttcggcacgaccgtcggcgacttcggcgatatggtcaaagaacaaatccaagccgagctggagaaaaaaggctacaccgtcaaattggtcgaatttaccgactatgtgcgcccgaatctggcattggcggagggcgagttggacatcaacgtcttccaacacaaaccctatcttgacgatttcaaaaaagaacacaacctggacatcaccgaagccttccaagtgccgaccgcgcctttgggactgtatccgggcaaactgaaatcgctggaagaagtcaaagacggcagcaccgtatccgcgcccaacgacccgtccaacttcgcacgcgccttggtgatgctgaacgaactgggttggatcaaactcaaagacggcatcaatccgctgaccgcatccaaagccgacatcgcggaaaacctgaaaaacatcaaaatcgtcgagcttgaagccgcacaactgccgcgcagccgcgccgacgtggattttgccgtcgtcaacggcaactacgccataagcagcggcatgaagctgaccgaagccctgttccaagagccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaataccctgccgcatggaatgaaggcgcagccaaa

SEQ ID NO: 1248 - protein, 288 aa, Neisseria gonorrhoeae
MKTFFKTLSAAALALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 1249 - DNA, 135 bp, Neisseria gonorrhoeae
atgccgattatcaaacgccgtaccatcatccgcctttcccataaaaccgcctgcaacggcaaaccggctattatagtgaaaaaacagaaatccgataaacacggatacaaattgtcggcaacacccaatatccga

SEQ ID NO: 1250 - protein, 45 aa, Neisseria gonorrhoeae
MPIIKRRTIIRLSHKTACNGKPAIIVKKQKSDKHGYKLSATPNIR

SEQ ID NO: 1251 - DNA, 789 bp, Neisseria gonorrhoeae
ttgtccgcaccgttggcgagcagcgaatccaagccgcgccccaatccgccttttacttttgccataccgccctcccgtgcctattcagataggatgttaaatcgggtattttatcggatattgggtgttgccgacaatttgtatccgtgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggcgcggagatggcgcgcgcttcggaaacggattatacgaaagacgaagtatatgccttggctgatttcgtccatccgatcggcaatatcggggcgtgcattgccagcggtacgtttaaaacggacgggatgctggtcgcaccctgttcgatgcggacgcttgcctctgtcgcgcacggcttcggcgacaacctcttgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaagccgcagacggcggacgacatagtggcgcacagtatcgcacacacgctgtcgctgttcggaatcgatacgccggatttggcggaatggcagggaatggcggat

SEQ ID NO: 1252 - protein, 263 aa, Neisseria gonorrhoeae
LSAPLASSESKPRPNPPFTFAIPPSRAYSDRMLNRVFYRILGVADNLYPCLSDFCFFTIIAGLPLQAVLWERRMMVRRLIIGISGASGFQYGVKALELLRAQDVETHLVVSKGAEMARASETDYTKDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSIAHTLSLFGIDTPDLAEWQGMAD

SEQ ID NO: 1253 - DNA, 858 bp, Neisseria gonorrhoeae
atggcaaaagtaaaaggcggattggggcgcggcttggattcgctgctcgccaacggtgcggacaacagcagcggcgaccggttgactgcggttgcggttaaagatatccggcccggccgctatcaggcgcgcgtccaaatcgatgacgaagccttgcaggaactggcagattcgattaaggcgcaaggcgtgatacagcccgtcatcgtgcgcgaacacggactgtcccgatacgaactgattgcaggcgaacgccgttggcgcgccgctcagattgccggcctgtccgaaatccccgccgttatcaaaaccatcagcgacgaaaccgcattggcaatgggtttgatcgaaaacctccagcgcgaaaacctcaaccccatcgaagaagcacaaggcttgaaacgccttgccgacgagttcgggctgacccacgaaaccatcgcccaagccgtcggcaaaagccgaagcgcgatttccaacagcctgcgccttttaagcctgcccgaatccgtgcaggaaatgctttaccaacgccgcctcgaaatggggcacgcccgcgcactgctgaccctgcccgtcgtcgaacagctcgaattggcgcaaaaggccgtcaaaaacggctggtcggtgcgcgaagtcgaacgccgcagccaggccgcccttcaaaacaaacgtcccgagccaaaaaaaactgccgccgccgacatcggccgcctgaatgatttgctgactgaaaaattgggtgtcaacgccgaaatcaagaccgccaaccataaaaaaggcaaaatcatcctgcatttcgacacgcccgaaaccttcgaccatatcttgaagcagttgggcatagattaccggcct

SEQ ID NO: 1254 - protein, 286 aa, Neisseria gonorrhoeae
MAKVKGGLGRGLDSLLANGADNSSGDRLTAVAVKDIRPGRYQARVQIDDEALQELADSIKAQGVIQPVIVREHGLSRYELIAGERRWRAAQIAGLSEIPAVIKTISDETALAMGLIENLQRENLNPIEEAQGLKRLADEFGLTHETIAQAVGKSRSAISNSLRLLSLPESVQEMLYQRRLEMGHARALLTLPVVEQLELAQKAVKNGWSVREVERRSQAALQNKRPEPKKTAAADIGRLNDLLTEKLGVNAEIKTANHKKGKIILHFDTPETFDHILKQLGIDYRP

SEQ ID NO: 1255 - DNA, 126 bp, Neisseria gonorrhoeae
gtgggaaatataattctattgacattttttctgcttcgcgtaagaatcgttttcctgttttcatttttaattttcgaggaaattatgaacacacgcatcaactttacgcaactgtgggtaagcgcg

SEQ ID NO: 1256 - protein, 42 aa, Neisseria gonorrhoeae
VGNIILLTFFLLRVRIVFLFSFLIFEEIMNTRINFTQLWVSA

SEQ ID NO: 1257 - DNA, 144 bp, Neisseria gonorrhoeae
gtgggtaagcgcgtgagccaatgctatgttaccagtgtaatcagcacaatcggcgttaccacttccgatgcaatttgttcgggaggcggaacgaacaaagccaaaagtcaatgcaatgctttgcttaaagcggcaggccgctgc

SEQ ID NO: 1258 - protein, 48 aa, Neisseria gonorrhoeae
VGKRVSQCYVTSVISTIGVTTSDAICSGGGTNKAKSQCNALLKAAGRC

SEQ ID NO: 1259 - DNA, 420 bp, Neisseria gonorrhoeae
atgttcttacgtgatttgtttgctttacgtggaaataataaaaaatcaacgcgaaattgtagtagtttatcggtcggattgtcggcagtttggggagtttgctcaataaataaaaggtcgtctgaaaatattttcagacgaccttttccgaataaaggattagcagcggcctgccgctttaagcaaagcattgcattgacttttggctttgttcgttccgcctcccgaacaaattgcatcggaagtggtaacgccgattgtgctgattacactggtaacatagcattggctcacgcgcttacccacagttgcgtaaagttgatgcgtgtgttcataatttcctcgaaaattaaaaatgaaaacaggaaaacgattcttacgcgaagcagaaaaaatgtcaatagaattatatttcccact

SEQ ID NO: 1260 - protein, 140 aa, Neisseria gonorrhoeae
MFLRDLFALRGNNKKSTRNCSSLSVGLSAVWGVCSINKRSSENIFRRPFPNKGLAAACRFKQSIALTFGFVRSASRTNCIGSGNADCADYTGNIALAHALTHSCVKLMRVFIISSKIKNENRKTILTRSRKNVNRIIFPT

SEQ ID NO: 1261 - DNA, 150 bp, Neisseria gonorrhoeae
ttgcctcgccttgccgtactatttgtactgtctgcggcttcgccgccttgtcctgatttaaatttaatccactatacattacctgtcataacagttccatttttgttaaaactagtctatgatagcggtacaaatgttgtttacaatatt

SEQ ID NO: 1262 - protein, 50 aa, Neisseria gonorrhoeae
LPRLAVLFVLSAASPPCPDLNLIHYTLPVITVPFLLKLVYDSGTNVVYNI

SEQ ID NO: 1263 - DNA, 180 bp, Neisseria gonorrhoeae
aaatgaatatcccaaagtttcaagccgttcctccgcaaacccgaccggacaccgtacagatgccgtcccgccatccccgacattttttccgggcaaagcaaaaacccccggatatccgggggttttctgaaagggtgtttggcagtgacctactttcgcatggaagaaccacactatcat

SEQ ID NO: 1264 - protein, 58 aa, Neisseria gonorrhoeae
ISQSFKPFLRKPDRTPYRCRPAIPDIFSGQSKNPRISGGFLKGCLAVTYFRMEEPHYH

SEQ ID NO: 1265 - DNA, 1983 bp, Neisseria gonorrhoeae
atggctaaaaacaaccaatacagcgaatccagcatcaccgtcctcaaaggcttggagccggtcaaagaacgtcccggcatgtacacccgcaccgacagcccgacacatatctgccaagaagtcatcgacaacgcggcggacgaggcgttgggcggtttcgccactgaaatcgacgtgcaaattcatgaagacggttcgctttccgtgcgcgacaacgggcgcggcattcccgtcggcctgcaccctgaagaaggcgtacccgtagtcgaactcgtgtttacccgcctgcacgcgggcggcaagttcaacaaaaaagacggcggcagtgcgtatgccttttcaggcggcctgcacggtgtgggcgtatccgttaccaatgcgctttccacccgacttgaagtcagtgtcaaacgagacggcaaagtccaccgcatcgtgtttgccggcggcgatgtggtcgaaccgttggcacaagtgggcaaatgcgccgtcaaagacagcggcaccgaagtgcgcgtgtggccggacggcaaatattttgaaagcccgaattacagcattcccgaactcgagcgtctattgcgcgccaaagccgtgctgctgccgggcgtgcgcgtttccctgacccgtccggtcaaaggcgaagacgaagcgcacacccaaacctggcattaccccgacggtctgaaaagctatctgaccgacctgattgccgacgcacaggaagccgtgccgctgttctcctgcgaaaactacatttcagacggccacaacggcgatttcagcattggcgaaggtgccgcgtttgctttgacttggctggaagaaggctcgtgcgccaacgaaagctacgtcaaccttatcccgacctcgctgggcggaacgcacgaagcaggcttgaaacaagccgtgttcaacgccgtcaacaatttcatcaacctgcacaacctcttaccgcgcggcgttaaagtgcaaagcgacgacgtgttcggaaaaaccgccttcgtcctctccgcccgcgtcctcgacccgcaattccaaggtcagaccaaagacaagctgaccaaccgcgacgcgctgaaacttgtcgccgccgtatcgggcgatcctttggaattgtggctgaaccaaaacgtggacttcggcaaaaaaatcgccgaactcgccatccgtcaggcacaggcacggatacgttcggttaaaaaaatcgaaaagaaaaaaggcagcggcgtcgccatcctgcccggtaagctgaccgactgtgaaagcgaagacatccgcgaaaacgaactcttcctcgtcgaaggcgattccgccggcggctccgccaaactcgcccgcgacaaagccacacaagccatcctgcccctgcgcggcaaagtgctcaatagctttgaagtccaccccgaccagcttttcggcaacgccgaaatccacgacatttccgtcgccgtcggtgtcgatccgcacgccatcaacgaccatcccgacttaagcggcctgcgctacggcaaaatagccatcttgtccgatgccgacgtggacggttcgcatattcaggttttgctgttgaccctgttctaccgccacttccccaaactggtcgccgacggacacatctacgtcgcccagccgccgctgttccgcgtcgatgtcaacgcacaaggcaaaagcaaacccgcccgcaaattctacgccctcgaccaaaacgaacttgacggcattttagagcggctgcaaaaagaaggcgttaaagaaaccgcctattccatcagccgtttcaaaggcttgggcgagatgaaccccgaccagctcaaagacaccaccatgcaccccgacacccgccgcctgttgcaggtgcaaatccccgaaggcgcggatgacgagacgcgcgacatcttcgtcaaactgatgggcaaaggcgaagccgccgcccgccgcgcttggatggaacgcgaaggcgatacggcgcaactcgatatt

SEQ ID NO: 1266 - protein, 661 aa, Neisseria gonorrhoeae
MAKNNQYSESSITVLKGLEPVKERPGMYTRTDSPTHICQEVIDNAADEALGGFATEIDVQIHEDGSLSVRDNGRGIPVGLHPEEGVPVVELVFTRLHAGGKFNKKDGGSAYAFSGGLHGVGVSVTNALSTRLEVSVKRDGKVHRIVFAGGDVVEPLAQVGKCAVKDSGTEVRVWPDGKYFESPNYSIPELERLLRAKAVLLPGVRVSLTRPVKGEDEAHTQTWHYPDGLKSYLTDLIADAQEAVPLFSCENYISDGHNGDFSIGEGAAFALTWLEEGSCANESYVNLIPTSLGGTHEAGLKQAVFNAVNNFINLHNLLPRGVKVQSDDVFGKTAFVLSARVLDPQFQGQTKDKLTNRDALKLVAAVSGDPLELWLNQNVDFGKKIAELAIRQAQARIRSVKKIEKKKGSGVAILPGKLTDCESEDIRENELFLVEGDSAGGSAKLARDKATQAILPLRGKVLNSFEVHPDQLFGNAEIHDISVAVGVDPHAINDHPDLSGLRYGKIAILSDADVDGSHIQVLLLTLFYRHFPKLVADGHIYVAQPPLFRVDVNAQGKSKPARKFYALDQNELDGILERLQKEGVKETAYSISRFKGLGEMNPDQLKDTTMHPDTRRLLQVQIPEGADDETRDIFVKLMGKGEAAARRAWMEREGDTAQLDI

SEQ ID NO: 1267 - DNA, 243 bp, Neisseria gonorrhoeae
atgctttgcttaaagcggcaggccgctgctaatcctttattcggaaaaggtcgtctgaaaatattttcagacgaccttttatttattgagcaaactccccaaactgccgacaatccgaccgataaactactacaatttcgcgttgattttttattatttccacgtaaagcaaacaaatcacgtaagaacattaaaagtgtaaagaaattgcggacaaactccttaatatcctgtaatcatatg

SEQ ID NO: 1268 - protein, 81 aa, Neisseria gonorrhoeae
MLCLKRQAAANPLFGKGRLKIFSDDLLFIEQTPQTADNPTDKLLQFRVDFLLFPRKANKSRKNIKSVKKLRTNSLISCNHM

SEQ ID NO: 1269 - DNA, 351 bp, Neisseria gonorrhoeae
atgaagcagattatcatcctacaatccgccgtattgtccatatgcgccgcagttgcctttgccgtatggggttttgccggattcctttcggcggtcgggggcggtttgtcctacctgcttcccacgtttgttgcagttttacttctaaaacttttcaggggaaaccccttcctgcaaagcaggatgttcgtcttcggagagattttaaaagtaatgctgtcgctgttgtccatgcttgccgtatttgcaatatggcatcaatcgctggtgttcgtcccgtttttgatggggctgctcggtgtcagccatctggtttttttagtattgttgagagtgaaagattatggcagg

SEQ ID NO: 1270 - protein, 117 aa, Neisseria gonorrhoeae
MKQIIILQSAVLSICAAVAFAVWGFAGFLSAVGGGLSYLLPTFVAVLLLKLFRGNPFLQSRMFVFGEILKVMLSLLSMLAVFAIWHQSLVFVPFLMGLLGVSHLVFLVLLRVKDYGR

SEQ ID NO: 1271 - DNA, 864 bp, Neisseria gonorrhoeae
atggcaggtgaaaccattaccgctgccgactacatcaagcaccacttgcagagcttgaccagtttgtcggatgttactcagggtcagggactgaaaaacattgctgatttttcgtttattaaccttgatgccgttttttttgccgtcctgttgggcgtaatcggcagcttcctgttgtggcgcggtgcaaaaaaagcaacggcaggcgttcccggacgtttccaggccgccgtggaaatcttgttcgagtttgtggacgatatgtgtaagagcatcattcacagcgaaaagtctaaaaaagccgtcgcgccgttgggtctgacgctgtttgtttggattttcctgatgaacgcgatggatatgctgccggtcgatttgctgccgatggtatggcagggcattaccggcaaccatcacgccctgctgcgcatcgtaccgactgccgatttgaacaccgctttggcactcgctgtcggcgtgttgctgatttgtatctattacaacatcaaaatcaaaggattgggcggctggtttcacgagttgttcagtgcgccgttcggtgcaaaactcgcacctgcgaactttctgttgaacttggtcgagtttctttctaaaaccgtatcccacggtatgcggttgttcggcaatatgtatgcgggcgagctggtattcctgctgatagccttgcttggccgttcttgggcggcttccggcagcgttgaagtcatggatccgattctgtttgtattccacattattgccggtttggcatgggcgattttccatattttggtgattaccctgcaggcatttattttcatggcgttggcgttcgtctatatcgggcaggcgcacgatgcccac

SEQ ID NO: 1272 - protein, 288 aa, Neisseria gonorrhoeae
MAGETITAADYIKHHLQSLTSLSDVTQGQGLKNIADFSFINLDAVFFAVLLGVIGSFLLWRGAKKATAGVPGRFQAAVEILFEFVDDMCKSIIHSEKSKKAVAPLGLTLFVWIFLMNAMDMLPVDLLPMVWQGITGNHHALLRIVPTADLNTALALAVGVLLICIYYNIKIKGLGGWFHELFSAPFGAKLAPANFLLNLVEFLSKTVSHGMRLFGNMYAGELVFLLIALLGRSWAASGSVEVMDPILFVFHIIAGLAWAIFHILVITLQAFIFMALAFVYIGQAHDAH

SEQ ID NO: 1273 - DNA, 894 bp, Neisseria gonorrhoeae
gtgcgcctgcccgatatagacgaacgccaacgccatgaaaataaatgcctgcagggtaatcaccaaaatatggaaaatcgcccatgccaaaccggcaataatgtggaatacaaacagaatcggatccatgacttcaacgctgccggaagccgcccaagaacggccaagcaaggctatcagcaggaataccagctcgcccgcatacatattgccgaacaaccgcataccgtgggatacggttttagaaagaaactcgaccaagttcaacagaaagttcgcaggtgcgagttttgcaccgaacggcgcactgaacaactcgtgaaaccagccgcccaatcctttgattttgatgttgtaatagatacaaatcagcaacacgccgacagcgagtgccaaagcggtgttcaaatcggcagtcggtacgatgcgcagcagggcgtgatggttgccggtaatgccctgccataccatcggcagcaaatcgaccggcagcatatccatcgcgttcatcaggaaaatccaaacaaacagcgtcagacccaacggcgcgacggcttttttagacttttcgctgtgaatgatgctcttacacatatcgtccacaaactcgaacaagatttccacggcggcctggaaacgtccgggaacgcctgccgttgctttttttgcaccgcgccacaacaggaagctgccgattacgcccaacaggacggcaaaaaaaacggcatcaaggttaataaacgaaaaatcagcaatgtttttcagtccctgaccctgagtaacatccgacaaactggtcaagctctgcaagtggtgcttgatgtagtcggcagcggtaatggtttcacctgccataatctttcactctcaacaatactaaaaaaaccagatggc

SEQ ID NO: 1274 - protein, 298 aa, Neisseria gonorrhoeae
VRLPDIDERQRHENKCLQGNHQNMENRPCQTGNNVEYKQNRIHDFNAAGSRPRTAKQGYQQEYQLARIHIAEQPHTVGYGFRKKLDQVQQKVRRCEFCTERRTEQLVKPAAQSFDFDVVIDTNQQHADSECQSGVQIGSRYDAQQGVMVAGNALPYHRQQIDRQHIHRVHQENPNKQRQTQRRDGFFRLFAVNDALTHIVHKLEQDFHGGLETSGNACRCFFCTAPQQEAADYAQQDGKKNGIKVNKRKISNVFQSLTLSNIRQTGQALQVVLDVVGSGNGFTCHNLSLSTILKKPDG

SEQ ID NO: 1275 - DNA, 234 bp, Neisseria gonorrhoeae
atgggtttgattgctatcgcatgtggtttgatcgttgcattgggtgcattgggtgcatctatcggtatcgcaatggtcggttctaaatatttggagtcttctgctcgccaacctgaactgattggtccgctgcaaaccaaactgttcctgattgccggtctgattgatgccgcattcttgatcggtgtcgccattgcactactgttcgccttcgtcaacccgtttgcaggtgca

SEQ ID NO: 1276 - protein, 78 aa, Neisseria gonorrhoeae
MGLIAIACGLIVALGALGASIGIAMVGSKYLESSARQPELIGPLQTKLFLIAGLIDAAFLIGVAIALLFAFVNPFAGA

SEQ ID NO: 1277 - DNA, 420 bp, Neisseria gonorrhoeae
ttgatattcacgttacttaaccttcgtattggggttaatcaaacaggctgcacctgtacgaacggacgaatccgtcctgattatgcacctgcaaacgggttgacgaaggcgaacagtagtgcaatggcgacaccgatcaagaatgcggcatcaatcagaccggcaatcaggaacagtttggtttgcagcggaccaatcagttcaggttggcgagcagaagactccaaatatttagaaccgaccattgcgataccgatagatgcacccaatgcacccaatgcaacgatcaaaccacatgcgatagcaatcaaacccattttaaactccttaaagaaacaaaggttaaactacaaaaacaaactacttgggaaaatcagtgggcatcgtgcgcctgcccgatatagacgaacgccaacgcca

SEQ ID NO: 1278 - protein, 140 aa, Neisseria gonorrhoeae
LIFTLLNLRIGVNQTGCTCTNGRIRPDYAPANGLTKANSSAMATPIKNAASIRPAIRNSLVCSGPISSGWRAEDSKYLEPTIAIPIDAPNAPNATIKPHAIAIKPILNSLKKQRLNYKNKLLGKISGHRAPARYRRTPTP

SEQ ID NO: 1279 - DNA, 468 bp, Neisseria gonorrhoeae
gtgaatatcaatgcaacattattcgctcaaatcatcgtctttttcggtttggtatggtttaccatgaaatttgtgtggccgccgattgcaaaagctttggatgagcgtgccgcaaaaatcgccgagggcttggctgccgccgagcgtggtaaaagcgatttcgagcaggctgaaaaaaaggttgcagaacttttggcagaagggcgtaatcaggtttccgaaatggttgccaacgccgaaaaacgtgccgccaaaattgtcgaagaagccaaagaacaggcttcttccgaggcggcgcgcattgcagctcaggcaaaggccgatgtggagcaggaattgttccgcgcacgcgaatccctgcgcgatcaggttgccgtgttggctgtcaaaggtgccgaatctattttgcgcagcgaagtcgatgcttccaaacacgcaaaactgctcgataccctgaaacaggagttg

SEQ ID NO: 1280 - protein, 156 aa, Neisseria gonorrhoeae
VNINATLFAQIIVFFGLVWFTMKFVWPPIAKALDERAAKIAEGLAAAERGKSDFEQAEKKVAELLAEGRNQVSEMVANAEKRAAKIVEEAKEQASSEAARIAAQAKADVEQELFRARESLRDQVAVLAVKGAESILRSEVDASKHAKLLDTLKQEL

SEQ ID NO: 1281 - DNA, 531 bp, Neisseria gonorrhoeae
atggcagagttcgcaacgatcgccagaccttatgcaaaggcattgttcggtctggctcaggaaaaaaaccaaattgagtcttggttgggcggactggaaaaacttgcggcggttgttcaggaagggaaggtggcttcattgattgaccgtcctgaaacgaatgcttcagaaaaagcagatatcctcatcgatttggtcggtttgaaagacaaggagttaaaaaactttgttatcgtcttggccgggcagaaacgtttgtcgatattgccggaagtgtatgctcaatatcaagacttgaccttatcattcaaccatatcaaatctgccgtcatttacagtgcctatccgttgaccgacaaacaggtcggcgagttggcgcaaatgctgaataagcgtttcgacagcgagctgaaaatctctgtcgaaatcgaaccggagctgattggcggcataaaagttgaagtgggtgatcaggttttggatttgtctgtacaaggcaaactgagtgctttgtacacgactatgacgaat

SEQ ID NO: 1282 - protein, 177 aa, Neisseria gonorrhoeae
MAEFATIARPYAKALFGLAQEKNQIESWLGGLEKLAAVVQEGKVASLIDRPETNASEKADILIDLVGLKDKELKNFVIVLAGQKRLSILPEVYAQYQDLTLSFNHIKSAVIYSAYPLTDKQVGELAQMLNKRFDSELKISVEIEPELIGGIKVEVGDQVLDLSVQGKLSALYTTMTN

SEQ ID NO: 1283 - DNA, 648 bp, Neisseria gonorrhoeae
atgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgcccgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacgactccacagagactggcgtctctgcttccaagcctcccacctatcctacacaag

SEQ ID NO: 1284 - protein, 216 aa, Neisseria gonorrhoeae
MLSALISSELSYPAMQLALQPVHQRFVHSGPLVLGAAPVKLPTPTADRDQTVSRRFKPSSRTTLNGEQPYPWDRLQPQDVMSRHRGAKLRRRYELLGGISLLSPEYLLSVERWPFHTEPPDHYVLLSHLPDLSVSQLSYLLPLHYQSDFRPDLGNLRTPPLRFGRRPPQSNCLPCTVPDPDDGSGLEPQRHQGGISRTTPQRLASLLPSLPPILHK

SEQ ID NO: 1285 - DNA, 2583 bp, Neisseria gonorrhoeae
atgttagaagcctatcgtaaagccgccgccgagcgcgccgccctcggcattcccgccctccctttgaatgcgcagcaaaccgccgatttggttgagctgctgaaaaacccgcccgcaggcgaaggcgagttcttggtcgagctgcttgcccaccgtgttccgcccggtgtggacgatgccgccaaagtcaaagcctcattcctggctgccgttgccgaaggcagcgcatccagcccgctggtttcccccaaatatgcgaccgaactcttaggtacgatgctcggcggttacaatatccacgccttaatcgaactcttggacgacgacaaactcgcgcccattgccgccaaaggcttgaaacatacgcttctgatgttcgattccttccacgacgttcaggaaaaagccgaaaaaggcaacaaatacgcgcaggaagttttgcaatcttgggcagatgccgaatggttcgcctcccgtgccaaagttcccgaaaaaatcaccgttaccgtcttcaaagttgacggcgaaaccaatacagacgacctctctcccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcctacgtcggtgacgtggtcggtaccggttcttcacgcaaatccgcgaccaactccgtcatttggcataccggcgaagacatcccgttcgtgccgaacaaacgcttcggcggcgtgtgcttgggcggtaaaatcgcgccgattttcttcaacactcaagaagactccggcgcgctgccgattgaagtcgatgtttccgcgctgaaaatgggcgatgtcgtcaatatccttccttatgaaggtaaaatcgtgaaaaacggcgagactgttgccgagtttgaattgaaatcacaagtattgctggacgaagtgcaagccggcggccgtatcaacctgattatcggtcgcggtctgaccgccaaagcgcgcgaagccctgaaactgcctgcctctactgcattccgcctgccgcaagcgcctgccgaaagcaaagtcggttttaccttggcgcaaaaaatggtcggtcgcgcctgcggtctgcccgaaggacaaggcgtgcgtccgggtacttactgcgaaccgcgcatgacgacggtcggctcgcaagatacgaccgggccgatgacccgcgacgagttgaaagacttggcttgtttgggcttctccgccgatatggtgatgcagtctttctgccacaccgctgcctatccgaaacctgtcgatgtaaaaacccataaagaactgcccgcctttatttctacccgtggcggcgtgtccctgcgtccgggcgacggcgtcatccactcatggctcaaccgcctgctgttgcctgatacagtcggtacaggcggcgacagccacacccgtttccccatcggtatttccttccccgcaggttcaggcttggtcgcttttgccgccgcaacgggcgtaataccgctcgatatgcccgagtccgtattggtacgtttcagcggcaagctgcaaccgggcgtaaccctgcgcgatttggtgaacgccatcccgctttacgcgattaaacaaggtttgctgaccgttgccaaagccggtaagaaaaacatcttctccggccgcatcctcgaaatcgaaggcctgcccgatttgaaagtggaacaagcctttgaattgaccgacgcatccgccgaacgctccgccgccggctgtaccgtgaagctcaataaagagccgattatcgagtacatgaaatccaacgtcgtgttgatgaaaaatatgattgccaacggctatcaagatccgcgcgctttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtatgctttatgtccgaacgctccggcaccaaaatcgacgaagtgttcatcggttcttgtatgaccaacatcggccacttccgcgccgcctccaaacttttggaaggcaagagcgacatccccgtccgcctgtgggtagcgccgccgaccaaaatggacgcgaaagagttgtccgacgaaggtcactacggcgtactcggccgcgccggcgcgcgtatggaaatgccgggctgttcgttgtgtatgggtaaccaagcccaagtacgcgaaggtgcaactgtcatgtccacttcgacccgcaacttcccgaaccgcttgggtaaaaacaccttcgtttacctcggctcggcagagttggcggcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaatgtt

SEQ ID NO: 1286 - protein, 861 aa, Neisseria gonorrhoeae
MLEAYRKAAAERAALGIPALPLNAQQTADLVELLKNPPAGEGEFLVELLAHRVPPGVDDAAKVKASFLAAVAEGSASSPLVSPKYATELLGTMLGGYNIHALIELLDDDKLAPIAAKGLKHTLLMFDSFHDVQEKAEKGNKYAQEVLQSWADAEWFASRAKVPEKITVTVFKVDGETNTDDLSPAPDAWSRPDIPLHALAMLKNPRDGITPDKPGEVGPIKLLEELKAKGHPVAYVGDVVGTGSSRKSATNSVIWHTGEDIPFVPNKRFGGVCLGGKIAPIFFNTQEDSGALPIEVDVSALKMGDVVNILPYEGKIVKNGETVAEFELKSQVLLDEVQAGGRINLIIGRGLTAKAREALKLPASTAFRLPQAPAESKVGFTLAQKMVGRACGLPEGQGVRPGTYCEPRMTTVGSQDTTGPMTRDELKDLACLGFSADMVMQSFCHTAAYPKPVDVKTHKELPAFISTRGGVSLRPGDGVIHSWLNRLLLPDTVGTGGDSHTRFPIGISFPAGSGLVAFAAATGVIPLDMPESVLVRFSGKLQPGVTLRDLVNAIPLYAIKQGLLTVAKAGKKNIFSGRILEIEGLPDLKVEQAFELTDASAERSAAGCTVKLNKEPIIEYMKSNVVLMKNMIANGYQDPRALERRIKAMEKWLANPELLEADKDAEYAAVIEINMDDIKEPIIACPNDPDDVCFMSERSGTKIDEVFIGSCMTNIGHFRAASKLLEGKSDIPVRLWVAPPTKMDAKELSDEGHYGVLGRAGARMEMPGCSLCMGNQAQVREGATVMSTSTRNFPNRLGKNTFVYLGSAELAAICSKLGKIPTVEEYQANIGIINEQGDKIYRYMNFNEIDSYNEVAETVNV

SEQ ID NO: 1287 - DNA, 1545 bp, Neisseria gonorrhoeae
atgcagcttaatcctgctgaaattagcgatctgattaaagccaagatcgaaaatctgtctgtaaatgccgaagtgagtacccgtggtacggtgatttcggtaactgacggtatcgttcgcatccatggtttgtcagatgcaatgcaaggtgagatgctcgaattcccgggtaacactttaggcttggcgatgaacctggagcgcgactccgtcggtgccgtagtgttgggcgagtacgaacatattaaagaaggcgacacggttacctgtaccggccgtattttagaagtgccggtcggacgcgaattggtcggacgcgtcgtcgatgcattgggtcggcctatcgacggcaaaggtccgattaatacaactttgaccgcccctgtcgaaaaaatcgcaccgggcgtgattgcacgcaaatcggttgatcagccgatgcaaaccggtctgaaggcgattgactctatgattcctgtcggtcgcggtcagcgtgagttgattattggagaccgtcagacaggtaaaacggccgtagcattggatgccatcgtcaaccaaaaaggtacgggtgttatctgtatctatgtcgctatcggtcaaaaagcatcttctattgccaacgtggtccgcaaattggaagagcatggcgcgatggaacacacgattgtggttgctgcaactgcatctgaagcggcggcattgcaatatatcgcaccttattcaggttgtacgatgggtgaattcttccgcgatcgtggcgaagatgccttgattgtttatgacgatttgtccaaacaggctgtggcttaccgtcaaatttccctgcttttgcgccgtccgcccggccgcgaagcctatcccggcgatgtgttctacctgcactcccgtctgttggaacgtgcggcacgtgtcaatgaacacgaagtggaaaaattgaccaacggcgaagtaaaaggcaaaaccggttctctgaccgcgttgccgattatcgaaacccaagcgggcgacgtatctgctttcgttccgactaacgtcatttcgattaccgacggtcagattttcttggaaaccgacctcttcaacgccggtatccgtcctgcaatcaatgccggtatttccgtatcccgcgtaggcggtgctgcacaaaccaaagtgattaaaaagctgggtggcggtatccgtttggcgttggcacaatatcgtgaattggcggcgttctcgcaatttgcatccgatttggatgaagctacgcgcaaacagttggagcatggcgaagtcgtaaccgaactgatgaaacagaaacagttcagtacgttgaatacggctgaaatggctttgaccctttgggcaatcaacaacggttcgtattctgatgttccggttgccaaagctctagcttttgaatctgaatttttgagctttgtccgtacccaacatccggaagttttggaagccgtcaatgcttcaggtgcaatgtccgacgagagcgagaaaacgcttgaagcagccatgaaatccttcaaatcttcttacgcctatcaggca

SEQ ID NO: 1288 - protein, 515 aa, Neisseria gonorrhoeae
MQLNPAEISDLIKAKIENLSVNAEVSTRGTVISVTDGIVRIHGLSDAMQGEMLEFPGNTLGLAMNLERDSVGAVVLGEYEHIKEGDTVTCTGRILEVPVGRELVGRVVDALGRPIDGKGPINTTLTAPVEKIAPGVIARKSVDQPMQTGLKAIDSMIPVGRGQRELIIGDRQTGKTAVALDAIVNQKGTGVICIYVAIGQKASSIANVVRKLEEHGAMEHTIVVAATASEAAALQYIAPYSGCTMGEFFRDRGEDALIVYDDLSKQAVAYRQISLLLRRPPGREAYPGDVFYLHSRLLERAARVNEHEVEKLTNGEVKGKTGSLTALPIIETQAGDVSAFVPTNVISITDGQIFLETDLFNAGIRPAINAGISVSRVGGAAQTKVIKKLGGGIRLALAQYRELAAFSQFASDLDEATRKQLEHGEVVTELMKQKQFSTLNTAEMALTLWAINNGSYSDVPVAKALAFESEFLSFVRTQHPEVLEAVNASGAMSDESEKTLEAAMKSFKSSYAYQA

SEQ ID NO: 1289 - DNA, 873 bp, Neisseria gonorrhoeae
atggcagtaggaaaagagattctcaccaaaatccgcagtgttcagaatacccaaaagatcactaaagcgatgcaaatggtgtcaacctctaaaatgcggaagactcaggaacggatgagtttggcgcgtccgtatgccgaaaaagtgcgtatggtgatgagccatcttgcgcaaaccaataccgatcatggtattccgttactggaatctcatcgggaaatcagacgtgtcggttttattttgattacgtctgataagggtttgtgtggcggtttgaacgccaacgtgctgaaaaagtttttggcacaagttcaagagtatcggaatcaaggtattgaagaggaaatcgtatgccttggcagtaaaggtctgatggcgtgtcagagcattggtctgaatgtggttgccagtgccgtaaatttgggcgataccccaaaaatggaaatgctgctcggacctttgacagaacttttccaacggtatgagaaacatgaaattgacagaatccatctggtgtattcgggttttgtcaataccatgcgtcaagaaccgaggatggaagtattgctgcctatcggtgagaacgtgattggcgattcagctcccaaatcaccgttcagctgggaataccgctacgaaccgactgcacttgcagtgttggaatatctggttcgccgctatttagagtctgtggtttatcaggcgttgagcgacaatatggcatccgaacaggcagcccgcatggttgccatgaaagctgcaacagacaatgcaggcaatgccatcaaagagttgcgtctggtatataacaaatcgcgtcaagctgcgattaccacggaattgtcagaaattgtagcaggtgcggcggccgtc

SEQ ID NO: 1290 - protein, 291 aa, Neisseria gonorrhoeae
MAVGKEILTKIRSVQNTQKITKAMQMVSTSKMRKTQERMSLARPYAEKVRMVMSHLAQTNTDHGIPLLESHREIRRVGFILITSDKGLCGGLNANVLKKFLAQVQEYRNQGIEEEIVCLGSKGLMACQSIGLNVVASAVNLGDTPKMEMLLGPLTELFQRYEKHEIDRIHLVYSGFVNTMRQEPRMEVLLPIGENVIGDSAPKSPFSWEYRYEPTALAVLEYLVRRYLESVVYQALSDNMASEQAARMVAMKAATDNAGNAIKELRLVYNKSRQAAITTELSEIVAGAAAV

SEQ ID NO: 1291 - DNA, 1395 bp, Neisseria gonorrhoeae
atgagccaaggcaaaatcgtacaaattatcggtgcggttgttgacgtggaatttccacgcgacatgattccgcgcgtttacgacgctttgaaattagacgaaaacggtctgactttggaagtccaacagcttttgggtgatggcgtagtccgtaccatcgctatgggcagctcggacggtttgaaacgcggcatgactgtgagcaatactggttcgcccattactgtgccggtaggtaaaggtacgttgggacgcattgtcgatgtattgggaacgcctgttgacgaggcaggtccaattgataccgacaagagtcgtgccatccaccaagccgctcctaagtttgacgaactgtcttccacaaccgaattgctcgaaacgggcattaaagtgattgacttgctgtgtccgtttgccaaaggcggtaaagtaggtctgttcggcggtgccggtgtgggtaaaaccgtgaacatgatggaattgatcaacaacatcgccaaagcgcacagcggcttgtccgtgttctcaggcgtgggtgagcgtacccgcgaaggtaacgacttctaccacgagatgaaagattccaacgtattggataaagtagccatggtgtatggccaaatgaacgaacctccaggcaaccgtctgcgcgttgctttgaccggtttgactatggctgaatacttccgtgacgaaaaagacgaaaacggtaaaggtcgtgacgtattgttcttcgttgacaacatctaccgttacactctggccggtaccgaagtatccgcactgttgggccgtatgccttctgcagtgggttaccaaccgacattggctgaagaaatgggtcgtttgcaagagcgtattacctctacccaaaccggttccattacttccatccaagccgtatatgtacctgcggatgacttgactgacccgtctccggcgacaactttcgcccacttggacgcgaccgtcgtattgagccgtgatattgcctctttgggtatttacccggcagttgacccgcttgactctacttcgcgccaattggatccgatggtattgggtcaagagcactacgacgtagcgcgcggtgtacagtctactctgcaaaaatacaaagaattgcgcgacatcatcgccattctgggtatggacgaattgtctgacgaagacaaactggctgtaatgcgtgcccgtaaaatccaacgcttcctgtctcaaccgttccacgttgccgaagtgtttacaggttctccaggcaaatatgtcgccctgcgcgataccattgccggcttcaaagccatcttgaacggcgaatacgatcatctgcccgaacaggcattctatatggtcggcagcatcgaagaagcggttgagaaagcgaaaaccttaaac

SEQ ID NO: 1292 - protein, 465 aa, Neisseria gonorrhoeae
MSQGKIVQIIGAVVDVEFPRDMIPRVYDALKLDENGLTLEVQQLLGDGVVRTIAMGSSDGLKRGMTVSNTGSPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFSGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGRLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLAVMRARKIQRFLSQPFHVAEVFTGSPGKYVALRDTIAGFKAILNGEYDHLPEQAFYMVGSIEEAVEKAKTLN

SEQ ID NO: 1293 - DNA, 411 bp, Neisseria gonorrhoeae
atgcaagttgaggtggtaagtggcgagcagaaaatctattcaggcgaggcaacatttatcgttgttccgactgtacagggcgaactcggtatttatccgcgacacgagccgattatgagtttggtgcgtcccggtgcgttgcgtttgaccgttccgggcgaggataaagaggttttggttgctgtttccggcggtattttggaagtacagcctgataaagtaactgtcttggcggatgttgccgtccgcagtgcggaaatggatcgggcacgtgcggaagaggcgaaaaaagccgcagaagcgggcatttcccaagctaaagacgataaggctttggcggaagcacataaagcattggctgccgcaattgcacagctcaaaactttggactatatccgttcgcacaagaaa

SEQ ID NO: 1294 - protein, 137 aa, Neisseria gonorrhoeae
MQVEVVSGEQKIYSGEATFIVVPTVQGELGIYPRHEPIMSLVRPGALRLTVPGEDKEVLVAVSGGILEVQPDKVTVLADVAVRSAEMDRARAEEAKKAAEAGISQAKDDKALAEAHKALAAAIAQLKTLDYIRSHKK

SEQ ID NO: 1295 - DNA, 114 bp, Neisseria gonorrhoeae
ttgcagtttgaagatgatttgttggaaggtaagcatggcttattgttcgataaaataaaggttttattttactgtttccatagccgcttgaatagatttatctcgaagacagcc

SEQ ID NO: 1296 - protein, 38 aa, Neisseria gonorrhoeae
LQFEDDLLEGKHGLLFDKIKVLFYCFHSRLNRFISKTA

SEQ ID NO: 1297 - DNA, 813 bp, Neisseria gonorrhoeae
atggaagtcggtgccggcacatcccatcccgccacctgcctgcgcgcgctcggccccgagccttggtttgccgcctacgtccaacccagccgccgccccaaagacggccgctacggcgacaaccccaaccgcctgcaacactattaccaattccaagtcgccctcaaacccgcccccgccaatatccaagacctctatctcgactccctgcgcgaattgggcatcgatcccaaagtccacgacatccgctttgtcgaagacgactgggaaaaccccaccctcggtgcgtggggtttgggctgggaagtctggctcaacggcatggaagtaacccagtttacctatttccaacaagtcggcggtatcgattgcacgcccgtactcggcgaaattacctacggcatcgaacgcttggcgatgtacctgcaaggcgtggaaaacgtctatgacctcgtttgggcaaaaacgccggacggcaataccgtaagctacggcgacgtgtaccatcaaaacgaagtcgagcaatctacctacaacttcgaatacagcgatgccgactggctgctgcgccagttcaacgactacgaagcgcaagccaaacgcctgttcgccgaagaaaacgccggccttgccttacctgcctacgagctggtcctcaaagcggggcatacgttcaaccttttagacgcacgcggcgcgatttccgtaaccgagcgggcaacttatattggacgtattcgtgcattgagccgcgccgtggcgcaaaaatatatcgaaagccgtgagaaactgggcttcccgttgattaaaaaa

SEQ ID NO: 1298 - protein, 271 aa, Neisseria gonorrhoeae
MEVGAGTSHPATCLRALGPEPWFAAYVQPSRRPKDGRYGDNPNRLQHYYQFQVALKPAPANIQDLYLDSLRELGIDPKVHDIRFVEDDWENPTLGAWGLGWEVWLNGMEVTQFTYFQQVGGIDCTPVLGEITYGIERLAMYLQGVENVYDLVWAKTPDGNTVSYGDVYHQNEVEQSTYNFEYSDADWLLRQFNDYEAQAKRLFAEENAGLALPAYELVLKAGHTFNLLDARGAISVTERATYIGRIRALSRAVAQKYIESREKLGFPLIKK

SEQ ID NO: 1299 - DNA, 2061 bp, Neisseria gonorrhoeae
atgacaacccaaacccttttaatcgaactccttaccgaagaactcccgccaaaagccctgaataatctgggcaaccattttgccgcttccgttgccgaaggcttggaaaaagcgcaactggttgacggcgcggccgaatttacggcttatgcctcgccgcgccgtttggcggttcaagtcaaaaacgtgaaggccgttcaagccgatcagaaaatcgtgaaaaaaggccctgccgtggcgaatgccgtaaaagacggtacgccgaccaaggctttggaaggttttgcgcgcggggcgggggcgaaaatcgaagacctgaccatcgtccacgacggcaggcaggacgtgtacgcctacgaatacgtccaaaccggcagaccgttgggcggacttttggaaaacattatcaatcaagctgttaagaagctgccgattccgaaagtaatgcgttggggcagcagcacgtttaccttcgtgcgccctgttcacgggctgattgtgctgcacggcggcgatgtcgtgaacgtcagcgttttgggcctgcaaagcggcaatcaaaccttgggacaccgctttctttccgacggcgaaatcatcattgaaaacgccgacagctacgccgcacaaatgcgcgggcaaggcaaagtcgtcgcttcgtttgccgggcgcaaagccgcgattcagacggcattggaagggcaggcacgccgtctgaacgcgaccgttgccgccgatgaagccctgttggacgaagtaaccgcgctggtcgaatggcctgttgttttggaagccggttttgaggaacacttcctcgccgtgcctcaagaatgcttgattttgacgatgcagcaaaaccaaaaatacttcccgctgctcgaccaaaacggcaagctgatgaaccgcttcctgctggtttccaacctgcaaaccgaagacccgtcgcacatcatccgaggcaacgaacgcgtattgcgcgcgcgcctgtctgatgccgagttcttctacaaacaagaccaaaaagcgaccttggaaagccgcctgcccaagctggcgaacgtggtgtaccacaacaaaatcggttcgcaggccgaacgcatcgaacgcctgcaaagcatcgccgcccatatcgccaaagcattgggcgcggatgccgcggcagccgagcgcgccgcgcgtcttgccaaagccgacttggtaactgaaatggtcggcgagttccccgaactgcaaggcacgatgggcaaatactacgcccgcttggacggcgaaaccgaagaaatcgccgaagctattgagcaacactaccaaccgcgttttgccggcgacaagctgcccgaaagcaaaattgccgccgccgtggcacttgccgacaaactggaaaccctggtcggcatttggggcatcggtttgattcctaccggcgacaaagacccctacgccctgcgccgcgccgccttgggtattttgcggatgctgatgcagtacggtttggacgtgaacgaactgattcagacggcattcgacagcttcccgcaaggtttgctcaacgaaaaaacgccgtctgaaaccgccgactttatgcaggcgcgccttgccgtgttgctgcaaaacgattatccgcaagacatcgttgccgccgtactcgccaaacagccgcgccgtttggacgatttgaccgccaaactgcaggccgtcgccgtattcaaacaactgcccgaagccgccgcgctcgccgccgccaacaaacgcgtgcaaaacctgctgaaaaaagccgatgccgagttgggcgcggttaacgaaagcctgctgcaacaggacgaagaaaaagccctgtacgctgccgcgcaaggtttgcagccgaaaatcgccgccgccgtcgccgaaggcaatttccaaactgctttgtccgaactggcttccgtcaagccgcaggttgatgccttcttcgacggcgtgatggtgatggcggaagatgccgccgtaaaacaaaaccgcctgaacctgctgaaccgcttggcagggcagatgaacgcggtggccgacatcgcgcttttgggcgag

SEQ ID NO: 1300 - protein, 687 aa, Neisseria gonorrhoeae
MTTQTLLIELLTEELPPKALNNLGNHFAASVAEGLEKAQLVDGAAEFTAYASPRRLAVQVKNVKAVQADQKIVKKGPAVANAVKDGTPTKALEGFARGAGAKIEDLTIVHDGRQDVYAYEYVQTGRPLGGLLENIINQAVKKLPIPKVMRWGSSTFTFVRPVHGLIVLHGGDVVNVSVLGLQSGNQTLGHRFLSDGEIIIENADSYAAQMRGQGKVVASFAGRKAAIQTALEGQARRLNATVAADEALLDEVTALVEWPVVLEAGFEEHFLAVPQECLILTMQQNQKYFPLLDQNGKLMNRFLLVSNLQTEDPSHIIRGNERVLRARLSDAEFFYKQDQKATLESRLPKLANVVYHNKIGSQAERIERLQSIAAHIAKALGADAAAAERAARLAKADLVTEMVGEFPELQGTMGKYYARLDGETEEIAEAIEQHYQPRFAGDKLPESKIAAAVALADKLETLVGIWGIGLIPTGDKDPYALRRAALGILRMLMQYGLDVNELIQTAFDSFPQGLLNEKTPSETADFMQARLAVLLQNDYPQDIVAAVLAKQPRRLDDLTAKLQAVAVFKQLPEAAALAAANKRVQNLLKKADAELGAVNESLLQQDEEKALYAAAQGLQPKIAAAVAEGNFQTALSELASVKPQVDAFFDGVMVMAEDAAVKQNRLNLLNRLAGQMNAVADIALLGE

SEQ ID NO: 1301 - DNA, 111 bp, Neisseria gonorrhoeae
tcctgcccacctgtgtcggtttgcggtacggttcgattcaaactgaagcttagtggcttttcctggaagcgtggtatcggttgcttcgtgtccgtagacactcgtcatcac

SEQ ID NO: 1302 - protein, 37 aa, Neisseria gonorrhoeae
SCPPVSVCGTVRFKLKLSGFSWKRGIGCFVSVDTRHH

SEQ ID NO: 1303 - DNA, 606 bp, Neisseria gonorrhoeae
atgcttgaaccataccgtccgatttgtcaaaaccgtccgatttgtgggaaaatcccaagattgaatttaacggagggcgacaccgtgttggacagggaaggctatcgccccaatgtcggtattatcctaattaacgaacgtaacgaagtcttttggggtaagcgcgtgcgcgaacattcatggcagtttcctcaaggcggcatcaagcccggcgaaagccccgaaaccgcgatgtaccgcgaactttacgaagaagtcggacttctgccgcaacacgtcaaaatcgtcgggcggacgcgcgactggctgcgttacgacgtgccgaacaactgggtgcgccgcgaatggcgcggctcttatcgcggacagaagcagatttggtatctcctgcgcctgaccggccgggattgcgatgtcaacctgcgcgccacccgccaccccgaatttgacggctggcgttggcatcaatattgggcgcccgttgacgaagtgattgatttcaaacgcgacgtttatttggaggcgttgaaagaactctcttcccgcttcctgcgcggtatggaaagttatgaagactttgccgcccgccaaccttccggcaaccgg

SEQ ID NO: 1304 - protein, 202 aa, Neisseria gonorrhoeae
MLEPYRPICQNRPICGKIPRLNLTEGDTVLDREGYRPNVGIILINERNEVFWGKRVREHSWQFPQGGIKPGESPETAMYRELYEEVGLLPQHVKIVGRTRDWLRYDVPNNWVRREWRGSYRGQKQIWYLLRLTGRDCDVNLRATRHPEFDGWRWHQYWAPVDEVIDFKRDVYLEALKELSSRFLRGMESYEDFAARQPSGNR

SEQ ID NO: 1305 - DNA, 96 bp, Neisseria gonorrhoeae
atgccgtctgaaggttgttcagacggcattgcggtcaatcccttactccatacggatgacggggatcaaacattcacggtctcggctacttcgttg

SEQ ID NO: 1306 - protein, 32 aa, Neisseria gonorrhoeae
MPSEGCSDGIAVNPLLHTDDGDQTFTVSATSL

SEQ ID NO: 1307 - DNA, 714 bp, Neisseria gonorrhoeae
gtgggcgagatggaaaaagaccgcagcatcattgcgatgggcgcgtggttggaaattttgtcggaagaaaaggacggcaaccggctggcgcggcatcacaaacacggcaaaatttggaaaaagccgacccggcacgaagacatcgccgcctttttccctttcggcaaccccatacacaacaacacgatgattatgcggcgcagcgtcattgacggcggtttgcgttacaacaccgggcgggattgggcggaagattaccaattttggtacgatgtcagcaaattgggcaggctggcttattatcccgaagccttggtcaaataccgccttcacgccaatcaggtttcatccaaacacagcgtccgccaacacgaaatcgcgcaaggcatccaaaaaaccgccagaaacgattttttgcagtctatgggttttaaaacccggttcgacagcctagaataccgccaaacaaaagcagcggcgtacgaattgccggagaaggatttgccggaagaagattttgaacgcgcccgccggtttttgtaccgatgcttcaaacggacggacacgccgccctccggcgcgtggctggatttcgcggcagacggcaggatgaggcggctgtttaccttgaggcaatacttcggcattttgtaccggctgattaaaaaccgccggcaggcgcggtcggattcggcagggaaagaacaggagatt

SEQ ID NO: 1308 - protein, 238 aa, Neisseria gonorrhoeae
VGEMEKDRSIIAMGAWLEILSEEKDGNRLARHHKHGKIWKKPTRHEDIAAFFPFGNPIHNNTMIMRRSVIDGGLRYNTGRDWAEDYQFWYDVSKLGRLAYYPEALVKYRLHANQVSSKHSVRQHEIAQGIQKTARNDFLQSMGFKTRFDSLEYRQTKAAAYELPEKDLPEEDFERARRFLYRCFKRTDTPPSGAWLDFAADGRMRRLFTLRQYFGILYRLIKNRRQARSDSAGKEQEI

SEQ ID NO: 1309 - DNA, 837 bp, Neisseria gonorrhoeae
atgcaaaaccacgttatcagcttggcttccgccgcagaacgcagggcgcacattgccgcaaccttcggcagtcgcggcatcccgtttcagtttttcgacgcactgatgccgtctgaaaggctggaacaggcgatggcggaactcgtccccggcttgtcggcgcacccctatttgagcggagtggaaaaagcctgctttatgagccacgccgtattgtgggaacaggcgttggatgaaggtctgccgtatatcgccgtatttgaggacgacgttttactcggcgaaggcgcggagcagttccttgccgaagatacttggttggaagagcgttttgataaggattccgcctttatcgtccgtttggaaacgatgtttatgcacgtcctgacctcgccctccggcgtggcggactacggcgggcgcgcctttccgcttttggaaagcgaacactgcgggacggcgggctatattatttcccgaaaggcgatgcgttttttcttggacaggtttgccgttttgccgcccgaacgcctgcaccctgtcgatttgatgatgttcggcaaccctgacgacagggaaggaatgccggtttgccagctcaatcccgccttgtgcgcccaagagctgcattatgccaagtttcacgaccaaaacagcgcattgggcagcctgatcgaacatgaccgccgcctgaaccgcaaacagcaatggcgcgattcccccgccaacacattcaaacaccgcctgatccgcgccttgaccaaaatcggcagggaaagggaaaaacgccggaaaaggcgcgaacagacaatcggcaaaattattgtgcctttccaa

SEQ ID NO: 1310 - protein, 279 aa, Neisseria gonorrhoeae
MQNHVISLASAAERRAHIAATFGSRGIPFQFFDALMPSERLEQAMAELVPGLSAHPYLSGVEKACFMSHAVLWEQALDEGLPYIAVFEDDVLLGEGAEQFLAEDTWLEERFDKDSAFIVRLETMFMHVLTSPSGVADYGGRAFPLLESEHCGTAGYIISRKAMRFFLDRFAVLPPERLHPVDLMMFGNPDDREGMPVCQLNPALCAQELHYAKFHDQNSALGSLIEHDRRLNRKQQWRDSPANTFKHRLIRALTKIGREREKRRKRREQTIGKIIVPFQ

SEQ ID NO: 1311 - DNA, 171 bp, Neisseria gonorrhoeae
atggacatcgtatttgcggcagacgacaactatgccgcctatctttgcgttgcggcaaaaagcgtggaagcggcccatcccgatacggaaatcaggttccacgtcctcgatgccggcatcagtgaggaaaaccgggcggcggttgccgccaatttgcgggggggggggggg

SEQ ID NO: 1312 - protein, 57 aa, Neisseria gonorrhoeae
MDIVFAADDNYAAYLCVAAKSVEAAHPDTEIRFHVLDAGISEENRAAVAANLRGGGG

SEQ ID NO: 1313 - DNA, 780 bp, Neisseria gonorrhoeae; identical to SEQ ID NO: 239

SEQ ID NO: 1314 - protein, 260 aa, Neisseria gonorrhoeae; identical to SEQ ID NO: 240

SEQ ID NO: 1315 - DNA, 255 bp, Neisseria gonorrhoeae
ttgccgtcccgccgacaaagcgtatgcttcaaagatggcgcaaaaagctgtctgccagattcttacgcaagatttattgacggggcaggccgtctgaagccttcagacggcatcggacgtatcggaaaggagaaacggattgcagcctttagtcagcgtattgatttgcgcctacaacgtagaaaaatattttgcccaatcattggccgccgtcgtgaatcagacttggcgcaacttggatattttgattgtcga

SEQ ID NO: 1316 - protein, 85 aa, Neisseria gonorrhoeae
LPSRRQSVCFKDGAKSCLPDSYARFIDGAGRLKPSDGIGRIGKEKRIAAFSQRIDLRLQRRKIFCPIIGRRRESDLAQLGYFDCR

SEQ ID NO: 1317 - DNA, 918 bp, Neisseria gonorrhoeae
ttggatattttgattgtcgatgacggctcgacggacggcacgcccgccattgcccggcgtttccaagaacaggacggcaggatcaggataatttccaatccccgcaatttgggctttatcgcctctttaaacatcgggctggacgaattggcaaagtcggggggggggggggaatatattgcgcgcaccgatgccgacgatattgcctcccccggctggattgagaaaatcgtgggcgagatggaaaaagaccgcagcatcattgcgatgggcgcgtggttggaagttttgtcggaagaaaacaataaaagcgtgcttgccgccattgcccgaaacggcgcaatttgggacaaaccgacccggcatgaagacattgtcgccgttttccctttcggcaaccccatacacaacaacacgatgattatgaggcgcagcgtcattgacggcggtttgcggttcgatccagcctatatccacgccgaagactataagttttggtacgaagccggcaaactgggcaggctggcttattatcccgaagccttggtcaaataccgcttccatcaagaccagacttcttccaaatacaacctgcaacagcgcaggacggcgtggaaaatcaaagaagaaatcagggcggggtattggaaggcggcaggcatagccgtcggggcggactgcctgaattacgggcttttgaaatcaacggcatatgcgttgtacgaaaaagccttgtccggacaggatatcggatgcctccgcctgttcctgtacgaatatttcttgtcgttggaaaagtattctttgaccgatttgctggatttcttgacagaccgcgtgatgaggaagctgtttgccgcaccgcaatataggaaaatcctgaaaaaaatgttacgcccttggaaataccgcagctat

SEQ ID NO: 1318 - protein, 306 aa, Neisseria gonorrhoeae
LDILIVDDGSTDGTPAIARRFQEQDGRIRIISNPRNLGFIASLNIGLDELAKSGGGGEYIARTDADDIASPGWIEKIVGEMEKDRSIIAMGAWLEVLSEENNKSVLAAIARNGAIWDKPTRHEDIVAVFPFGNPIHNNTMIMRRSVIDGGLRFDPAYIHAEDYKFWYEAGKLGRLAYYPEALVKYRFHQDQTSSKYNLQQRRTAWKIKEEIRAGYWKAAGIAVGADCLNYGLLKSTAYALYEKALSGQDIGCLRLFLYEYFLSLEKYSLTDLLDFLTDRVMRKLFAAPQYRKILKKMLRPWKYRSY

SEQ ID NO: 1319 - DNA, 381 bp, Neisseria gonorrhoeae
atgcttgcacatcttcaattaaccttccggcaccgggcaggcgtcacaccctatacgtccactttcgtgttggcagagtgctgtgtttttaataaacagtcgcagccacctattctctgcgaccctccggggcttacggagcaagtccttaaccttagagggcataccttctcccgaagttacggtatcaatttgccgagttccttctcccgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcatcacttctcggtgttaagaaaacccggatttgcc

SEQ ID NO: 1320 - protein, 127 aa, Neisseria gonorrhoeae
MLAHLQLTFRHRAGVTPYTSTFVLAECCVFNKQSQPPILCDPPGLTEQVLNLRGHTFSRSYGINLPSSFSRVLSSALEFSSCPPVSVCGTVRFKLKLSGFSWKRGIGCFVSVDTRHHFSVLRKPGFA

SEQ ID NO: 1321 - DNA, 1293 bp, Neisseria gonorrhoeae
atgttagatatccaattgctccgcagcaacaccgccgccgttgccgaacggcttgcacggcgcggttatgactttgataccgcacgttttgacgcactggaagaacgacgcaagtccgttcaggtgaaaaccgaagaactacaagcctcgcgcaacagcatttccaaacaaatcggcgcactgaaaggtcagggcaaacatgaagaggcgcaggcggccatggatcaagtcgcccaaatcaaaaccgatttggaacaggctgccgccgatttggatgccgttcaaaaagaattggacgcatggttgttgagcatacctaacctgccgcacgaaagcgtacctcccggtaaagacgaaaccgaaaacgtcgaagtccgcaaagtcggtacgccgcgcgaatttgattttgaaatcaaagatcatgtcgatttgggcgagcctttgggcttggatttcgaaggcggcgcgaaactttccggcgcacgatttaccgtgatgcgcggacaaatcgcccgtctgcaccgcgccttggcgcaattcatgctcgatacgcacatgctgcaacacggctacaccgagcattacacgccttatatcgttgacgatacgacgctgcaaggcacaggtcagctgcccaaatttgcagaagatttgttccacgttacccgcggcggcgatgaaaccaaaaccacgcaatatctgattccgacagccgaagttaccctgaccaataccgttgccggcagcattatcccgtccgaacaactgccgctgaagctgaccgcgcattcgccctgtttccgcagtgaagcgggatcatacggcaaagacacgcgcggcctaatccgccagcaccagttcgacaaagtagaaatggtacaaatcgttcatcccgaaaaatcatacggcgcgctggaagaaatggtcggccatgccgaaaacatcctgaaggctttggaactgccctaccgcgtgattaccctgtgtaccggcgacatgggtttcagcgcggccaaaacgtatgacttggaagtttgggttcccgcacaaaatacctaccgcgaaatctcaagctgctccaactgcgaagatttccaagcacgccgcatgaaggcgcgtttcaaagacgaaaacggcaaaaaccgcttggtacataccttaaacggctccggtttggcagtcggtcgcactttggtcgcggttttggaaaaccatcaaaacgccgacggcagcatcaatatccccgccgcactgcaaccgtatatgggcggtgttaccaagttggaagtgaaa

SEQ ID NO: 1322 - protein, 431 aa, Neisseria gonorrhoeae
MLDIQLLRSNTAAVAERLARRGYDFDTARFDALEERRKSVQVKTEELQASRNSISKQIGALKGQGKHEEAQAAMDQVAQIKTDLEQAAADLDAVQKELDAWLLSIPNLPHESVPPGKDETENVEVRKVGTPREFDFEIKDHVDLGEPLGLDFEGGAKLSGARFTVMRGQIARLHRALAQFMLDTHMLQHGYTEHYTPYIVDDTTLQGTGQLPKFAEDLFHVTRGGDETKTTQYLIPTAEVTLTNTVAGSIIPSEQLPLKLTAHSPCFRSEAGSYGKDTRGLIRQHQFDKVEMVQIVHPEKSYGALEEMVGHAENILKALELPYRVITLCTGDMGFSAAKTYDLEVWVPAQNTYREISSCSNCEDFQARRMKARFKDENGKNRLVHTLNGSGLAVGRTLVAVLENHQNADGSINIPAALQPYMGGVTKLEVK

SEQ ID NO: 1323 - DNA, 993 bp, Neisseria gonorrhoeae
gtgaacctgaaaaaccgccattttctgaaacttttggacttcacgccggaagaaatcaccacctacctcgaccttgccgccgagttgaaagacgccaaaaaggcagggcgcgagattcagcggatgaaagggaaaaacatcgccctgatttttgaaaaaacatccacgcgcacacgctgtgcgtttgaagtcgccgcacgcgaccaaggcgcggatgcaacctatctggaaccgtccgccagccaaatcgggcacaaagaaagcatcaaagacacggcgcgcgtcttaggcagaatgtacgatgccatcgaatatcgcggcttcgctcaggaaactgtcgaagaattggcaaaatatgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcacctcaaagcctgtggccgtctgaaggcattatcgccgccgcacacgccgccgccaaagaaaccggtgcaaaaattaccctgaccgaaaacgcgcatgaagccgtcaaaggtgtcggtttcattcatactgacgtatgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaagtattcgaaagtccggccggcatcgtgttcgatcaggcggaaaaccgtatgcacacgattaaagcggtaatggtcgcggctctgggcgac

SEQ ID NO: 1324 - protein, 331 aa, Neisseria gonorrhoeae
VNLKNRHFLKLLDFTPEEITTYLDLAAELKDAKKAGREIQRMKGKNIALIFEKTSTRTRCAFEVAARDQGADATYLEPSASQIGHKESIKDTARVLGRMYDAIEYRGFAQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPAGIVFDQAENRMHTIKAVMVAALGD

SEQ ID NO: 1325 - DNA, 840 bp, Neisseria gonorrhoeae
atgcaaaaccacgttatcagcttggcttccgccgcagagcgcagggcgcacattgccgcaaccttcggcagtcgcggcatcccgttccagtttttcgacgcactgatgccgtctgaaaggctggaacaggcgatggcggaactcgtccccggcttgtcggcgcacccctatttgagcggagtggaaaaagcctgctttatgagccacgccgtattgtggaaacaggcattggacgaaggcttaccgtatattgccgtatttgaggatgatgttctgcttggcaaagacgcagaaaagttccttgccgaagatacttggttggaagagcgttttgataaggattccgcctttatcgtccgtttggaaacgatgtttgcgaaagttattgtcagaccggataaagtcctgaattatgaaaaccggtcatttcctttgctggagagcgaacattgtgggacggctggctatatcatttcgcgtgaggcgatgcggtttttcttggacaggtttgccgttttgccgccagagcggattaaagcggtagatttgatgatgtttacttatttctttgataaggaggggatgcctgtttatcaggttagtcccgccttatgtacccaagaattgcattatgccaagtttctcagtcaaaacagtatgttgggtagcgatttggaaaaagatagggaacaaggaagaagacaccgccgttcgttgaaggtgatgtttgacttgaagcgtgctttgggtaaattcggtagggaaaagaagaaaagaatggagcgtcaaaggcaggcggagcttgagaaagtttacggcaggcgggtcatattgttcaaa

SEQ ID NO: 1326 - protein, 280 aa, Neisseria gonorrhoeae
MQNHVISLASAAERRAHIAATFGSRGIPFQFFDALMPSERLEQAMAELVPGLSAHPYLSGVEKACFMSHAVLWKQALDEGLPYIAVFEDDVLLGKDAEKFLAEDTWLEERFDKDSAFIVRLETMFAKVIVRPDKVLNYENRSFPLLESEHCGTAGYIISREAMRFFLDRFAVLPPERIKAVDLMMFTYFFDKEGMPVYQVSPALCTQELHYAKFLSQNSMLGSDLEKDREQGRRHRRSLKVMFDLKRALGKFGREKKKRMERQRQAELEKVYGRRVILFK

SEQ ID NO: 1327 - DNA, 219 bp, Neisseria gonorrhoeae
ttggggcgattttacctagcagatgaaaaaacacgggattttatccgaaaaagcaacaatccccccgccgtcatccccgcgaaagcgggaatctggaattttaatgcggcaagaatttatcggaaaaaaccgaagtttaaagacctagattcccgcctgcgcgggaatgacagtgtgtccatttctgattttaatcccctatattttacacaaactatt

SEQ ID NO: 1328 - protein, 73 aa, Neisseria gonorrhoeae
LGRFYLADEKTRDFIRKSNNPPAVIPAKAGIWNFNAARIYRKKPKFKDLDSRLRGNDSVSISDFNPLYFTQTI

SEQ ID NO: 1329 - DNA, 723 bp, Neisseria gonorrhoeae
atgcccagattctacctgcccgaaaacctttccgtcggacaaaccgtcgaccttcccgacaacatcgtccgccacctcaacgtcctgcgcgtccgccccaacgaaaacatcaccctcttcgacggcaaaggcaaggcacataccgcacggctgaccgttttggaaaaacaccgcgccgaagccgaaatcctgcacgaagacacaaccgacaacgagtccccgctcaacatcacgctcatccaatccatttcctccggcgatcgcatggatttcaccctgcaaaaaagcgtcgaactcggcgtaaccgccatacagcccgtcatcagcgaacgctgcatcgtccgcctcgacggagaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaaacaccaagctgattatgagcatcaaccgcgcctgcaaactcggcgacatccgccacccgtccggcgcaatcgtctttatggtcgggcccgaaggcggctggacagaacaggaagaacaacaggcatttgaagccggctttcaggcggttacactcggaaaacggattttacgcacagaaaccgccccactcgccgccatcgccgcgatgcagacgctttggggcgattttacc

SEQ ID NO: 1330 - protein, 241 aa, Neisseria gonorrhoeae
MPRFYLPENLSVGQTVDLPDNIVRHLNVLRVRPNENITLFDGKGKAHTARLTVLEKHRAEAEILHEDTTDNESPLNITLIQSISSGDRMDFTLQKSVELGVTAIQPVISERCIVRLDGERAAKRLARWQEIVISACEQSGRNTVPPVLPIIGYREALDKMPSENTKLIMSINRACKLGDIRHPSGAIVFMVGPEGGWTEQEEQQAFEAGFQAVTLGKRILRTETAPLAAIAAMQTLWGDFT

SEQ ID NO: 1331 - DNA, 792 bp, Neisseria gonorrhoeae
gtgttacaccgtttgcagaaagtcgtgcgccatatcgcgcaaaccgaaattatgccgcgttttttgaatacgccgtcccgccgcaaggaagacggttcgatgttgagcgaggcggacattgccgcgcagacggcatttgccgccgcgttgccgcttctgatcgattgcccgatgttgggcgaggaaatgtcgcggcaggaacagtcggctttgtgggaacaatattcgggggaaaaggggctgtggattgtcgatccgatagacgggacgaacaattttgtcaacgggctgccgcattttgccgtgtcggtggcgtttgtccgcaacgggcgcgccgaattgggcgtaatctacaatccggtcagcggcgaatgtttttatgccgaacgcgggcagggtgcgtttcttaatgggacacgcctgcctttgcgtctcgtggataaaaaactcaatgaggcgattgcgggcgtggaaatcaaatatctgcgttcgggcaaactttccagccgcatgagtacgctcgcgcctttcgggacgatacgcagtatgggcagcagcacgctggactggtgttatctggcgtgcgggcgttatgatgtttatgtccacggcgggcagaagctgtgggattatgctgcgggtgcgttgattttcgaggaggcgggcggcaggctgacgactttggaaggcgacgggttttggagtggtgaacacgtgttcaaacgctcggtcgtcgccgcgctcgaaccgaagctgtttgaacgctgggtcgggtggatacgggaaaaccag

SEQ ID NO: 1332 - protein, 264 aa, Neisseria gonorrhoeae
VLHRLQKVVRHIAQTEIMPRFLNTPSRRKEDGSMLSEADIAAQTAFAAALPLLIDCPMLGEEMSRQEQSALWEQYSGEKGLWIVDPIDGTNNFVNGLPHFAVSVAFVRNGRAELGVIYNPVSGECFYAERGQGAFLNGTRLPLRLVDKKLNEAIAGVEIKYLRSGKLSSRMSTLAPFGTIRSMGSSTLDWCYLACGRYDVYVHGGQKLWDYAAGALIFEEAGGRLTTLEGDGFWSGEHVFKRSVVAALEPKLFERWVGWIRENQ

SEQ ID NO: 1333 - DNA, 408 bp, Neisseria gonorrhoeae
ttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgtaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctt

SEQ ID NO: 1334 - protein, 136 aa, Neisseria gonorrhoeae
LPKSSTYRLKQAIPTACQPNLLRPHIAFESSTGILTCFPSTTHFCLALGADSPYADERCVGNLGLSASGLFTRFIATHVNIRTSDTSSTLYNAPSSAYRTLPYHAGKPASAASVIDLSPVTSSAQDDSTSELLRFL

SEQ ID NO: 1335 - DNA, 1107 bp, Neisseria gonorrhoeae
atgaagttgccgtttaagcggcacactctgtttaacccgtccgaagccgctcaacattttaaggcttcgacaaccatttaccttaaaggaaatcaaatgcaagtctattacgataaagatgccgatctgtccctgatcaaaggcaaaaccgttgccatcatcggttacggttcgcaaggtcatgcccatgctgccaacctgaaagattcgggtgtaaacgtggtgatcggtctgcgccacggctcttcttggaaaaaagccgaagcagccggccatgttgttaaaaccgttgctgaagcgaccaaagaagccgatgtcgttatgctgctgctgcctgacgaaaccatgcctgccgtctatcacgccgaagttgcagccaatttgaaagaaggcgcgacgctggcatttgcacacggcttcaacgtgcactacaaccaaatcgttccgcgtgccgacttggacgtgattatggttgcccccaaaggtccgggtcataccgtacgcagtgaatacaaacgcggcggcggcgtgccttctctgattgccgtttaccaagacaattccggcaaggccaaagacatcgccctgtcttatgcggctgccaacggcggcaccaaaggcggtgtgattgaaaccactttccgcgaagaaaccgaaaccgatctgttcggcgaacaagccgtattgtgcggtggcgtggccgagttgatcaaagcaggttttgaaaccctgaccgaagccggttacgcgcctgaaatggcttacttcgaatgcctgcacgaaatgaaactgatcgttgacctgattttcgaaggcggtattgccaatatgaactactccatttccaacaatgcggagtacggcgaatacgttaccggccctgaagtggtcaatgcttccagcaaagaagccatgcgcaatgccctgaaacgcatccaaaccggcgaatacgcaaaaatgtttatccaagagggtaatgtcaactacgcgtctatgactgcccgccgccgtttgaatgccgaccaccaagttgaaaaagtcggcgcacgactgcgtgccatgatgccttggattacggccaacaaattggttgaccaagacaaaaac

SEQ ID NO: 1336 - protein, 369 aa, Neisseria gonorrhoeae
MKLPFKRHTLFNPSEAAQHFKASTTIYLKGNQMQVYYDKDADLSLIKGKTVAIIGYGSQGHAHAANLKDSGVNVVIGLRHGSSWKKAEAAGHVVKTVAEATKEADVVMLLLPDETMPAVYHAEVAANLKEGATLAFAHGFNVHYNQIVPRADLDVIMVAPKGPGHTVRSEYKRGGGVPSLIAVYQDNSGKAKDIALSYAAANGGTKGGVIETTFREETETDLFGEQAVLCGGVAELIKAGFETLTEAGYAPEMAYFECLHEMKLIVDLIFEGGIANMNYSISNNAEYGEYVTGPEVVNASSKEAMRNALKRIQTGEYAKMFIQEGNVNYASMTARRRLNADHQVEKVGARLRAMMPWITANKLVDQDKN

SEQ ID NO: 1337 - DNA, 483 bp, Neisseria gonorrhoeae
atgaacactcaccaccacccgccctgcccctgcggttcaggcacaagctatgccggctgctgccgaccgcttcatctgcgccaaatcctgccgcccaccgccgaagccctcatacgttcgcggtacggcgcatatgtgctgcaccttatcgactacatcatcgctactaccgttccggcgcaacaaacattcctcgatgccgccgaactgatgcagtggagcagagaagccgaatggctgggcttgaatgtcatcgcacaccgcaacctcggcaaacagcacgcccaagtcgaatttgaagcctacttccaagacggcggaaaccgaacagtgcatcacgagctgtcggcattcgtgaaaatagcggagcaatggtatttcatcgatccgactgttccgctgcctaccatgaaacagccctgcatttgcggttcgggcaaaaaattcaaagcctgctgcggcaaatatctgcaacctgtcgca

SEQ ID NO: 1338 - protein, 161 aa, Neisseria gonorrhoeae
MNTHHHPPCPCGSGTSYAGCCRPLHLRQILPPTAEALIRSRYGAYVLHLIDYIIATTVPAQQTFLDAAELMQWSREAEWLGLNVIAHRNLGKQHAQVEFEAYFQDGGNRTVHHELSAFVKIAEQWYFIDPTVPLPTMKQPCICGSGKKFKACCGKYLQPVA

SEQ ID NO: 1339 - DNA, 105 bp, Neisseria gonorrhoeae
gtggtggtgagtgttcattttgtttgggaatgcaaatgccgtctgaaagggcttcagacggcatggttgaaaagcctgtccgttagggcatcagcatgccgccgt

SEQ ID NO: 1340 - protein, 35 aa, Neisseria gonorrhoeae
VVVSVHFVWECKCRLKGLQTAWLKSLSVRASACRR

SEQ ID NO: 1341 - DNA, 846 bp, Neisseria gonorrhoeae
atgtcagcggcaaaccgcccgccaccatcgagtgggaataaacagcaaacagggctgcaccgtccggcgcagtccttcgattatcggaaaaaaggaaaaaatatgagcacacaagatttaagcggcaaaatcgctttggtaaccggcgcatcgcgcggcatcggcgcggcaattgccgacacactggcggcagccggtgccaaaatcatcggtacggcaaccggcgagagcggtgcggcggcgattagcaaacgtctggcacaatggggcggcgaaggccgcgtattaaattccgccgaacccgaaaccgtcgaaaacctgattgccgacatcgaaaaaacgttcggcaaactcgacattctggtcaacaacgccggcatcacccgcgacaacctgttgatgcgtatgaaagaagaagagtgggacgacatcatgcaggtcaacctcaaatccgtgttccgcgcttctaaagccgtcttgcgcggcatgatgaagcagcgcgccggccgcatcatcaacatcacctccgtcgtcggcgtgatgggcaatgccgggcaaaccaattatgccgccgcaaaagcgggcttgatcggttttgccaaatctatggcgcgcgaagtcggcagccggggcattaccgtcaactgcgtcgccccgggctttatcgataccgatatgacccgcgccctgcccgaagaaacccgccaaacatttaccgcccaaaccgccttgggcagattcggcgacgcgcaagacatcgccgatgcggttctgttcctcgcttccgatcaggcgaaatacattaccggtcaaacgctgcacgtcaacggcggcatgctgatgccc

SEQ ID NO: 1342 - protein, 282 aa, Neisseria gonorrhoeae
MSAANRPPPSSGNKQQTGLHRPAQSFDYRKKGKNMSTQDLSGKIALVTGASRGIGAAIADTLAAAGAKIIGTATGESGAAAISKRLAQWGGEGRVLNSAEPETVENLIADIEKTFGKLDILVNNAGITRDNLLMRMKEEEWDDIMQVNLKSVFRASKAVLRGMMKQRAGRIINITSVVGVMGNAGQTNYAAAKAGLIGFAKSMAREVGSRGITVNCVAPGFIDTDMTRALPEETRQTFTAQTALGRFGDAQDIADAVLFLASDQAKYITGQTLHVNGGMLMP

SEQ ID NO: 1343 - DNA, 1563 bp, Neisseria gonorrhoeae
atgacccaagacaaaatcctcatcctcgacttcggttctcaagttacccggctgattgcccgccgcgtgcgcgaagcccacgtttactgcgaactgcattccttcgatatgcctttggacgaaatcaaagccttcaaccccaaaggcatcatcctttccggcggccctaattctgtttacgaatccgactatcaagccgataccggtatttttgatttgggcattccggttttgggcatctgctacggcatgcagtttatggcgcaccacttgggtggcgaagtgcagcccggcaaccagcgcgaattcggttacgcgcaagtcaaaaccatcgacagcggactgacacgcggcattcaagacgacgcgcccaacacactcgacgtatggatgagccacggcgacaaagtgtccaaactgcccgacggtttcgccgtcatcggcgataccccgtcctgcccgattgcaatgatggaaaacgccgaaaaacaattctacggcatccagttccaccccgaagttacccacaccaaacaaggccgcgccctgttgaaccgctttgtcttggatatttgcggcgcgcaaccgggctggacgatgcccaactacatcgaagaagccgttgccaaaatccgcgaacaagtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaggcaaaatggtgatggatatgttcgcccgcaacttgggtgtgaaagtgatacacgtcgatgccgaagggcagtttatggcgaaactcgccggcgtgaccgaccctgagaaaaaacgcaaaatcatcggcgcggaatttatcgaagtatttgatgccgaagagaaaaaactcaccaacgccaaatggctggcgcaaggcacgatttaccccgacgtaatcgaatccgccggtgcgaaaaccaaaaaagcccacgccatcaaatcccaccacaacgtcggcggcctgcctgaaaatatgaagctcaaactgcttgagcccttgcgcgacttgttcaaagacgaagtgcgcgagttgggcgtggctttgggcctgccgcgcgaaatggtgtaccgccaccccttcccgggccccggtttgggtgtgcgcatcttgggcgaagtgaaaaaagaatacgccgacttgctgcgtcaggcggacgatattttcatccaagaattacgcaatactaccgacgaaaacggcacgtcttggtatgacctgaccagccaggcatttgccgtattcctgcccgtcaaatccgtcggcgtgatgggcgacggccgcacttacgactacgtcgtcgcactgcgcgcagtcatcaccagcgactttatgactgcacactgggcagagctgccatactcactgctcggccgcgtgtccaaccgcatcatcaacgaagtcaaaggcatcaaccgcgtggtgtacgatgtcagcggcaaaccgcccgccaccatcgagtgggaa

SEQ ID NO: 1344 - protein, 521 aa, Neisseria gonorrhoeae
MTQDKILILDFGSQVTRLIARRVREAHVYCELHSFDMPLDEIKAFNPKGIILSGGPNSVYESDYQADTGIFDLGIPVLGICYGMQFMAHHLGGEVQPGNQREFGYAQVKTIDSGLTRGIQDDAPNTLDVWMSHGDKVSKLPDGFAVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 1345 - DNA, 1866 bp, Neisseria gonorrhoeae
atgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctatcttgccgccttcatcgcccccctgatcaaccacggcttttccgcgcccgccgcgccgcccgatctgtccgccgccgccggcatcctttccaccctgcaaaactggcgcgaacagtttacctatatggtttgggggacggaaaacaaaatctggaccgtcccgctctttctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgattgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggcgtatgtgcatttctcgacaccccgcccgaacaggacaaaggcacgctcgcgccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaaccttctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgtccgccctccaagccgccaacctgcaaagcctgatcgacgcatccccgctcggactgcaccagcccatcggatcgaacggcagcaacttatccggcggacagcggcaacgcgtcgccatcgcccgcgccattttgaaagacgcgccgatattattattggacgaagccaccagcgcattggacaacgaatccgaacgcctcgtccaacaagcgctcgaacgcctgatggaaaaccgcaccggcatcatcgtcgcccaccgcctgaccaccgtcgaatccgccgaccgcatcatcgtcatggatggcggcaaaatcatcgaacaaggcacacacgatcaactcatgttccaaaacggctactacaccatgctgaggaacatctccggaaaagataccgccgccgttcagacggca

SEQ ID NO: 1346 - protein, 622 aa, Neisseria gonorrhoeae
MIEKLTFGLFKKEDARSFMRLMAYVRPYKIRIVAALIAIFGVAATESYLAAFIAPLINHGFSAPAAPPDLSAAAGILSTLQNWREQFTYMVWGTENKIWTVPLFLIILVVIRGICRFTSTYLMTWVSVMTISKIRKDMFAKMLTLSSRYHQETPSGTVLMNMLNLTEQSVSNASDIFTVLTRDTMIVTGLTIVLLYLNWQLSLIVVLMFPLLSLLSRYYRDRLKHVISDSQKSIGTMNNVIAETHQGHRVVKLFNGQAQAANRFDAVNRTIVRLSKKITQATAAHSPFSELIASIALAVVIFIALWQSQNGYTTIGEFMAFIVAMLQMYAPIKSLANISIPMQTMFLAADGVCAFLDTPPEQDKGTLAPQRVEGRISFRNVDVEYRSDGIKALDNFNLDIRQGERVALVGRSGSGKSTVVNLLPRFVEPSAGNICIDGIDIADIKLDCLRAQFALVSQDVFLFDDTLFENVRYSRPDAGEAEVLSALQAANLQSLIDASPLGLHQPIGSNGSNLSGGQRQRVAIARAILKDAPILLLDEATSALDNESERLVQQALERLMENRTGIIVAHRLTTVESADRIIVMDGGKIIEQGTHDQLMFQNGYYTMLRNISGKDTAAVQTA

SEQ ID NO: 1347 - DNA, 171 bp, Neisseria gonorrhoeae
ttgacttcgttccgcaaaaagcagcctgccctcttcaggctgcttttcacgtccgaacggcaaacagccgcatatttgcgctataatccatccctaccaaaccaccgacagcggctgccgttgcagttcccgccctaccgatatgatagaaaaactgactttcggactgtt

SEQ ID NO: 1348 - protein, 57 aa, Neisseria gonorrhoeae
LTSFRKKQPALFRLLFTSERQTAAYLRYNPSLPNHRQRLPLQFPPYRYDRKTDFRTV

SEQ ID NO: 1349 - DNA, 924 bp, Neisseria gonorrhoeae
atgtctttcgcattcttcttccccggacaaggttcccaaagcctcggcatgatgaacggctttgccgaacacgtcatcgtcaaaaacacatttgacgaagcctccgccatattggggcaggacttgtgggcgatgattaacggcagcgatgccgaaatcatcggtcaaacagtcaacacccagcccattatgctcgccgccggcgttgccgtttaccgcgcctatttggaagtgggcggcaaaacgcctgccgccgttgccggacacagcctcggcgaatacaccgcgcttgtcgccgccgaagcattggattttgccgatgccgtcaaactcgtccgcctgcgcgccgaactgatgcagtccgccgtaccgcaaggcgtaggcgcaatggcggccattttgggtttggaagatgaacaggtcaggcagatttgtgccgaatccgcacagggcgaagtggtcgaagccgtcaacttcaactcgcccggacaagtcgtgattgcaggcaacgccgccgccgtcggacgcaccatggctgccgccaaagaagccggagccaaacgcgccctgccgctgccggtatccgttccttcccattgcagcctgatgaaacccgccgccgacaaacttgccgaaacactcaaaaccgttgaaatcaagcagccgcaaatccgcgtcatccacaacgccgacgttgccgcctacgatgatgccggcaaaatcaaagacgcgctcgtccgccagctttacagccccgtgcgctggacggaaaccgtcaacgccctcgtttcagacggcattgccgaatccgccgaatgcagcccgggcaaagtgttggcgggcttggcaaaacgcatcaacaaggccgccgcgtgcagcgcactgaccgatgccggacagattaccgcctttatcgaagcgcat

SEQ ID NO: 1350 - protein, 308 aa, Neisseria gonorrhoeae
MSFAFFFPGQGSQSLGMMNGFAEHVIVKNTFDEASAILGQDLWAMINGSDAEIIGQTVNTQPIMLAAGVAVYRAYLEVGGKTPAAVAGHSLGEYTALVAAEALDFADAVKLVRLRAELMQSAVPQGVGAMAAILGLEDEQVRQICAESAQGEVVEAVNFNSPGQVVIAGNAAAVGRTMAAAKEAGAKRALPLPVSVPSHCSLMKPAADKLAETLKTVEIKQPQIRVIHNADVAAYDDAGKIKDALVRQLYSPVRWTETVNALVSDGIAESAECSPGKVLAGLAKRINKAAACSALTDAGQITAFIEAH

SEQ ID NO: 1351 - DNA, 843 bp, Neisseria gonorrhoeae
gtggatgacgcggatttgcggctgcttgatttcaacggttttgagtgtttcggcaagtttgtcggcggcgggtttcatcaggctgcaatgggaaggaacggataccggcagcggcagggcgcgtttggctccggcttctttggcggcagccatggtgcgtccgacggcggcggcgttgcctgcaatcacgacttgtccgggcgagttgaagttgacggcttcgaccacttcgccctgtgcggattcggcacaaatctgcctgacctgttcatcttccaaacccaaaatggccgccattgcgcctacgccttgcggtacggcggactgcatcagttcggcgcgcaggcggacgagtttgacggcatcggcaaaatccaatgcttcggcggcgacaagcgcggtgtattcgccgaggctgtgtccggcaacggcggcaggcgttttgccgcccacttccaaataggcgcggtaaacggcaacgccggcggcgagcataatgggctgggtgttgactgtttgaccgatgatttcggcatcgctgccgttaatcatcgcccacaagtcctgccccaatatggcggaggcttcgtcaaatgtgtttttgacgatgacgtgttcggcaaagccgttcatcatgccgaggctttgggaaccttgtccggggaagaagaatgcgaaagacatagtattcctttgttgggttggattgtcagagatgttgcccgagttttacaaaaagttcgggcggaacgaaataatcaatcaggatgcaggtcgccaggacattgcccgaaacagtcagacggaacagcacaacaaaacgctttttcgccgttttatgcc

SEQ ID NO: 1352 - protein, 281 aa, Neisseria gonorrhoeae
VDDADLRLLDFNGFECFGKFVGGGFHQAAMGRNGYRQRQGAFGSGFFGGSHGASDGGGVACNHDLSGRVEVDGFDHFALCGFGTNLPDLFIFQTQNGRHCAYALRYGGLHQFGAQADEFDGIGKIQCFGGDKRGVFAEAVSGNGGRRFAAHFQIGAVNGNAGGEHNGLGVDCLTDDFGIAAVNHRPQVLPQYGGGFVKCVFDDDVFGKAVHHAEALGTLSGEEECERHSIPLLGWIVRDVARVLQKVRAERNNQSGCRSPGHCPKQSDGTAQQNAFSPFYA

SEQ ID NO: 1353 - DNA, 1116 bp, Neisseria gonorrhoeae
ttggtggtcggcattcaaacggcggcgggcagtcatagacgcgtagttgacattaccctcttggataaacatttttgcgtattcgccggtttggatgcgtttcagggcattgcgcatggcttctttgctggaagcattgaccacttcagggccggtaacgtattcgccgtactccgcattgttggaaatggagtagttcatattggcaataccgccttcgaaaatcaggtcaacgatcagtttcatttcgtgcaggcattcgaagtaagccatttcaggcgcgtaaccggcttcggtcagggtttcaaaacctgctttgatcaactcggccacgccaccgcacaatacggcttgttcgccgaacagatcggtttcggtttcttcgcggaaagtggtttcaatcacaccgcctttggtgccgccgttggcagccgcataagacagggcgatgtctttggccttgccggaattgtcttggtaaacggcaatcagagaaggcacgccgccgccgcgtttgtattcactgcgtacggtatgacccggacctttgggggcaaccataatcacgtccaagtcggcacgcggaacgatttggttgtagtgcacgttgaagccgtgtgcaaatgccagcgtcgcgccttctttcaaattggctgcaacttcggcgtgatagacggcaggcatggtttcgtcaggcagcagcagcataacgacatcggcttctttggtcgcttcagcaacggttttaacaacatggccggctgcttcggcttttttccaagaagagccgtggcgcagaccgatcaccacgtttacacccgaatctttcaggttggcagcatgggcatgaccttgcgaaccgtaaccgatgatggcaacggttttgcctttgatcagggacagatcggcatctttatcgtaatagacttgcatttgatttcctttaaggtaaatggttgtcgaagccttaaaatgttgagcggcttcggacgggttaaacagagtgtgccgcttaaacggcaacttcattcatcaatacgatttccaacgcttcggttttgccgtcgacggactggacgaaggcttggaaatgcgcgctggcattatgttcgtcaa

SEQ ID NO: 1354 - protein, 372 aa, Neisseria gonorrhoeae
LVVGIQTAAGSHRRVVDITLLDKHFCVFAGLDAFQGIAHGFFAGSIDHFRAGNVFAVLRIVGNGVVHIGNTAFENQVNDQFHFVQAFEVSHFRRVTGFGQGFKTCFDQLGHATAQYGLFAEQIGFGFFAESGFNHTAFGAAVGSRIRQGDVFGLAGIVLVNGNQRRHAAAAFVFTAYGMTRTFGGNHNHVQVGTRNDLVVVHVEAVCKCQRRAFFQIGCNFGVIDGRHGFVRQQQHNDIGFFGRFSNGFNNMAGCFGFFPRRAVAQTDHHVYTRIFQVGSMGMTLRTVTDDGNGFAFDQGQIGIFIVIDLHLISFKVNGCRSLKMLSGFGRVKQSVPLKRQLHSSIRFPTLRFCRRRTGRRLGNARWHYVRQ

SEQ ID NO: 1355 - DNA, 93 bp, Neisseria gonorrhoeae
agtaagcaaacttgaaatccctactttgataaagcttactgctttgttgtgtcttaatcctgccttttgtgtttcaggattaagtcgatacaa

SEQ ID NO: 1356 - protein, 4 aa, Neisseria gonorrhoeae
SKQT

SEQ ID NO: 1357 - DNA, 369 bp, Neisseria gonorrhoeae
atgaagcggcaggctttcttcaaaccgatggcgtgtgcggcatttctgtccgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctcctgcctgccttgttcggcggttggacgggcgcatacttgggtagtaggatgttcaggcataaaacggcgaaaaagcgttttgttgtgctgttccgtctgactgtttcgggcaatgtcctggcgacctgcatcctgattgattatttcgttccgcccgaactttttgtaaaactcgggcaacatctc

SEQ ID NO: 1358 - protein, 123 aa, Neisseria gonorrhoeae
MKRQAFFKPMACAAFLSAVSLRLPVLGACYAILSLYAFALYGIDKRRAVRGKRRIPEHRLLLPALFGGWTGAYLGSRMFRHKTAKKRFVVLFRLTVSGNVLATCILIDYFVPPELFVKLGQHL

SEQ ID NO: 1359 - DNA, 960 bp, Neisseria gonorrhoeae
atgcagtatgcaaaaatttccggcacgggcagctatcttcctgccaaccgcgtcagcaatgacgaccttgcccaaaaggtagatacctctgacgagtggattaccgcgcgtacgggcatcaaattccgccatattgcagccgaaaacgaaaaaaccagcgatcttgcagccgaagcggcgcggcgcgctttggcagatgccaaattaaatataaacgacattgatttgattatcgtggcgacggcaacgccggatatgcagtttccttctaccgccaccatcgtgcagcaaaaattgggcatcaccaacggctgccccgcgtttgacgtgcaggcggtgtgcgcaggctttatgtacgcgctgactacggcaaatgcctacattaaaagcggtatggcgaaaaacgcgctggtcatcggcgcggaaaccttcagccgcatcgtcgattggaacgaccgcacaacctgcgtgctgttcggcgacggcgcgggcgcggtggttttaagcgcgtccgacaaaccgggcatcatccacagcaaactcaaagccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgaacaaatcgactggattgttccccatcaggcaaaccgccgcattatcgaatcgaccgcgaaacatttgggtttgagtatggacaaagtcgtcctgaccgtccaagaccacggcaacacgtccgccgcatccattccgctggctttggacgcgggcatccgcagcggacaaatcaaacgcggtcaaaacctgctgctcgaaggcataggcggcggtttcgcgtggggcgcggtgctgttgcaatat

SEQ ID NO: 1360 - protein, 320 aa, Neisseria gonorrhoeae
MQYAKISGTGSYLPANRVSNDDLAQKVDTSDEWITARTGIKFRHIAAENEKTSDLAAEAARRALADAKLNINDIDLIIVATATPDMQFPSTATIVQQKLGITNGCPAFDVQAVCAGFMYALTTANAYIKSGMAKNALVIGAETFSRIVDWNDRTTCVLFGDGAGAVVLSASDKPGIIHSKLKADGNYLKLLNVPGQIACGKVSGSPYISMDGPGVFKFAVKMLSKIADDVIEEAGYTAEQIDWIVPHQANRRIIESTAKHLGLSMDKVVLTVQDHGNTSAASIPLALDAGIRSGQIKRGQNLLLEGIGGGFAWGAVLLQY

SEQ ID NO: 1361 - DNA, 201 bp, Neisseria gonorrhoeae
atgccgtctgaagcagcttgggctttcagacggcatttccttcacttaaaacagcgtatcggcaaccccgccccgcccgtccacggcaatccgcatctgaaaaccatctgtatgccaaaccacacccccatccctgtttccgtcatttgcaccctgcccgtattgggcaatcatcggtttttcgcttacaatagccgaatc

SEQ ID NO: 1362 - protein, 67 aa, Neisseria gonorrhoeae
MPSEAAWAFRRHFLHLKQRIGNPAPPVHGNPHLKTICMPNHTPIPVSVICTLPVLGNHRFFAYNSRI

SEQ ID NO: 1363 - DNA, 231 bp, Neisseria gonorrhoeae
atgccgtctgaaagcccaagctgcttcagacggcatcttgattgttgggtttccatcaaattatattggtgccggtgtttgtttttgtctgataaattcggaaatgatattttgaattgtagaaatatttttagagatatgttcaatagggtaggaatctcccaagatttcccttaccttcccgctgtaattttctgttttaaggttttttactttaatatccccgccttc

SEQ ID NO: 1364 - protein, 77 aa, Neisseria gonorrhoeae
MPSESPSCFRRHLDCWVSIKLYWCRCLFLSDKFGNDILNCRNIFRDMFNRVGISQDFPYLPAVIFCFKVFYFNIPAF

SEQ ID NO: 1365 - DNA, 192 bp, Neisseria gonorrhoeae
ttgccaataattcaaacaattttagaaggcggggatattaaagtaaaaaaccttaaaacagaaaattacagcgggaaggtaagggaaatcttgggagattcctaccctattgaacatatctctaaaaatatttctacaattcaaaatatcatttccgaatttatcagacaaaaacaaacaccggcaccaata

SEQ ID NO: 1366 - protein, 64 aa, Neisseria gonorrhoeae
LPIIQTILEGGDIKVKNLKTENYSGKVREILGDSYPIEHISKNISTIQNIISEFIRQKQTPAPI

SEQ ID NO: 1367 - DNA, 288 bp, Neisseria gonorrhoeae
ttgataagaatgaaaacatcgacggtcgtttttggcggattttttatggcagacaacggggagcgaatccaaatccccgttttggaaaatcctgacattagggaaatcaatcgctttttttccgtatcaaattttgagaaaaaagccggcgtccttgttttcagaatcatccccgagccggaatttggcaataccgaattaactgtctattttgaaaaaggatattatagtggattaacaaaaaccggtacggcgttgccccgccttagctcaaagagaacgattccc

SEQ ID NO: 1368 - protein, 96 aa, Neisseria gonorrhoeae
LIRMKTSTVVFGGFFMADNGERIQIPVLENPDIREINRFFSVSNFEKKAGVLVFRIIPEPEFGNTELTVYFEKGYYSGLTKTGTALPRLSSKRTIP

SEQ ID NO: 1369 - DNA, 147 bp, Neisseria gonorrhoeae
ttgtgtcttaatcctgccttttgtgtttcaggattaagtcgatacaatcatcacccaaatactatgtttgttttcttttctcttgcgagaggtttttatcctttgcaaagaataaaaaatcaaaacaaactcattgtctttgtttgt

SEQ ID NO: 1370 - protein, 49 aa, Neisseria gonorrhoeae
LCLNPAFCVSGLSRYNHHPNTMFVFFSLARGFYPLQRIKNQNKLIVFVC

SEQ ID NO: 1371 - DNA, 354 bp, Neisseria gonorrhoeae
gtgtgccgcttaaacggcaacttcattcatcaatacgatttccaacgcttcggttttgccgtcgacggactggacgaaggcttggaaatgcgcgctggcattatgttcgtcaatagctgcttgggatttccaattttccacgaaaacaaaacggttcggtttgccgatttcctgatggagattgtagctgatgttgccctcttccgcacggctggctttgaccagttctttaaactgtgctgccagtgtttccgtgtattccggtttgacggtaaccagtgcgacaattttaatgttcgacataaatctctcctgccgttcgtttttcagacggcattcaaataccatgccgtc

SEQ ID NO: 1372 - protein, 118 aa, Neisseria gonorrhoeae
VCRLNGNFIHQYDFQRFGFAVDGLDEGLEMRAGIMFVNSCLGFPIFHENKTVRFADFLMEIVADVALFRTAGFDQFFKLCCQCFRVFRFDGNQCDNFNVRHKSLLPFVFQTAFKYHAV

SEQ ID NO: 1373 - DNA, 1035 bp, Neisseria gonorrhoeae
atgccgtttctcaaccatagacgacaactggacatattgatgaagattgcgatttacggtacgaaaagctatgaccgcgaacattttacccgcgccaaccggcatttcggcttcgagctggagttttttgatttcatgctggatgcgaaaacggcgaaaatggcggaaggcgcggaagcggcctgtatttttgtaaacgacgacgccagccggcccgtgttggaaaaattggcgcaaattggcgtgaaaactgtggcgttgcgttgtgccggcttcaataatgtggatttgaaggcggctgaagagttgggcttgaaagtcgtgcgcgtgcctgcctattcgcccgaatcggttgcggaacatacggtcggtctgatgctgactttgaaccgccgtatccacaaagcctaccagcgtacccgcgatgcgaatttttcgctggaaggtctgaccggcttcaatatgtacggcaaaacggcgggcgttatcggcacggggaaaatcggtatcgcaacgatgcggattttaaagggtttcggtatgaacctgctggcttacgatccgttttgcaaccccgaagtggaaaaactcggcggcaggtatgtggatttggacgagctgtatgcccgatcggacatcatcacgctgcattgtcccgccacgccggaaaaccactatatgctgaacgaagcggcgttcgacaaaatgaaagacggcgtgatgattatcaacaccagccggggcgggctgattgacagcgccgccgccatcgaggcgttgaaatgccggaaaatcggtgcattgggcatggatgtgtacgagaacgagcgcgagctgttttttgaagacaaatccaacgatgtgattaccgacgacgtgttccgccgcctgtcgtcttgtcataacgtactgtttaccggacatcaggcatttttgacggaagaggcgttgggtaatatttcggaagttacgctgtccaatatccgcgaggtcggacagaccggcgattgcggcaatgcggttcgtgccgacggt

SEQ ID NO: 1374 - protein, 345 aa, Neisseria gonorrhoeae
MPFLNHRRQLDILMKIAIYGTKSYDREHFTRANRHFGFELEFFDFMLDAKTAKMAEGAEAACIFVNDDASRPVLEKLAQIGVKTVALRCAGFNNVDLKAAEELGLKVVRVPAYSPESVAEHTVGLMLTLNRRIHKAYQRTRDANFSLEGLTGFNMYGKTAGVIGTGKIGIATMRILKGFGMNLLAYDPFCNPEVEKLGGRYVDLDELYARSDIITLHCPATPENHYMLNEAAFDKMKDGVMIINTSRGGLIDSAAAIEALKCRKIGALGMDVYENERELFFEDKSNDVITDDVFRRLSSCHNVLFTGHQAFLTEEALGNISEVTLSNIREVGQTGDCGNAVRADG

SEQ ID NO: 1375 - DNA, 255 bp, Neisseria gonorrhoeae
atgttttcattcttatcaaatcattggctttattggttaatcggacgtgctttctatctcaaattccttgttgataaaagaaatttcccgggattcttgttccgtcagccggatatcgaaatcttcgatataagtacacaggatgtcaaaagccaaaaaacgttccgaataatgaatataatccaatgcggattcaatcagacgggcatcaagcctgccttcaagggattttccgaacttcatcatccgtttgtc

SEQ ID NO: 1376 - protein, 85 aa, Neisseria gonorrhoeae
MFSFLSNHWLYWLIGRAFYLKFLVDKRNFPGFLFRQPDIEIFDISTQDVKSQKTFRIMNIIQCGFNQTGIKPAFKGFSELHHPFV

SEQ ID NO: 1377 - DNA, 249 bp, Neisseria gonorrhoeae
atgaagacattagaaaaacggatgaaagctctagacaaacggatgatgaagttcggaaaatcccttgaaggcaggcttgatgcccgtctgattgaatccgcattggattatattcattattcggaacgttttttggcttttgacatcctgtgtacttatatcgaagatttcgatatccggctgacggaacaagaatcccgggaaatttcttttatcaacaaggaatttgagatagaaagcacgtccgat

SEQ ID NO: 1378 - protein, 83 aa, Neisseria gonorrhoeae
MKTLEKRMKALDKRMMKFGKSLEGRLDARLIESALDYIHYSERFLAFDILCTYIEDFDIRLTEQESREISFINKEFEIESTSD

SEQ ID NO: 1379 - DNA, 939 bp, Neisseria gonorrhoeae
atgaccggcgacgaaacgcagctccgccaagccctgaacgcggcaggcgcgccgatggaacgcatcgacatctgccataccacccaagttgtcggcatggatgaatcccctcagtccgccctaaagaacaaaaaatactcctccatgcgcgttgccatcaaccaagttaaagaaggcaaagcccaagccgccgtatccgcaggcaacacgggcgcgctcatggcaaccgcacgtttcgtcctcaagaccatacccggcatcgaacgccccgccatcgccaaattccttccttccgacaccgaccacgttaccctcgccctcgacctcggcgcaaacgtcgactgcacacccgaacagcttgcccaatttgccgtcatcggcagcgaactcgtccacgcgctccatcctcaaaaaggacagccgcgcgtcgggctggtcaacgtcggcacagaagacatcaaaggtacggataccgtcaaacaaacctacaaactgctgcaaaacagcaaactcaactttatcggcaacatcgaaagcaacggcatcctgtacggcgaagcagatgtcgtcgtcgccgacggctttgtcggcaacgtcatgctcaaaaccatcgaaggcgcagtcaaattcatgagcggagccatccgccgcgaattccagagcaacctgttcaacaaacttgccgccgttgccgccctacccgccctcaaaggcttgaaaaacaaactcgatccgcgcaaattcaacggggccatcctgctcgggctgcgcggcatcgtcatcaaaagccacggcggcacagacaaaaccggtttccgctacgcactcgaagaagcctaccacgaagccaagtccgccggcctttccaaaatcgaacaaggcgttgccgaacaactcgccgcactggaagccgcccaaaacgaaaccgccgccagtctg

SEQ ID NO: 1380 - protein, 313 aa, Neisseria gonorrhoeae
MTGDETQLRQALNAAGAPMERIDICHTTQVVGMDESPQSALKNKKYSSMRVAINQVKEGKAQAAVSAGNTGALMATARFVLKTIPGIERPAIAKFLPSDTDHVTLALDLGANVDCTPEQLAQFAVIGSELVHALHPQKGQPRVGLVNVGTEDIKGTDTVKQTYKLLQNSKLNFIGNIESNGILYGEADVVVADGFVGNVMLKTIEGAVKFMSGAIRREFQSNLFNKLAAVAALPALKGLKNKLDPRKFNGAILLGLRGIVIKSHGGTDKTGFRYALEEAYHEAKSAGLSKIEQGVAEQLAALEAAQNETAASL

SEQ ID NO: 1381 - DNA, 111 bp, Neisseria gonorrhoeae
ttggggcttttggaatattttcacggggtattatacggaacgctttgcccctgtgtgttgacgtatggcgaaagtttggacggatggtgcgtccaatgcaaaaaaagccag

SEQ ID NO: 1382 - protein, 37 aa, Neisseria gonorrhoeae
LGLLEYFHGVLYGTLCPCVLTYGESLDGWCVQCKKSQ

SEQ ID NO: 1383 - DNA, 525 bp, Neisseria gonorrhoeae
atgaaacagaaaatctggtacacctacgatgacatccaccgcgtcatcaaagcattggcagaaaaaatccggaacgccggcgtcaaatacgatgccatgatcgctatcggcggcggcggctttattccggcacgcatgctgcgctgttttctggaaattccgatttatgccgtaaccaccgcctattacgacagcgacagcgaaggacaagttaccgaagaagtcaaaaaagtccaatggctagaccccgtccccgaagtcctgcggggcaaaaacgtgctcgtcgtcgatgaagtggacgacagccgcgtaaccatggagttctgcctgaaagaactgctcaaggaagacttcgacactgtcggcgtcgccgtcctgcacgaaaaaatcaaagccaaagcaggcaaaatccccgaaggcattccctatttcagcggcattaccgtagaagactggtggatcaactatccgtgggacgcactcgacatcgacgaacacaaccgccttgccgaagccgatcgaggc

SEQ ID NO: 1384 - protein, 175 aa, Neisseria gonorrhoeae
MKQKIWYTYDDIHRVIKALAEKIRNAGVKYDAMIAIGGGGFIPARMLRCFLEIPIYAVTTAYYDSDSEGQVTEEVKKVQWLDPVPEVLRGKNVLVVDEVDDSRVTMEFCLKELLKEDFDTVGVAVLHEKIKAKAGKIPEGIPYFSGITVEDWWINYPWDALDIDEHNRLAEADRG

SEQ ID NO: 1385 - DNA, 180 bp, Neisseria gonorrhoeae
ttgtctttgtttgttgatttcggctttccaatttgttaaagatcgatgcgtcgttattctacttcgcaaatcaaaataagctgctaaaaacagcaaacttgctttcatttgtaaagttttggtggaggcaaacgggatcgaaccgatgaccccctgcttgcaaagcaggtgctctaccaa

SEQ ID NO: 1386 - protein, 12 aa, Neisseria gonorrhoeae
LSLFVDFGFPIC

SEQ ID NO: 1387 - DNA, 99 bp, Neisseria gonorrhoeae
ttgtgttttgaaatggaaatgccgtgcatgaaatcaattttaatccgccatattctactgatttgtttgaattcggtgtattatgccgtttctcaacca

SEQ ID NO: 1388 - protein, 33 aa, Neisseria gonorrhoeae
LCFEMEMPCMKSILIRHILLICLNSVYYAVSQP

SEQ ID NO: 1389 - DNA, 336 bp, Neisseria gonorrhoeae
atggtatttgaatgccgtctgaaaaacgaacggcaggagagatttatgtcgaacattaaaattgtcgcactggttaccgtcaaaccggaatacacggaaacactggcagcacagtttaaagaactggtcaaagccagccgtgcggaagagggcaacatcagctacaatctccatcaggaaatcggcaaaccgaaccgttttgttttcgtggaaaattggaaatcccaagcagctattgacgaacataatgccagcgcgcatttccaagccttcgtccagtccgtcgacggcaaaaccgaagcgttggaaatcgtattgatgaatgaagttgccgtt

SEQ ID NO: 1390 - protein, 112 aa, Neisseria gonorrhoeae
MVFECRLKNERQERFMSNIKIVALVTVKPEYTETLAAQFKELVKASRAEEGNISYNLHQEIGKPNRFVFVENWKSQAAIDEHNASAHFQAFVQSVDGKTEALEIVLMNEVAV

SEQ ID NO: 1391 - DNA, 366 bp, Neisseria gonorrhoeae
gtgtaccagattttctgtttcatcggaatttccttggtggttggggcttttggaatattttcacggggtattatacggaacgctttgcccctgtgtgttgacgtatggcgaaagtttggacggatggtgcgtccaatgcaaaaaaagccagtaattgcatggcaatgttctggctttttcagtcagtcgaatagggattattcgcctttggctttgaccactttgcggccgcggtacataccgttgggggagatgtggtgcgggcggtgtacttcgccggttgtgctgtcgacaaacagtgcgggcgcggtcagtgcgtcgtgcgaacggtgcataccgcgtttggaaggggattttttgttttgt

SEQ ID NO: 1392 - protein, 122 aa, Neisseria gonorrhoeae
VYQIFCFIGISLVVGAFGIFSRGIIRNALPLCVDVWRKFGRMVRPMQKKPVIAWQCSGFFSQSNRDYSPLALTTLRPRYIPLGEMWCGRCTSPVVLSTNSAGAVSASCERCIPRLEGDFLFC

SEQ ID NO: 1393 - DNA, 135 bp, Neisseria gonorrhoeae
atgcaccgttcgcacgacgcactgaccgcgcccgcactgtttgtcgacagcacaaccggcgaagtacaccgcccgcaccacatctcccccaacggtatgtaccgcggccgcaaagtggtcaaagccaaaggcgaa

SEQ ID NO: 1394 - protein, 45 aa, Neisseria gonorrhoeae
MHRSHDALTAPALFVDSTTGEVHRPHHISPNGMYRGRKVVKAKGE

SEQ ID NO: 1395 - DNA, 498 bp, Neisseria gonorrhoeae
atgtcagaccctaatttgattgacccggaaatttttgccgccgaaaggcagaacctgcaaggcagttttctgctggaagaattggacgagcgagtcagtttgcacgattatcccgccgacaggcggaacaaaatatcgtttacactgaccggcggtcgcgaccggctgcaacgcctgttcctcgacctgaacgtcaaagccgatatgcccctgatttgccagagatgtatcaaacccatgccgttcatgctcgatgaaagcagccgtatcatcctgttttccgacgaagagtccttggacgaatccatgcttgccgacgaagaactcgaaggcatactgattgaaaaagaactcgacgtgcgcgcattggtagaagaccaaatcctgatgtccctgcccttttcgccgcgacacggacactgcggcaatacccttccggaatccgccaaccaagacaaacccaacccctttgctgttttggcgggtttgaaaagcagt

SEQ ID NO: 1396 - protein, 166 aa, Neisseria gonorrhoeae
MSDPNLIDPEIFAAERQNLQGSFLLEELDERVSLHDYPADRRNKISFTLTGGRDRLQRLFLDLNVKADMPLICQRCIKPMPFMLDESSRIILFSDEESLDESMLADEELEGILIEKELDVRALVEDQILMSLPFSPRHGHCGNTLPESANQDKPNPFAVLAGLKSS

SEQ ID NO: 1397 - DNA, 654 bp, Neisseria gonorrhoeae
gtgtttcggcgcatggctggattttaccgccccttcgggcgtgttttcaacggtaaggaggatgggatgggtttggaactgcctttggttttgggtacgagttcggttttccgccgcgaacagatggaaaggctcggcattgcctttcaggcggcatcccccgattttgacgaaacgccgatgttgggggaatccgcccctcagacggcattgcgccttgccgagggtaaggcgcggtcgttgaccgggcgtttccccggggcgttgattgtcggtgcggaccaggtggcgtggtgcgacggcaggcagtggggcaagccgatgaaccttgccaacgcgcaaaagatgttgatgcatttgagcggcagggagattgagttttacagtgcggtcgttctgctaaatacggttacgggcaggatgcatcggcatatcgataagacggtggtcgtgatgaggcagttggacgagctgcacatcctccgctatttggagcgcgagccggatgcggtttattgttcgtgtgcggcgaaaagcgagggcttgggcgcgctgttgatcgaacggattgaaagtaccgatccgaatgccttgattggtctgccggttttccgtctggtcgattttttgaaaaacgagggcgtggatgttttg

SEQ ID NO: 1398 - protein, 218 aa, Neisseria gonorrhoeae
VFRRMAGFYRPFGRVFNGKEDGMGLELPLVLGTSSVFRREQMERLGIAFQAASPDFDETPMLGESAPQTALRLAEGKARSLTGRFPGALIVGADQVAWCDGRQWGKPMNLANAQKMLMHLSGREIEFYSAVVLLNTVTGRMHRHIDKTVVVMRQLDELHILRYLEREPDAVYCSCAAKSEGLGALLIERIESTDPNALIGLPVFRLVDFLKNEGVDVL

SEQ ID NO: 1399 - DNA, 723 bp, Neisseria gonorrhoeae
atgagtgagggaatgatgtctcctgttttgtatttgattcctacgcctttgggtacgcctgacacgccgtgcctgttgcagcatgaacaacgggcggttgtcgggctgacggattttgtcgtggaagcggaaaaaacggcgcgtgcgcatttgaagcatttggggataacgacgccgatacgcgaactgaatctgcaaacgttgaatgaacacacggatttgaagactttgccggaattgctgaaacctttgcaagaagggcgcagtatggggattgtcagcgaggcgggttgcccggctgttgccgatccgggcgcgaatttggtggcattggcgcataaacacggttttgaagtacggcctttggtcggcccgtccagcctgctgctggcgctgatggcttcgggtgcgaatgggcagaactttgcgtttaatggttatctgccgtctgaaaaaaatgagcgcattcagagtttgaatgctttggagcaacgttcgcggcagtgcggcgagacgcagatttttattgaaacgccttaccgcaatgatgcgctgcttgccgatgcggtggaaaacctgcatcctgaaacgcgcttgtgtacggctacggatttgacgttgccgactcagttggtggtcagtaaaacggttgcggattggcgcaggatgaaggaaatgcccaatctgaaaaaacgcccgacgatttttgtgatgtatgcgggt

SEQ ID NO: 1400 - protein, 241 aa, Neisseria gonorrhoeae
MSEGMMSPVLYLIPTPLGTPDTPCLLQHEQRAVVGLTDFVVEAEKTARAHLKHLGITTPIRELNLQTLNEHTDLKTLPELLKPLQEGRSMGIVSEAGCPAVADPGANLVALAHKHGFEVRPLVGPSSLLLALMASGANGQNFAFNGYLPSEKNERIQSLNALEQRSRQCGETQIFIETPYRNDALLADAVENLHPETRLCTATDLTLPTQLVVSKTVADWRRMKEMPNLKKRPTIFVMYAG

SEQ ID NO: 1401 - DNA, 99 bp, Neisseria gonorrhoeae
ttggcgcaggatgaaggaaatgcccaatctgaaaaaacgcccgacgatttttgtgatgtatgcgggttgaagatttccgccccgatagggggtgaacaa

SEQ ID NO: 1402 - protein, 33 aa, Neisseria gonorrhoeae
LAQDEGNAQSEKTPDDFCDVCGLKISAPIGGEQ

SEQ ID NO: 1403 - DNA, 873 bp, Neisseria gonorrhoeae
atgcaggttttccaccgcatcggcaagcagcgcatcattgcggtaaggcgtttcaataaaaatctgcgtctcgccgcactgccgcgaacgttgctccaaagcattcaaactctgaatgcgctcatttttttcagacggcagataaccattaaacgcaaagttctgcccattcgcacccgaagccatcagcgccagcagcaggctggacgggccgaccaaaggccgtacttcaaaaccgtgtttatgcgccaatgccaccaaattcgcgcccggatcggcaacagccgggcaacccgcctcgctgacaatccccatactgcgcccttcttgcaaaggtttcagcaattccggcaaagtcttcaaatccgtgtgttcattcaacgtttgcagattcagttcgcgtatcggcgtcgttatccccaaatgcttcaaatgcgcacgcgccgttttttccgcttccacgacaaaatccgtcagcccgacaaccgcccgttgttcatgctgcaacaggcacggcgtgtcaggcgtacccaaaggcgtaggaatcaaatacaaaacaggagacatcattccctcactcatcggttaaaaatgccgtccgaacccttcagacggcataaacgggcagttacaaaacatccacgccctcgtttttcaaaaaatcgaccagacggaaaaccggcagaccaatcaaggcattcggatcggtactttcaatccgttcgatcaacagcgcgcccaagccctcgcttttcgccgcacacgaacaataaaccgcatccggctcgcgctccaaatagcggaggatgtgcagctcgtccaactgcctcatcacgaccaccgtcttatcgatatgccgatgcatcctgcccg

SEQ ID NO: 1404 - protein, 291 aa, Neisseria gonorrhoeae
MQVFHRIGKQRIIAVRRFNKNLRLAALPRTLLQSIQTLNALIFFRRQITIKRKVLPIRTRSHQRQQQAGRADQRPYFKTVFMRQCHQIRARIGNSRATRLADNPHTAPFLQRFQQFRQSLQIRVFIQRLQIQFAYRRRYPQMLQMRTRRFFRFHDKIRQPDNRPLFMLQQARRVRRTQRRRNQIQNRRHHSLTHRLKMPSEPFRRHKRAVTKHPRPRFSKNRPDGKPADQSRHSDRYFQSVRSTARPSPRFSPHTNNKPHPARAPNSGGCAARPTASSRPPSYRYADASCP

SEQ ID NO: 1405 - DNA, 177 bp, Neisseria gonorrhoeae
atgccgcagcatgaaaaatgccgtctgaaacctgttcagacggcatttttattgttcaccccctatcggggcggaaatcttcaacccgcatacatcacaaaaatcgtcgggcgttttttcagattgggcatttccttcatcctgcgccaatccgcaaccgttttactgaccaccaac

SEQ ID NO: 1406 - protein, 59 aa, Neisseria gonorrhoeae
MPQHEKCRLKPVQTAFLLFTPYRGGNLQPAYITKIVGRFFRLGISFILRQSATVLLTTN

SEQ ID NO: 1407 - DNA, 1635 bp, Neisseria gonorrhoeae
atggattttaaaagactcacggcgtttttcgccatcgcgctggtgattatgatcggctgggaaaaaatgttccccaccccgaaacccgtccccgcgccccaacaggcggcacaaaaacaggcagcaaccgcttccgccgaagccgcgctcgcgcccgcaacgccgattaccgtaacgaccgacacggttcaagccgttattgatgaaaaaagtggcgacctgcgccggctgaccctgctcaaatacaaagcaaccggcgacgaaaacaaaccgttcgtcctgtttggcgacggcaaagaatacacctacgtcgcccaatccgaacttttggacgcgcagggcaacaacattctgaaaggcatcggctttagcgcaccgaaaaaacagtacaccctcaacggcgacacagtcgaagtccgcctgagcgcgcccgaaaccaacggactgaaaatcgacaaagtctatacctttaccaaagacagctatctggtcaacgtccgcttcgacatcgccaacggcagcggtcaaaccgccaacctgagcgcggactaccgcatcgtccgcgaccacagcgaacccgagggtcaaggctactttacccactcttacgtcggccctgttgtttatacccctgaaggcaacttccaaaaagtcagcttctccgacttggacgacgatgcgaaatccggcaaatccgaggccgaatacatccgcaaaaccccgaccggttggctcggcatgattgaacaccacttcatgtccacctggatcctccaacctaaaggcggccaaagcgtttgcgccgcaggcgactgccgtatcgacatcaaacgccgcagcgacaagctgtacagcgcaagcgtcagcgtgcctttagccgctatccaagccggcgccaaagccgaaactgccgtcaacctgtatgccggtccgcaaaccacatccgttatcgcaaacatcgccgacaacctgcaactggcaaaagactacggtaaagtacactggttcgcatcgccgctcttctggctcctgaaccaactgcacaacattatcggcaactggggctgggcaatcgtcgttttgaccatcatcgtcaaagccgtactgtatccattgaccaacgcctcctaccgttcgatggcgaaaatgcgtgccgccgcacccaaactgcagaccatcaaagaaaaatacggcgacgaccgtatggcgcaacagcaagcgatgatgcagctttacaaagacgagaaaatcaacccgctgggcggctgtctgcctatgctgttgcaaatccccgtcttcatcggcttgtactgggcattgttcgcctccgtagaattgcgccaggcaccttggctgggctggattaccgacctcagccgcgccgacccctactacatcctgcccatcattatggcggcaacgatgttcgcccaaacctatctgaacccgccgccgaccgacccgatgcaggcgaaaatgatgaaaatcatgccgttggttttctccgtcatgttcttcttcttccctgccggtttggttctctactgggtggtcaacaacctcctgaccatcgcccagcagtggcacatcaaccgcagcatcgaaaaacaacgcgcccaaggcgaagtcgtttcc

SEQ ID NO: 1408 - protein, 545 aa, Neisseria gonorrhoeae
MDFKRLTAFFAIALVIMIGWEKMFPTPKPVPAPQQAAQKQAATASAEAALAPATPITVTTDTVQAVIDEKSGDLRRLTLLKYKATGDENKPFVLFGDGKEYTYVAQSELLDAQGNNILKGIGFSAPKKQYTLNGDTVEVRLSAPETNGLKIDKVYTFTKDSYLVNVRFDIANGSGQTANLSADYRIVRDHSEPEGQGYFTHSYVGPVVYTPEGNFQKVSFSDLDDDAKSGKSEAEYIRKTPTGWLGMIEHHFMSTWILQPKGGQSVCAAGDCRIDIKRRSDKLYSASVSVPLAAIQAGAKAETAVNLYAGPQTTSVIANIADNLQLAKDYGKVHWFASPLFWLLNQLHNIIGNWGWAIVVLTIIVKAVLYPLTNASYRSMAKMRAAAPKLQTIKEKYGDDRMAQQQAMMQLYKDEKINPLGGCLPMLLQIPVFIGLYWALFASVELRQAPWLGWITDLSRADPYYILPIIMAATMFAQTYLNPPPTDPMQAKMMKIMPLVFSVMFFFFPAGLVLYWVVNNLLTIAQQWHINRSIEKQRAQGEVVS

SEQ ID NO: 1409 - DNA, 132 bp, Neisseria gonorrhoeae
cgacacgagctgacgacagccatgcagcacctgtgttacggctcccgaaggcactcctccgtctccggaggattccgcacatgtcaaaaccaggtaaggttcttcgcgttgcatcgaattaatccacatcat

SEQ ID NO: 1410 - protein, 44 aa, Neisseria gonorrhoeae
RHELTTAMQHLCYGSRRHSSVSGGFRTCQNQVRFFALHRINPHH

SEQ ID NO: 1411 - DNA, 489 bp, Neisseria gonorrhoeae
atgcgacatatcttatctgttctgatcgaaaacgaatcaggtgcgatgagccgcgtggtcggtttgttctctgcacgcgattacaatatcgattctttggcggttgcgccgaccgaagacaaaaccctgtcacggatgaccatcgttacccacggcgacgagcaggttatcgaacaaatcaccaagcaactcaataaattgattgaagtgattaaagtggtcgatttgaacgaaagccgttttgtcgaacgcgaactgatgttggtaaaagtccgtgccgccggcaaagaccgcgacgaatttttacgcttgaccgaaatctaccggggcagcatcatcgacgtaaccgaccgcagctatacgattgaaattaccggctcgaccgacaagctggattcctttttggaaacggtcggacgcgcccaaattttggaaaccgtacgtacaggtgcggccggcatcggtcgcggtgagcgtattttgaaaatt

SEQ ID NO: 1412 - protein, 163 aa, Neisseria gonorrhoeae
MRHILSVLIENESGAMSRVVGLFSARDYNIDSLAVAPTEDKTLSRMTIVTHGDEQVIEQITKQLNKLIEVIKVVDLNESRFVERELMLVKVRAAGKDRDEFLRLTEIYRGSIIDVTDRSYTIEITGSTDKLDSFLETVGRAQILETVRTGAAGIGRGERILKI

SEQ ID NO: 1413 - DNA, 342 bp, Neisseria gonorrhoeae; identical to SEQ ID NO: 123

SEQ ID NO: 1414 - protein, 114 aa, Neisseria gonorrhoeae; identical to SEQ ID NO: 124

SEQ ID NO: 1415 - DNA, 423 bp, Neisseria gonorrhoeae
gtgccaaactccgccgtcgatatgaactcttgggcggaatcaagcctgttatccccggagtaccttttatccgttgagcgatggcccttccatacagaaccaccggatcactatgtcctgctttcgcacctgcccgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtattttcaaggacgactccacagagactggcgtctttgcttccaagccttccacctatcctacacaagtgacttcaaagtccaatgcaaagctacag

SEQ ID NO: 1416 - protein, 141 aa, Neisseria gonorrhoeae
VPNSAVDMNSWAESSLLSPEYLLSVERWPFHTEPPDHYVLLSHLPDLSVSQLSYLLPLHYQSDFRPDLGNLRTPPLRFGRRPPQSNCLPCTVPDPDDGSGLEPQRHQGGIFKDDSTETGVFASKPSTYPTQVTSKSNAKLQ

SEQ ID NO: 1417 - DNA, 2253 bp, Neisseria gonorrhoeae
atgggacagtacaagaagctgtggtacttgctgtttgccgttctggcggtatgctttaccattcttggctatatgggcagcgaggtttataagaaagccccgccttaccccgaacaggtcgtttccgcatccggcaaagtgctgatgacgaaagacgatattttggcaggtcagtctgcgtggcagagtaccggcggcatggaagtcggttcgattctgggtcacggcgcatatcaggctccggactggacggccgactggctgcatcgtgagttgtccgcctggttggatttgaccgcgcaacagacttacggcaaaaaattcgatgaagtttcccctgaagaacaagccgttctgaaaacccgcttggccgatgaataccgcaatcaaagccgtattaaagaagacggcagcgtcgtcatcagcgatacgcgcgtgaaagccatcgaaagcatcctgccttactatcacggcgtttacggcgatgatcccaagttgcaaaccacccgcgaacactttgcaatgaaaaacaacacattgccaagccaagaagcgcgtgaaaaactgttcgacttcttcttctggacttcttggtctgcttcgaccaaccgtcccggcgaggtctttacctacaccaacaactggccgcacgagcctttgatcaacaatgtaccgactactgaaaactacatgtggtcgtttaccagtgtcgtactgctcttgatgggcatcggtttgttgatgtggggttattccttcctgaccaaacacgaggaagtggaagtgccgtctgaagacccgatttccaaaatccaactgaccccttcgcaaaaagcattgggcaaatacgtcttcctgacggtcgccctgtttgtggtacaagtattgctgggcggcctgaccgcgcactacaccgtcgaaggtcagggtttctacggcattgacgaggcgttgggctttgaaatgtccgactggttcccctacgccctgacccgtacttggcacatccaatccgccatcttctggattgcaaccggctttttgacggcaggtttgttcctcgcgccgattgtcaacggcggcaaagatcccaagttccaacgtgcaggcgtgaacttcctctatatcgccctcttcatcgtggtcggcggttcttacgcgggcaacttcttcgcgttgacgcacatccttcctcccgaatttaacttctggttcggacaccaaggttacgaatacctcgatttgggacgtttctggcaactccttttgatggtcggactgctgttgtggctgttcctgatgttgcgctgcacggtttccgccttcaaagaaaaaggcgtggacaaaaacttgctggcaatctttgtcgcttctatggtcggcgtgggcgtgttctacgcaccgggcctgttctatggcgaaaaatccccgattgccgtaatggaatactggcgttggtgggtggtccacctgtgggtggaaggcttctttgaagtatttgccactgccgcctttgcctttgtcttctacaatatgggctttgtccgccgcagtaccgccactgcctccactttggccgctgccgccatctttatgttgggcggcgttccgggcacgctgcaccacctgtacttctccggctctacctccgcctctatggcaatcggcgcctgcttctccgctttggaagtcgtgccgctggtgttgctgggccgcgaggcatacgagcactggtcttaccaacacctgtccgactgggcgaaacgcctgcgttggccgctgatgtgcttcgtggcagtcgctttttggaatatgatcggtgccggcgtattcggctttctgatcaatccgccgatttccctgttctatatccaaggtttgaacacttccgccgttcacgcgcacgccgccttgttcggtgtgtacggtttcttggcattgggcttcgtattgttggttgcgcgctacttgaaaccgaacgcgcggtttgacgacaaactgatgacttggggcttctggctgctcaacggcggcttggtcggtatgattgccatcagcctgctgcctgtcggcgtgattcaggcatacgcctctatcacgcacggtttgtggtatgcccgcagcgaagaattcctgcaaatggaaatcctcgacaccctgcgctgggtacgcactgcccccgacttaatctttatcggcggtgcaatctgcgttgccatccaagccactaaaatcgtattcggccgcgacaaa

SEQ ID NO: 1418 - protein, 751 aa, Neisseria gonorrhoeae
MGQYKKLWYLLFAVLAVCFTILGYMGSEVYKKAPPYPEQVVSASGKVLMTKDDILAGQSAWQSTGGMEVGSILGHGAYQAPDWTADWLHRELSAWLDLTAQQTYGKKFDEVSPEEQAVLKTRLADEYRNQSRIKEDGSVVISDTRVKAIESILPYYHGVYGDDPKLQTTREHFAMKNNTLPSQEAREKLFDFFFWTSWSASTNRPGEVFTYTNNWPHEPLINNVPTTENYMWSFTSVVLLLMGIGLLMWGYSFLTKHEEVEVPSEDPISKIQLTPSQKALGKYVFLTVALFVVQVLLGGLTAHYTVEGQGFYGIDEALGFEMSDWFPYALTRTWHIQSAIFWIATGFLTAGLFLAPIVNGGKDPKFQRAGVNFLYIALFIVVGGSYAGNFFALTHILPPEFNFWFGHQGYEYLDLGRFWQLLLMVGLLLWLFLMLRCTVSAFKEKGVDKNLLAIFVASMVGVGVFYAPGLFYGEKSPIAVMEYWRWWVVHLWVEGFFEVFATAAFAFVFYNMGFVRRSTATASTLAAAAIFMLGGVPGTLHHLYFSGSTSASMAIGACFSALEVVPLVLLGREAYEHWSYQHLSDWAKRLRWPLMCFVAVAFWNMIGAGVFGFLINPPISLFYIQGLNTSAVHAHAALFGVYGFLALGFVLLVARYLKPNARFDDKLMTWGFWLLNGGLVGMIAISLLPVGVIQAYASITHGLWYARSEEFLQMEILDTLRWVRTAPDLIFIGGAICVAIQATKIVFGRDK

SEQ ID NO: 1419 - DNA, 132 bp, Neisseria gonorrhoeae
atgccgcaggttgcgtgttccgatagacggggaataagggcgggcttcatacccgacggccgtgccgccagcccgaaggttcagacggcattatatagaaaccgatgggaaataaaaggaaagcgtgcaatt

SEQ ID NO: 1420 - protein, 44 aa, Neisseria gonorrhoeae
MPQVACSDRRGIRAGFIPDGRAASPKVQTALYRNRWEIKGKRAI

SEQ ID NO: 1421 - DNA, 219 bp, Neisseria gonorrhoeae
atgaacttcctattgtccaaactgctgctggggctgataaggttttaccaatactgcatcagcccgctgattccgccgcgctgccgttatacgccgacctgttcgcaatacgcggtcgaagcggtcaaaaaatacggcgcattcaaaggcctccggctcgccatcaagcgcattgcacgctgccaccctttcggcggacacggacacgaccccgttccc

SEQ ID NO: 1422 - protein, 73 aa, Neisseria gonorrhoeae
MNFLLSKLLLGLIRFYQYCISPLIPPRCRYTPTCSQYAVEAVKKYGAFKGLRLAIKRIARCHPFGGHGHDPVP

SEQ ID NO: 1423 - DNA, 132 bp, Neisseria gonorrhoeae
atgaaacgcacttatcaaccttccgttaccaaacgcaaacgcacccacggcttcctcgtgcgctccaaaacacgcggcggacgcgcagtattggccgcacgccgtgccaaaggccgcaaacgcctggcagtg

SEQ ID NO: 1424 - protein, 44 aa, Neisseria gonorrhoeae
MKRTYQPSVTKRKRTHGFLVRSKTRGGRAVLAARRAKGRKRLAV

SEQ ID NO: 1425 - DNA, 570 bp, Neisseria gonorrhoeae
ttgacaaaagcggcaaattggagtgtaattcacggtttaattatctacccattctattttaggaaccatcatgaaacgcacttatcaaccttccgttaccaaacgcaaacgcacccacggcttcctcgtgcgctccaaaacacgcggcggacgcgcagtattggccgcacgccgtgccaaaggccgcaaacgcctggcagtgtaattttggactaccgcttcggaaggcagtaccgcttgttaaaaacggatgatttttcatccgtttttgcattcagaaaccgccgcagccgcgacctgctgcaagtttcgcgctcaaacggcaacgggctggaccatccccgcatcggtctggtggtcggcaaaaaaaccgccaaacgcgccaacgagcggaactatatgaaacgcgtcatccgcgactggttcagattgaacaaaaaccggctgccgcctcaggatttcgtcgtgcgcgtccgccggaaattcgacagggctaccgcaaaacaggcaagggcggaactggcacaactcatgttcggcaaccccgcaaccggatgcgggaaacaggta

SEQ ID NO: 1426 - protein, 190 aa, Neisseria gonorrhoeae
LTKAANWSVIHGLIIYPFYFRNHHETHLSTFRYQTQTHPRLPRALQNTRRTRSIGRTPCQRPQTPGSVILDYRFGRQYRLLKTDDFSSVFAFRNRRSRDLLQVSRSNGNGLDHPRIGLVVGKKTAKRANERNYMKRVIRDWFRLNKNRLPPQDFVVRVRRKFDRATAKQARAELAQLMFGNPATGCGKQV

SEQ ID NO: 1427 - DNA, 189 bp, Neisseria gonorrhoeae
ttgcctgcggatttctgccgcctttctgtggataaatttttgcacgggttgtggataaaatatcggcgagtcggtataatcggttcgctgcgttttgaaccgacgcgtattcaacagatttgttttctttttgaaaatattatattttctttgttttcgatttcatttttaccgattcgagcctatcca

SEQ ID NO: 1428 - protein, 63 aa, Neisseria gonorrhoeae
LPADFCRLSVDKFLHGLWIKYRRVGIIGSLRFEPTRIQQICFLFENIIFSLFSISFLPIRAYP

SEQ ID NO: 1429 - DNA, 222 bp, Neisseria gonorrhoeae
ttgaatacgaaaggcgggacggccggcagccaactcttcccttaccgcttctatttttccggcaaactggctcttgagcatattgcaggcaaactggttcttgccgtacaccacccatacgccaccctcctcaccaaccgtaaggggcgcaatccattgcgcaaactgcccgtgaggcaacatatcgtgaagacggcggaggcacagcggccaaaactctgc

SEQ ID NO: 1430 - protein, 74 aa, Neisseria gonorrhoeae
LNTKGGTAGSQLFPYRFYFSGKLALEHIAGKLVLAVHHPYATLLTNRKGRNPLRKLPVRQHIVKTAEAQRPKLC

SEQ ID NO: 1431 - DNA, 252 bp, Neisseria gonorrhoeae
atgacattagcagagttttggccgctgtgcctccgccgtcttcacgatatgttgcctcacgggcagtttgcgcaatggattgcgccccttacggttggtgaggagggtggcgtatgggtggtgtacggcaagaaccagtttgcctgcaatatgctcaagagccagtttgccggaaaaatagaagcggtaagggaagagttggctgccggccgtcccgcctttcgtattcaaaccgggagaaggcgtgcgtta

SEQ ID NO: 1432 - protein, 84 aa, Neisseria gonorrhoeae
MTLAEFWPLCLRRLHDMLPHGQFAQWIAPLTVGEEGGVWVVYGKNQFACNMLKSQFAGKIEAVREELAAGRPAFRIQTGRRRAL

SEQ ID NO: 1433 - DNA, 1299 bp, Neisseria gonorrhoeae
atggcggcggttgaaggtgctgtcgaacctgccgagccgtccttgcacgcggggtcggaggagatgcccgtgcaggaggttctgttggacgagctgccgtctgaaaagcctgtcaaacccgctgcgtcgaaaacggcggcggatattttggcggaacgtatgaaaaacctgccgcacgagccgcgtcaggctgccgggcctgcttcccggccggaatcggcggcagttgccaaagcgcggacggatgcgcagcgtgatgcggaagaagcgcgttacgaacaaaccaacctgtctccggattacacgtttgatacgttggtagaaggtaagggcaaccgccttgcggcggctgcggcgcaggcgattgcggaaaacccggggcagagttacaacccgttcttcctgtacggcagcacgggtttgggcaaaacccaccttgtgcaggcggtcggcaacgagctgttgaaaaaccgtcccgatgccaaagtgcgctatatgcattcggacgactacatccgcagctttatgaaggcggttcgcaacaatacctacgacgtgttcaagcagcaatacaagcaatacgacctgctgattatcgacgatattcagttcatcaaaggaaaagaccgtacgatggaagaatttttctatctgtacaaccattttcacaatgagaaaaaacagctcatcctcacttgcgatgttttacccgccaaaatcgaaggtatggacgaccgcctcaaatcccgcttttcgtgggggctgactttggaactcgagccgcccgaattggaaatgcgtatcgccattttgcagaaaaaggcggaagcggcgggcatcagtatcgaagacgaagccgcgctgttcattgccaatctgatccgttccaacgtgcgcgaactggaaggcgcgttcaaccgtgtcggagcgagcagccgctttatgaaccgtcccgtcatcgacatcgatttggcgcgtaccgctttgcaggacattattgccgagaagcacaaagtcatcaccgccgacatcatcatcgatgcggtggcgaaatattaccgcatcaaaatcagcgacgtactcggcaaaaaacgcacgcgcaacattgcccgtccgcgtcaggttgccatgagcctgaccaaagaattgaccactttgagcctgccgtctatcggcgattcgttcggcggacgcgaccatacgaccgtcatgcacggcatcagggcggtggcgaaactgcgcgaggaagaccccgagttggcgcaggattacgagaaactgctgattctgattcaaaac

SEQ ID NO: 1434 - protein, 433 aa, Neisseria gonorrhoeae
MAAVEGAVEPAEPSLHAGSEEMPVQEVLLDELPSEKPVKPAASKTAADILAERMKNLPHEPRQAAGPASRPESAAVAKARTDAQRDAEEARYEQTNLSPDYTFDTLVEGKGNRLAAAAAQAIAENPGQSYNPFFLYGSTGLGKTHLVQAVGNELLKNRPDAKVRYMHSDDYIRSFMKAVRNNTYDVFKQQYKQYDLLIIDDIQFIKGKDRTMEEFFYLYNHFHNEKKQLILTCDVLPAKIEGMDDRLKSRFSWGLTLELEPPELEMRIAILQKKAEAAGISIEDEAALFIANLIRSNVRELEGAFNRVGASSRFMNRPVIDIDLARTALQDIIAEKHKVITADIIIDAVAKYYRIKISDVLGKKRTRNIARPRQVAMSLTKELTTLSLPSIGDSFGGRDHTTVMHGIRAVAKLREEDPELAQDYEKLLILIQN

SEQ ID NO: 1435 - DNA, 204 bp, Neisseria gonorrhoeae
tcggtaatctgttttgttaaagagcgttgcgaaattataaagtatcccttccgcctgtctaagatatctctcgatatttccgacattccgtgctatacttttcagttcgtccgccgcttcggcagcggcgaagaaccgaactatacgcccgcaggggaaaacagtcaatactttcagcgggatttttttggggaaattcgtcat

SEQ ID NO: 1436 - protein, 68 aa, Neisseria gonorrhoeae
SVICFVKERCEIIKYPFRLSKISLDISDIPCYTFQFVRRFGSGEEPNYTPAGENSQYFQRDFFGEIRH

SEQ ID NO: 1437 - DNA, 1074 bp, Neisseria gonorrhoeae
atgaagccgtctatcttagaaaaactgcaacaactcggcgaccggttggaagaagttacccaccttttagggcaacccgaagccacatccgatatggacaactaccgcaagctcacgcgcgaacacgccgaactgacccccgtcgtcgaagtattccaaaactatcggcttgcccaaagcgacttggcggatgccgaagaaatgttgtccgaccccgaaatgaaagactttgccgccgaagaaatcgaagcggcgaaagccaaaatcgacgaactggataccgaattgcaaaaactgctgctgcccaaagatgccgacgacgacaaaaacatctttatcgaaatacgcgccggcacgggcggcgacgaagccgcgctgtttgccggcgatttgctgcgtatgtacagccgctacgccgaacgcaaccgctggcaggttgaaatcgtgtccgccaacgaaagcgaattgggcggctataaagaagtcatcgcccgtattgtcggactcggcgcgtacagccgtctgaaatttgaatcgggcggacaccgcgtgcagcgcgtccccgccaccgaaagccaaggccgcatccacacctccgcctgtaccgttgccgtcatgcccgaagcggacgagctcgaagacatcgaactgaaccccgccgacctgcgcaccgataccttccgcgcatccggcgcgggcggtcagcacattaacaaaaccgactccgccgtccgcattacccacttgccgacaggcatggtggtcgaatgccaagacggccgcagccaacacgccaacaaagcgcaggcgatgaaagtcctcgccgcccgcctgaacgacgcgcaaaaacgcgaagtccaagccaaagaagccgccgaacgcaaatccctcatcggcagcggcgaccgcagcgaacgcatccgcacctacaactatccccaaggcagggtaacagaccaccgcatcaacctcaccctgcacaagctggattttgtgatggacggcgatttggcagaaatcaccgatgccctgattgccgaacatcaggcggagcttctggcggcgatgggcgat

SEQ ID NO: 1438 - protein, 358 aa, Neisseria gonorrhoeae
MKPSILEKLQQLGDRLEEVTHLLGQPEATSDMDNYRKLTREHAELTPVVEVFQNYRLAQSDLADAEEMLSDPEMKDFAAEEIEAAKAKIDELDTELQKLLLPKDADDDKNIFIEIRAGTGGDEAALFAGDLLRMYSRYAERNRWQVEIVSANESELGGYKEVIARIVGLGAYSRLKFESGGHRVQRVPATESQGRIHTSACTVAVMPEADELEDIELNPADLRTDTFRASGAGGQHINKTDSAVRITHLPTGMVVECQDGRSQHANKAQAMKVLAARLNDAQKREVQAKEAAERKSLIGSGDRSERIRTYNYPQGRVTDHRINLTLHKLDFVMDGDLAEITDALIAEHQAELLAAMGD

SEQ ID NO: 1439 - DNA, 1101 bp, Neisseria gonorrhoeae
atgttgattttacaagccgagcgcgacagcctgctcaagccgctgcaagcctttaccggcatcgtcgaacgcctacacaccctgcccatcctgtccaatgtgctgattgagggcaggggcggtcagaccaaactcttggcaaccgatttggaaatccaaatcgacaccgcgggtcccgagggaggtgcgggcgacttccgcatcactaccaatgccaagaaatttcaggacattttgcgcgcgctgcctgccggtgcgctggtgtcgctggattgggacgacaaccgtctgacgctgaaggcgggcaaatcgcgttttgccctgcaaaccctgcctgccgccgattttccgatgatgaatgtcggcgaggacatcagcgcgactttctcgctggggcaggagcgtttcaaaaccatgctgtcgcaagtgcagtacagcatggcggtgcaggacatccgctattatctcaacggtctgctgatgcaggttgagggcagccagttgcgccttgtggcgaccgacggacaccgccttgcctatgcagcctgcgcgattgatgcggatttgccgcgcgccgaagtgattttgccgcgcaaaacggtgctggaactgttcaaactgttgaacaaccccgacgatccgattcaaatcgagctgctggacaagcaggtgcgtttccaatgcaacggcacgaccatcgtcagcaaggtcatcgacggcaaattccccgatttcaaccgcgtgattcctttggacaacgacaagattttcgtgttgtcccgtgccgaacttttgggcgcgctggaacgtgtgtccattcttgccaacgaaaaattccgtggcgcgcgcctgttcctgcaacccggcctgttgagcgtcgtgtgcagcaacaacgagcaggaagaagcgcgcgaagaaatcgaaatcgcctatcagggcggcgaactcgaagtcggtttcaatatcggctatttgatggacgtgttgcgcaacatccattccgacgatatgcagcttgccttcggcgacgccaaccgctcgacgctgtttaccgtgccgaacaatccgaatttcaaatatattgtgatgccgatgcggatt

SEQ ID NO: 1440 - protein, 367 aa, Neisseria gonorrhoeae
MLILQAERDSLLKPLQAFTGIVERLHTLPILSNVLIEGRGGQTKLLATDLEIQIDTAGPEGGAGDFRITTNAKKFQDILRALPAGALVSLDWDDNRLTLKAGKSRFALQTLPAADFPMMNVGEDISATFSLGQERFKTMLSQVQYSMAVQDIRYYLNGLLMQVEGSQLRLVATDGHRLAYAACAIDADLPRAEVILPRKTVLELFKLLNNPDDPIQIELLDKQVRFQCNGTTIVSKVIDGKFPDFNRVIPLDNDKIFVLSRAELLGALERVSILANEKFRGARLFLQPGLLSVVCSNNEQEEAREEIEIAYQGGELEVGFNIGYLMDVLRNIHSDDMQLAFGDANRSTLFTVPNNPNFKYIVMPMRI

SEQ ID NO: 1441 - DNA, 2184 bp, Neisseria gonorrhoeae
ttgccccgatgcctgaaacagaccgtccgtcacgtcatgccgcctgaaaccggcgcagatgccgccaagccttcagacggcattgtccgcccgctccgaccgaacaacaaccatctttgggagaaccttatgaccgaacaaaaccgcatcctctgccgcgaactgagcctgctggcattcaaccgccgcgtgttggcacaggcggaagacaaaaacgtcccccttttggaacgcctgcgcttcctgtgcatcgtgtcgtccaatcttgacgagttttttgaagtccgcatggcgtggctcaagcgtgaaaacaagctgcacccccggcgcaggccggacaacggcaaaatgccgtctgaaaccatcgccgacgttaccgaagcggcgcgctccctgatacggcaccagtacgacctgttcaacaacgtccttcagcccgagttggcgcgggaaagcatccatttttaccgccgccgcaattggacgggcacgcagaaaaaatggatcgaagactatttcgaccgcgaactgctgccgatcctgacccccatcggactcgacccttcccaccctttcccgcgcccgctgaacaaatcgctcaacttcgccgtagaactcgacggcacggacgcgttcggcaggccttcgggtatggcgattgtccaagcaccgcgcatcctgccgcgcgttgttcccctgccgtccgaactgtgtggcggcggacacggcttcgtcttcctgtcgtccatcctccacgcccacgtcggcaaactcttcccgggcatgaacgtcaaaggctgccaccagttccgcctcacgcgcgacagcgacttgaccgttgacgaagaagacgtacaaaacctccgcgccgccattcaaaacgaactgcacgaccgcgaatacggcgacggcgtgcggctcgaagtcgccgacacctgtcccgcctacatccgcgactttctgctcgcgcaattcaggctgaccgacgccgaactctatcaggtcaaaggcccggtcaacctcgtccgcctcaacgccgtccccgacctagtcaaccgccccgatttgaaatttccgccgcacacgccgggccgtctgaaagccttgggcaaaaacagcccgatcttcgatttggtgcgccaatcgcccatcctgctgcaccacccctaccaatctttcgatcccgtggtcgatatgatacgcgaagccgccgccgatcccgccgttcttgccgtcaaaatgacgatttaccgcaccggcacgcgctccgaactcgtccccgccctgatgaaggcggcactcgccgacaaacaagtaaccgtcgtcgtcgaactgatggcgcgttttgacgaagccaacaacgtcaactgggcgaagcagctcgaagaggcgggagcgcacgtcgtgtacggcgtgttcggctacaaagtccacgccaaaatggcactggtcatccgccgcgaagacggcgtgctcaagcgttacgcccacctcggcacgggcaactaccaccaaggcacatcgcgcatctacaccgacttcggcctcattaccgccgacgaacaaatcaccgccgacgtgaacacattatttatggaaatcacaggcttgggcaaacccgggcggctgaacaaactctaccaaagtccgtttaccctgcacaaaatggttatcggccgcatcgctcgcgaaaccgaacacgcaaaagccggcaaaccggcgcggattaccgccaagatgaattcgctcatcgaaccgactgtcatagaagccctgtatcgggcaagcgcggcaggcgtgcaaatcgatttgattgtgcgcggtatgtgtaccttgcgcccgggtgtaaaaggcttgtccgaaaacatccgcgtccgctccatcgtcggcaggcagctcgaacacgcgcgcgtatattgtttccacaacaacggcgcggacgacacctttatttccagcgcggattggatggggcgcaatttcttccgccgcatcgaaaccgccaccccgattaccgcgcccgaactcaaaaaacgcgtcatccgcgaaggtttggaaatggcactggcagacaatacccacgcgtggctgatgcagcccgacggcggctatatccgcgccgcgcccgccgaaggcgaaagcgaagccgacctgcaaaacgatttatgggatttgctccgaggc

SEQ ID NO: 1442 - protein, 728 aa, Neisseria gonorrhoeae
LPRCLKQTVRHVMPPETGADAAKPSDGIVRPLRPNNNHLWENLMTEQNRILCRELSLLAFNRRVLAQAEDKNVPLLERLRFLCIVSSNLDEFFEVRMAWLKRENKLHPRRRPDNGKMPSETIADVTEAARSLIRHQYDLFNNVLQPELARESIHFYRRRNWTGTQKKWIEDYFDRELLPILTPIGLDPSHPFPRPLNKSLNFAVELDGTDAFGRPSGMAIVQAPRILPRVVPLPSELCGGGHGFVFLSSILHAHVGKLFPGMNVKGCHQFRLTRDSDLTVDEEDVQNLRAAIQNELHDREYGDGVRLEVADTCPAYIRDFLLAQFRLTDAELYQVKGPVNLVRLNAVPDLVNRPDLKFPPHTPGRLKALGKNSPIFDLVRQSPILLHHPYQSFDPVVDMIREAAADPAVLAVKMTIYRTGTRSELVPALMKAALADKQVTVVVELMARFDEANNVNWAKQLEEAGAHVVYGVFGYKVHAKMALVIRREDGVLKRYAHLGTGNYHQGTSRIYTDFGLITADEQITADVNTLFMEITGLGKPGRLNKLYQSPFTLHKMVIGRIARETEHAKAGKPARITAKMNSLIEPTVIEALYRASAAGVQIDLIVRGMCTLRPGVKGLSENIRVRSIVGRQLEHARVYCFHNNGADDTFISSADWMGRNFFRRIETATPITAPELKKRVIREGLEMALADNTHAWLMQPDGGYIRAAPAEGESEADLQNDLWDLLRG

SEQ ID NO: 1443 - DNA, 495 bp, Neisseria gonorrhoeae
gtgacggacggtctgtttcaggcatcggggcaatgtgaaaacggataccggtacgtgcggtatccgtctgtttcaaatcacttccaacacaaaataatgacgcagtttttcgtacaccgcatcgctgacgttgatgcagccgttggtcataatcctgtcggacacggacggggaggcgatgcgttcgtttcgcctttcggacggtatctgattccaaacgcggtgcagggcgaaaagaaaatcgccctcctgcttgaaaccgatgacttcgccgccgtaaccgggcttgtcggtactgttcagcgtcagtccgaacgtccccttgggtgtggcagtgccgatgaggacggggtggcactgacggtcgtcggcaaaacagagttccgccttggatgtgtcgacgatgacttttttcttttgaatataggcactgaccgcatccggctgcccctgtgcgaatacgggggcagtcgtcagcaggcagcacaatatccc

SEQ ID NO: 1444 - protein, 165 aa, Neisseria gonorrhoeae
VTDGLFQASGQCENGYRYVRYPSVSNHFQHKIMTQFFVHRIADVDAAVGHNPVGHGRGGDAFVSPFGRYLIPNAVQGEKKIALLLETDDFAAVTGLVGTVQRQSERPLGCGSADEDGVALTVVGKTEFRLGCVDDDFFLLNIGTDRIRLPLCEYGGSRQQAAQYP

SEQ ID NO: 1445 - DNA, 441 bp, Neisseria gonorrhoeae
atgccgccccgcctgctttcagggatattgtgctgcctgctgacgactgcccccgtattcgcacaggggcagccggatgcggtcagtgcctatattcaaaagaaaaaagtcatcgtcgacacatccaaggcggaactctgttttgccgacgaccgtcagtgccaccccgtcctcatcggcactgccacacccaaggggacgttcggactgacgctgaacagtaccgacaagcccggttacggcggcgaagtcatcggtttcaagcaggagggcgattttcttttcgccctgcaccgcgtttggaatcagataccgtccgaaaggcgaaacgaacgcatcgcctccccgtccgtgtccgacaggattatgaccaacggctgcatcaacgtcagcgatgcggtgtacgaaaaactgcgtcattattttgtgttggaagtgatt

SEQ ID NO: 1446 - protein, 147 aa, Neisseria gonorrhoeae
MPPRLLSGILCCLLTTAPVFAQGQPDAVSAYIQKKKVIVDTSKAELCFADDRQCHPVLIGTATPKGTFGLTLNSTDKPGYGGEVIGFKQEGDFLFALHRVWNQIPSERRNERIASPSVSDRIMTNGCINVSDAVYEKLRHYFVLEVI

SEQ ID NO: 1447 - DNA, 327 bp, Neisseria gonorrhoeae
atgcgccccggtctgaccaaagacgacatctacaaaatcccgggccgcccgcattacgacgaaggtatgtacggcgtgcgcgaatgggattacctgttccacttccacaccccgggcgtgggtatcgaccctgaaaacacttccggcgtggaaggcgttactacctgccaatacaaagtgattttcgataaagacaaatttgcccgcagcttctactggaaccccgtcttcccgaaagatgccgtctgcccgccgcccgcacccaaagccgagccgcaagtcatcatccgcgaaatcgtgccggcaaaaccgaaacgtatccgccaa

SEQ ID NO: 1448 - protein, 109 aa, Neisseria gonorrhoeae
MRPGLTKDDIYKIPGRPHYDEGMYGVREWDYLFHFHTPGVGIDPENTSGVEGVTTCQYKVIFDKDKFARSFYWNPVFPKDAVCPPPAPKAEPQVIIREIVPAKPKRIRQ

SEQ ID NO: 1449 - DNA, 492 bp, Neisseria gonorrhoeae
ttggcggatacgtttcggttttgccggcacgatttcgcggatgatgacttgcggctcggctttgggtgcgggcggcgggcagacggcatctttcgggaagacggggttccagtagaagctgcgggcaaatttgtctttatcgaaaatcactttgtattggcaggtagtaacgccttccacgccggaagtgttttcagggtcgatacccacgcccggggtgtggaagtggaacaggtaatcccattcgcgcacgccgtacataccttcgtcgtaatgcgggcggcccgggattttgtagatgtcgtctttggtcagaccggggcgcatctgatccagttcgtcataagtcgggaatgtgccgcgcttgttgtcgagcgttacggaatagggttccgggaaaaccggattgtcggtcgtgccgtcggctttgacgttgctttatggttgcgcaggcagacagaatgcctgccgccaatactgccaagctcggtt

SEQ ID NO: 1450 - protein, 164 aa, Neisseria gonorrhoeae
LADTFRFCRHDFADDDLRLGFGCGRRADGIFREDGVPVEAAGKFVFIENHFVLAGSNAFHAGSVFRVDTHARGVEVEQVIPFAHAVHTFVVMRAARDFVDVVFGQTGAHLIQFVISRECAALVVERYGIGFRENRIVGRAVGFDVALWLRRQTECLPPILPSSV

SEQ ID NO: 1451 - DNA, 171 bp, Neisseria gonorrhoeae
atgaaaatcaaacaaatcgtcaaaccgagcttggcagtattggcggcaggcattctgtctgcctgcgcaaccataaagcaacgtcaaagccgacggcacgaccgacaatccggttttcccggaaccctattccgtaacgctcgacaacaagcgcggcacattcccgactta

SEQ ID NO: 1452 - protein, 57 aa, Neisseria gonorrhoeae
MKIKQIVKPSLAVLAAGILSACATIKQRQSRRHDRQSGFPGTLFRNARQQARHIPDL

SEQ ID NO: 1453 - DNA, 822 bp, Neisseria gonorrhoeae
atggggcgcggacggggtgaaacacgagttgcagcggttggggctggtgtgaagatgaggctgaccgacacacattgccatcttgccgattccgttttgcgcggcaatctggcgcaggtgcttgccgaagcgcgacaggcgggcgtgtggcggtttatcgttcccgccacctgtccgcaggattggcaggacgtggcggaactgtcggaaatgccgtccgaacacggtcaaatccgtattgcgctgggcatccatccttggttttcagacggcattgcggaacaggatttttccggtttggaagccgtattggtgcgttacccccgagcgtgggtcggcgaaatcggcttggatttttacgacaaaacccaaacgccgccgcagcgtgaacggcaaattcaagtttttagccgccagcttgccatcgcgcaaaccctgcgccgccgcgtgattatccataatctcaaagccaccgccgacatcgccgccgccgtcaaacagacaggctttactcaaggcggcatcgttcacgctttctcaggcagcgcggaagaagcgcgcgtgttgacaaaactggggttcaaaatcggcatcggttcgctgctgctcaatccgaacgcgcgtaaagtgcgcgatacgcttaaagccttgaacgacggggatttcgtattggaaacggatagcccgttcatgttggaaaacaccgtcaatacgcctgccaacattcttcggattgccgaaattgctgcggaaatacgcggtaccggcgcggcggaaatcgccgcgataacggaacgcaatgccgacagtctgctccgtccc

SEQ ID NO: 1454 - protein, 274 aa, Neisseria gonorrhoeae
MGRGRGETRVAAVGAGVKMRLTDTHCHLADSVLRGNLAQVLAEARQAGVWRFIVPATCPQDWQDVAELSEMPSEHGQIRIALGIHPWFSDGIAEQDFSGLEAVLVRYPRAWVGEIGLDFYDKTQTPPQRERQIQVFSRQLAIAQTLRRRVIIHNLKATADIAAAVKQTGFTQGGIVHAFSGSAEEARVLTKLGFKIGIGSLLLNPNARKVRDTLKALNDGDFVLETDSPFMLENTVNTPANILRIAEIAAEIRGTGAAEIAAITERNADSLLRP

SEQ ID NO: 1455 - DNA, 1725 bp, Neisseria gonorrhoeae
atgcagttatcaggcgcgcaaatcatagtgcagagtctcaaagccgaaggcgtcgagtacgttttcggttatcccggcggtgcggttatcgaaatctacgatgccctgttccaactcaataaattcaaacacattcttacccgccatgagcaggcggcagtacacgcggcagatgcgtatgcgcgcgtcagcggtaaggtgggcgtggcattggttacatccggcccgggcgttaccaatgcgctgaccggtattgctactgcctatacggattcgattccgatggtggtcatcagcggacaggtaggcaattccctgattggtacggatgcgttccaagaagttgatacggtgggtattacccgtccgtgcgtcaaacacaatttcttggttacggacatcaatgagttggtggaaaccattaaaaaggcgttccaaattgccgcaagcggccgaccggggcccgtggtgcttgatgtcccgaaagatgttacgcaggcgatggcgaaattcagctatcctcaggaagacatttttatccgttcgtatcaaccggttgttcaagggcatatcggtcagattaaaaaggccgtgcagatgttggcatctgccaaacgcccggtcgtctattttggcggcggcgtggtgttgggtaatgcttctgaagagctgacccgatttgtccgaatgacgggtgctccgtgcacgggtacgctgatgggcttgggcgcttatccttccggcgaccgccaattcctcggtatgctcggtatgcacggtacttacgaggcaaaccttgccatgcagaatgcggatgtcgttcttgccgtaggtgcgcgttttgacgaccgtgtggtttccgtaccgtccaaatttttcgagaaggcgaagaaggttatccatatcgatgtcgatccttccagcatcgccaaacgcgtgaaggcggacattccgattgtcggcgacgtgaaaaacattttgtccgagatggttgcgctgtggcaaaaacaagagtccgtgccgtctgaagatgctttgggcaaatggtggaaaaccatagaggaatggcgttcccgcgattgcttgtggtttgacaacggcagcgaaattatcaagccccaatatgtgattcagaagcttgccgagattaccggcaattcggcaatcatcacatcggatgtagggcagcatcaaatgtttgcggctcaatattatcctttcgaacgtccgcgccaatggctcaactccggcggtttgggtacgatgggcgtgggtctgccttatgcgattggtgcaaaacttgccgccccggatcaagacgtattctgtattaccggcgacggctcgatccagatgaacatccaagagttgtccacctgtttccaatatcggattccggttaacgtcattacgctgaacaacggttatctgggtatggtacgccagtggcaggaaatatattacggcggtcgagagtcggaaacctatttcgattctttgcccgatttcgtcaaacttgccgaggcatacggccatatcggcatccgcgtggacaataaatctgatgtggaaggtgccttgttggaagcattgaaccaaaaagacaggctggtgtttatcgacttcctgaccgaccagaaacagaatgtgatgcctatggtcggcaacggcaaaggtttggacgaaatggtacttccgccgcatatgcgtacggacggaaaggcg

SEQ ID NO: 1456 - protein, 575 aa, Neisseria gonorrhoeae
MQLSGAQIIVQSLKAEGVEYVFGYPGGAVIEIYDALFQLNKFKHILTRHEQAAVHAADAYARVSGKVGVALVTSGPGVTNALTGIATAYTDSIPMVVISGQVGNSLIGTDAFQEVDTVGITRPCVKHNFLVTDINELVETIKKAFQIAASGRPGPVVLDVPKDVTQAMAKFSYPQEDIFIRSYQPVVQGHIGQIKKAVQMLASAKRPVVYFGGGVVLGNASEELTRFVRMTGAPCTGTLMGLGAYPSGDRQFLGMLGMHGTYEANLAMQNADVVLAVGARFDDRVVSVPSKFFEKAKKVIHIDVDPSSIAKRVKADIPIVGDVKNILSEMVALWQKQESVPSEDALGKWWKTIEEWRSRDCLWFDNGSEIIKPQYVIQKLAEITGNSAIITSDVGQHQMFAAQYYPFERPRQWLNSGGLGTMGVGLPYAIGAKLAAPDQDVFCITGDGSIQMNIQELSTCFQYRIPVNVITLNNGYLGMVRQWQEIYYGGRESETYFDSLPDFVKLAEAYGHIGIRVDNKSDVEGALLEALNQKDRLVFIDFLTDQKQNVMPMVGNGKGLDEMVLPPHMRTDGKA

SEQ ID NO: 1457 - DNA, 90 bp, Neisseria gonorrhoeae
ttgtttgattttcatatgcagaatccttttttacccgatgcccgtctgccttttgttcggaagagccgcatcaggagagttttaaacgtt

SEQ ID NO: 1458 - protein, 30 aa, Neisseria gonorrhoeae
LFDFHMQNPFLPDARLPFVRKSRIRRVLNV

SEQ ID NO: 1459 - DNA, 174 bp, Neisseria gonorrhoeae
atgcgtaaattcgcacgcgcatcattccgtatgccgtacaaatacaccgcgtttactgatacgcacgttttttatgctaatattacgaaccaaaatcaaacgtttaaaactctcctgatgcggctcttccgaacaaaaggcagacgggcatcgggtaaaaaaggattctgcata

SEQ ID NO: 1460 - protein, 58 aa, Neisseria gonorrhoeae
MRKFARASFRMPYKYTAFTDTHVFYANITNQNQTFKTLLMRLFRTKGRRASGKKGFCI

SEQ ID NO: 1461 - DNA, 246 bp, Neisseria gonorrhoeae
atgcgcgtgcgaatttacgcatcctgccggcaatttgccgattcgccgacatcggcaacctgttataattcctcctttaaattcctaacgttttcaagcgaaaaacaaaatgaccatgcaagaacattaccagcccgccgccatcgagcctgcggcgcagaaaaaatgggacgacgcccgtatttccaacgtctccgaagacgcttccaaacccaaatattattgcctttcgatgttcccttaccc

SEQ ID NO: 1462 - protein, 82 aa, Neisseria gonorrhoeae
MRVRIYASCRQFADSPTSATCYNSSFKFLTFSSEKQNDHARTLPARRHRACGAEKMGRRPYFQRLRRRFQTQILLPFDVPLP

SEQ ID NO: 1463 - DNA, 2511 bp, Neisseria gonorrhoeae
atgttcccttaccctagcggcaagctgcatatggggcatgtacgcaactacaccatcggcgacgtattgagccgcttcaaacttttaaacggcttcaacgttatgcagcctatgggttgggacgcgttcggcatgccggcggaaaatgcggcgatgaaaaacaacgtcgcccccgccgcttggacctacgacaacatcgaatacatgaaaacccagctcaaaagcctgggttttgcgattgactgggaacgcgaagtcgccacctgcaaacccgaatactaccgctgggaacaatggctgtttaccaagctgtttgaaaaaggcatcgtctatcgcaaaaacggaacggtgaactgggacccggtcgaccaaaccgtccttgccaacgagcaagtcatcgacggacgcggctggcgttcgggcgcgttgatcgaaaaacgcgaaatcccgatgtattacttcaaaattacggattacgccgaagagctgctcaacgatttggacaagctggaacactggccggaacaagtcaaaaccatgcagcgcaactggatcggcaaatctcgcggcatgaccgtgcgcttcgccgtttcagacgacagcaagcaaggtttggaaggcgattacgcgaaattcctgcaagtttataccacccgccccgacacgctgatgggtgcgacttatgtcgctgttgccgccgaacatccgctggcaacagccgcagccgccgacaaacccgaattgcaggcatttatcgccgaatgcaaagccggttcggttgccgaagccgatatggcgacgatggagaaaaaaggcgtgccgaccggccgctacgtcgtcaacccgctcaacggcgacaagctggaagtgtggattgccaactatgtcttgtggggctacggcgacggcgcggtgatggctgttccggcgcacgacgaacgcgatttcgagtttgccgccaaatacaatctgccgaaaaaacaagtcattgccgtcggcgacaacgcattcgacgcaaaccgatggcaagaatggtacggcgacaaagaaaacggcgtattggtcaacagcggcgacttggacggcttggattttcagacggcatttgatgccgttgccgccaagctgcaaagccaaggtgcgggcgaaccgaaaacccaataccgcctgcgcgactggggcatttcgcgccaacgctactggggctgcccgattcccatcgtccattgcgaaaaatgcggagacgttcccgtccctgccgaccaactgcccgtcgtcctgcctgaaaacgtcgtacccgacggtatgggttcgccgctggcaaaaatgcccgagttttacgaaacttcctgcccgtgctgcggcggcgcggcgaaacgcgaaaccgacaccatggacaccttcatggagtcgagctggtacttcttccgctatatgtcgcccaagttttcagacggcatggtatcggcagaatccgcgaaatactggggcgcggtcgaccaatacatcggcggcatcgaacacgcgattttgcacctcctgtacgcgcgcttcttcaccaaactgatgcgcgacgaaggtttggtcaatgttgacgaaccgtttgaacgcctgctcacgcaaggtatggtcgtctgcgaaacctactaccgcgaaaacgacaaaggcggcaaagactggatcaaccccgccgatgtcgagctgactttcgatgacaaaggccgccccgtttccgccgtcctcaaagccgacggactgcccgtcgtcatcagcggcacggaaaaaatgtccaaatccaaaaacaacggcgtcgatccgcaagaactgattaacgcctacggcgcggacaccgcccgcctgttcatgatgttcgccgcaccgcccgaacagtccctcgaatggagcgacagcggcgtcgaaggtgcacaccgcttcctgcgccgtctgtggcgtaccgtttacgaatacctgaagcaaggcggcgcggtcaaagcatttgcaggcaaccaagacggtttgtctaaagaactcaaagacctgcgccacaaactgcattccaccaccgccaaagtcagcgacgactacggccgccgccagcagttcaacaccgccatcgccgccgtgatggaactgctcaaccaatacgacaaaaccgacaccggcagcgaacaaggccgcgccgtcgcccaagaagtattggaagccgccgtacgcctgttgtggcccatcgtgccgcacatctgcgaaaccctgtggagcgaattgaacggcgcgaaactgtgggaagcaggctggccgacagtcgacgaagccgccctggtcaaatccgaaatcgaagtgatggttcaagtcaacggcaaactgcgcggcaaaatcaccgtcgccgccgacgcctccaaagccgacctcgaagccgccgcactcgccaacgaaggcgcagtgaaattcatggaaggcaagcctgcgaagaaaatcatcgtcgtaccgggcagactggtgaacatcgtcgtc

SEQ ID NO: 1464 - protein, 837 aa, Neisseria gonorrhoeae
MFPYPSGKLHMGHVRNYTIGDVLSRFKLLNGFNVMQPMGWDAFGMPAENAAMKNNVAPAAWTYDNIEYMKTQLKSLGFAIDWEREVATCKPEYYRWEQWLFTKLFEKGIVYRKNGTVNWDPVDQTVLANEQVIDGRGWRSGALIEKREIPMYYFKITDYAEELLNDLDKLEHWPEQVKTMQRNWIGKSRGMTVRFAVSDDSKQGLEGDYAKFLQVYTTRPDTLMGATYVAVAAEHPLATAAAADKPELQAFIAECKAGSVAEADMATMEKKGVPTGRYVVNPLNGDKLEVWIANYVLWGYGDGAVMAVPAHDERDFEFAAKYNLPKKQVIAVGDNAFDANRWQEWYGDKENGVLVNSGDLDGLDFQTAFDAVAAKLQSQGAGEPKTQYRLRDWGISRQRYWGCPIPIVHCEKCGDVPVPADQLPVVLPENVVPDGMGSPLAKMPEFYETSCPCCGGAAKRETDTMDTFMESSWYFFRYMSPKFSDGMVSAESAKYWGAVDQYIGGIEHAILHLLYARFFTKLMRDEGLVNVDEPFERLLTQGMVVCETYYRENDKGGKDWINPADVELTFDDKGRPVSAVLKADGLPVVISGTEKMSKSKNNGVDPQELINAYGADTARLFMMFAAPPEQSLEWSDSGVEGAHRFLRRLWRTVYEYLKQGGAVKAFAGNQDGLSKELKDLRHKLHSTTAKVSDDYGRRQQFNTAIAAVMELLNQYDKTDTGSEQGRAVAQEVLEAAVRLLWPIVPHICETLWSELNGAKLWEAGWPTVDEAALVKSEIEVMVQVNGKLRGKITVAADASKADLEAAALANEGAVKFMEGKPAKKIIVVPGRLVNIVV

SEQ ID NO: 1465 - DNA, 1005 bp, Neisseria gonorrhoeae
ttgccctgctgtctgcggcttcgtctccttgtcctgatttttgttaatctactaaaaattaatctcaaaatccaaaatatgaatttatttttcgatacccaattgggaaagcaacaaaataaagcaacccacaaaatccgtgtaatgagcgaggcttggctggaaaaaaacggctattgcccctgttgcggaagcaagccgatgcagagatttgccaataacaaacctgttgcagacctcttttgcccaaattgccacgagcaatatgaattaaagagtaaaaatcaaaaaaccataggcaacagcgtgcctgacggtgcatatcgcactatgttggagcgcatccggtcagataccaaccccaactttttctttcttgcatataaaaaagcggattactccatacggcaattggtgcttgtacccaaacatttcatcacgccggatatgattattcccagaaataaaggcattaaaaaccgaccgcaccacattatgtgttccatcaatctcgcccctttgcctgaaagcggaaaaatattcttaatagacgattcccgcattatcgaacccgaaaccgttctgaaaaaatggcaatccaacctgtttttacgcaaccaaaatgcggagcgcaaagactggcttttggctgttatgaaatgtatcgaccaactcaccgaagaattcacattgtcgcaaatgtatgaatttgaaaacaaactatccatccaatttccccaaaacaaccatatcaaagacaaaatccgccaacagttgcaaattttgcgtgatcaaaatatgatcgaattcattggtcgcggactttacaaaaaaaatcgacaaattgcacccaactcccaaggcgttttgatttcaaatcatgatactgaatttacgagaaatatttattcttctgccattctaaaaacggttgaagtacaacgcaatattgccgcaaagggcagcagtcgtaaaaaagtcggagaattattggcaatttatgat

SEQ ID NO: 1466 - protein, 335 aa, Neisseria gonorrhoeae
LPCCLRLRLLVLIFVNLLKINLKIQNMNLFFDTQLGKQQNKATHKIRVMSEAWLEKNGYCPCCGSKPMQRFANNKPVADLFCPNCHEQYELKSKNQKTIGNSVPDGAYRTMLERIRSDTNPNFFFLAYKKADYSIRQLVLVPKHFITPDMIIPRNKGIKNRPHHIMCSINLAPLPESGKIFLIDDSRIIEPETVLKKWQSNLFLRNQNAERKDWLLAVMKCIDQLTEEFTLSQMYEFENKLSIQFPQNNHIKDKIRQQLQILRDQNMIEFIGRGLYKKNRQIAPNSQGVLISNHDTEFTRNIYSSAILKTVEVQRNIAAKGSSRKKVGELLAIYD

SEQ ID NO: 1467 - DNA, 804 bp, Neisseria gonorrhoeae
tcttttcagaatgatttccaatacgaacttgctgcccatataggcaatcataaggctgacaaatccgatgatggtccacacggcggcttttttgccgcgccatgcggtcatgctgtgtttgagcagcagtcctccgtaaatcagccatgacaatatgccgaatacggttttatgggtaaatgtcatgggtttgccgaatacggcttcggcaaagaatgtgccgctgacgacggaataggtcagcaggatgaaacctgcccacatggcctggaacatgagtttttccaaactgagcagcgacggcaggaatcctgcgagcttggagaagtttctgcggtgcaggctccggtgcagcagcaagctcaaaacggacaataatgttgcgatgccgaacagcccgtatgcaagcagtgatgtgccgatatgcagcataaagggaaagtcggtaatttcatatcccgagaattttcccgggaaaaccaaacctgacagcagcatcagtgcggcgcaaggatacagcagcaactgcactccgcgcagcggataaaaaaagctgccggcaaaataaataaacagcatcatccaaacaatcaggctgccggaatacccgaagcccataatgatgattttgtcttgaatgaccggcatcagcagtgccgcgccgtggacggtcaatgccgcgcccaaaaccggcaattccgtcttccacgggtaatcccggccgcgcccctgctgttggcagtgccatgcaaatgcacccaatcctgcgtaaaccgccgtcaaaaagatgaaaactgtcggcat

SEQ ID NO: 1468 - protein, 49 aa, Neisseria gonorrhoeae
SFQNDFQYELAAHIGNHKADKSDDGPHGGFFAAPCGHAVFEQQSSVNQP

SEQ ID NO: 1469 - DNA, 108 bp, Neisseria gonorrhoeae
ttggataatctgtctgttgccgtgttcccccaatgcgcgtaccctaaatcgctgcttggtggaattgcattacaggtgctgtggcaaagcggtttgtccctattggtt

SEQ ID NO: 1470 - protein, 36 aa, Neisseria gonorrhoeae
LDNLSVAVFPQCAYPKSLLGGIALQVLWQSGLSLLV

SEQ ID NO: 1471 - DNA, 150 bp, Neisseria gonorrhoeae
atgattgattttgacaaaccggctgaagaagctgccatttatcaaagtcgtttgaaaaaatcgtttcagacgaccttgtcctctacaacgaaaattcccttaacgtcatgcggaagatattggaaaaacatccaaacggctgttttgata

SEQ ID NO: 1472 - protein, 50 aa, Neisseria gonorrhoeae
MIDFDKPAEEAAIYQSRLKKSFQTTLSSTTKIPLTSCGRYWKNIQTAVLI

SEQ ID NO: 1473 - DNA, 633 bp, Neisseria gonorrhoeae; identical to SEQ ID NO: 241

SEQ ID NO: 1474 - protein, 211 aa, Neisseria gonorrhoeae; identical to SEQ ID NO: 242

SEQ ID NO: 1475 - DNA, 453 bp, Neisseria gonorrhoeae
atgattattggcggaatcggcggtgcaaggacacaaacaggactcagattcgaagaacgtacagacttacgaaagttgtttgaagaaattcccgggtacgacttaagaaaaacagatgataatgcgggttatgaagtttggtttaatggagaattgaaggcttattgtttcaaaaaatatgagttttaccgatttttggaaagactggaatacaatattaattggaaagaccatctgtctaaaagattactgcccgataatggcttatttatcatcatccgtgataccttatttattattgagatcaaattccaacaaactcccggttcagtagatgagaaattacaaacttgcgattttaagagaaaacaatatacaaagttagttcactctttaggttggcgggttggatatgtctatgttttgaatgattggtttacaaaaccggaatat

SEQ ID NO: 1476 - protein, 151 aa, Neisseria gonorrhoeae
MIIGGIGGARTQTGLRFEERTDLRKLFEEIPGYDLRKTDDNAGYEVWFNGELKAYCFKKYEFYRFLERLEYNINWKDHLSKRLLPDNGLFIIIRDTLFIIEIKFQQTPGSVDEKLQTCDFKRKQYTKLVHSLGWRVGYVYVLNDWFTKPEY

SEQ ID NO: 1477 - DNA, 126 bp, Neisseria gonorrhoeae
atgattggtttacaaaaccggaatattaaagatgttttagattatattatcagtgttaactgccattaccaatttaacacgattcccttaaggtggtttggactgcctgatggtgaaacaaatgaa

SEQ ID NO: 1478 - protein, 42 aa, Neisseria gonorrhoeae
MIGLQNRNIKDVLDYIISVNCHYQFNTIPLRWFGLPDGETNE

SEQ ID NO: 1479 - DNA, 102 bp, Neisseria gonorrhoeae
ttgacagatgctgcattcagtgtcgcggaatccgcgtattttgaacaaaaggtcgggctactttatcacaatagcagaaagatggaaaacggcggggattgg

SEQ ID NO: 1480 - protein, 34 aa, Neisseria gonorrhoeae
LTDAAFSVAESAYFEQKVGLLYHNSRKMENGGDW

SEQ ID NO: 1481 - DNA, 156 bp, Neisseria gonorrhoeae
ttgttcaaaatacgcggattccgcgacactgaatgcagcatctgtcaaagattatttgaaaacggtcgagttagacaagtctgccgacaatgtcgataccacatccaaaactatccgcagggtttaggcggtattccagagtacggtgtcttatgc

SEQ ID NO: 1482 - protein, 52 aa, Neisseria gonorrhoeae
LFKIRGFRDTECSICQRLFENGRVRQVCRQCRYHIQNYPQGLGGIPEYGVLC

SEQ ID NO: 1483 - DNA, 126 bp, Neisseria gonorrhoeae
gtgtcttatgctgatgctgtaaacaatgcccgtatagaaaatctaaaacggttgttgccgaccgttatgccggtttatgagcaaagtgtcagaaataaggggcgcgttaataaaaaacgtcggcgt

SEQ ID NO: 1484 - protein, 42 aa, Neisseria gonorrhoeae
VSYADAVNNARIENLKRLLPTVMPVYEQSVRNKGRVNKKRRR

SEQ ID NO: 1485 - DNA, 315 bp, Neisseria gonorrhoeae
ttgcgtagccgacttggcaaacggcaaaatcagcaagttcacaatagacgcgctgctgaatatgcctgccaaaacaggcaagaccgccgaactgaatatcagggcgtagccgcacaaatgcccgaccgcatcaaaccaagccgaaacggcggcggtacagacggcatagcccgacagcaaggcacggcgcagacgggcgcgaaacccgaaacatccccgaccgcgaggcacggggattttttgcgcccgttgcaggggggattggatttaagcggcacgggcttgaaggcaaaacgggcggggcgcagaactgtt

SEQ ID NO: 1486 - protein, 105 aa, Neisseria gonorrhoeae
LRSRLGKRQNQQVHNRRAAEYACQNRQDRRTEYQGVAAQMPDRIKPSRNGGGTDGIARQQGTAQTGAKPETSPTARHGDFLRPLQGGLDLSGTGLKAKRAGRRTV

SEQ ID NO: 1487 - DNA, 246 bp, Neisseria gonorrhoeae
atgatttgcgcgcctgataactgcataacgacctcttttatacggtttcaaaccaatagggacaaaccgctttgccacagcacctgtaatgcaattccaccaagcagcgatttagggtacgcgcattgggggaacacggcaacagacagattatccaatcaattggaaaggaacacagagtttgtgaaaaagagtaaaaacgataacgcaaaccgacagttcaatcaagaaaaatctttcatcttt

SEQ ID NO: 1488 - protein, 82 aa, Neisseria gonorrhoeae
MICAPDNCITTSFIRFQTNRDKPLCHSTCNAIPPSSDLGYAHWGNTATDRLSNQLERNTEFVKKSKNDNANRQFNQEKSFIF

SEQ ID NO: 1489 - DNA, 90 bp, Neisseria gonorrhoeae
tgaaatattggaacttttaacgttggaattgtaaaatccccgtttcgggcaagccttgacggatttgccgatatgctgtccggcacacaa

SEQ ID NO: 1490 - protein, 29 aa, Neisseria gonorrhoeae
NIGTFNVGIVKSPFRASLDGFADMLSGTQ

SEQ ID NO: 1491 - DNA, 990 bp, Neisseria gonorrhoeae
atgaaacagaaaatttttgtcctttataccggcggcaccatcggcatgacgcaaagcagtgcgggcttgcgccccgataccgcgctggtcgggcaggcactcgcgccgttttcagacggcatggatttcgattggcacgtttgtgagccgctgattgattcttccgccgtccaactgcaaaactggtgcgcttggctggacatcattgccgccgcgctgccgcagtacgacggtgttttggtgctgcacggcacggacacactcgcctataccgccaatatgttcgccctcgccctgcaaggtttggacaaaccgatcgtcctgaccggttcgcaatggccgtacaacgcagagggcagcgacgcgccgcgcaatctggtgactgccgttgccgcattcccactcggattgaagcagacgcttattgcctttgacggcaaactgtatcccgccgtcggcagcagcaaaatcagcacggaaaccgccgccggtttcggcaatgcccatttcggcgcacttgccgagtgggacgaaacccggggctggcacaatgtccgcatcccgaatcaggacgcggcagatgtttcagacggcctcgaaatccgttatcccgacccgcaggcaaaaatcgccgtccgcacgcttatccccggctttgccgtccaagaacttgccgacgggctcggacagcttcccgcccaagcccttatcctgcaaagctacggacacggcaatacctccgccggcgaaggcttcatccgcgccgtgcaagactttacgcagcaaggcaaattgttgcttaacatcagccaagtgccgcagggttgcgctgccgccgtttacgcacagggcgacgcgctgcgtcgggcgggcgtggtcaacggcggcaaatgcaatttggaaaccgcaaccgcattgatgacgcttgccgtttccgaaggatggggcgcggacggggtgaaacacgagttgcagcggttggggctggtg

SEQ ID NO: 1492 - protein, 330 aa, Neisseria gonorrhoeae
MKQKIFVLYTGGTIGMTQSSAGLRPDTALVGQALAPFSDGMDFDWHVCEPLIDSSAVQLQNWCAWLDIIAAALPQYDGVLVLHGTDTLAYTANMFALALQGLDKPIVLTGSQWPYNAEGSDAPRNLVTAVAAFPLGLKQTLIAFDGKLYPAVGSSKISTETAAGFGNAHFGALAEWDETRGWHNVRIPNQDAADVSDGLEIRYPDPQAKIAVRTLIPGFAVQELADGLGQLPAQALILQSYGHGNTSAGEGFIRAVQDFTQQGKLLLNISQVPQGCAAAVYAQGDALRRAGVVNGGKCNLETATALMTLAVSEGWGADGVKHELQRLGLV

SEQ ID NO: 1493 - DNA, 267 bp, Neisseria gonorrhoeae
atgcagggattgcacgacatcggcgcaatcgacaaaaagactatgcgcggctttgacaagtcctgcctgaccgaaatcaagccgttgagcggcggggacatcaaggcaatcagggagaaggaggcactatcgcaagccgctttcgccatctatctcaacgtggggaaaaatcacgtttcggcttgggagcggggcgttaaaaagccgagcggcgcggcgttgaagctgctgaccatcgtcaaaaacaagggcatcgaagccattgcg

SEQ ID NO: 1494 - protein, 89 aa, Neisseria gonorrhoeae
MQGLHDIGAIDKKTMRGFDKSCLTEIKPLSGGDIKAIREKEALSQAAFAIYLNVGKNHVSAWERGVKKPSGAALKLLTIVKNKGIEAIA

SEQ ID NO: 1495 - DNA, 225 bp, Neisseria gonorrhoeae
gtgtattgctgcgaaaatcccgcttttatatttcatggctgtatctccgtgaaagtgccgtttgacttcgcttgctctatgtcggtttctgtcattgccaagatgatggcggcggttttctttaattctgtaagttctttatcagtgatgttttcgcggtcgttcttggcaaaggcggtcatgaaaaacgcccgttctccatgcctgaaaaatatcagactgcga

SEQ ID NO: 1496 - protein, 75 aa, Neisseria gonorrhoeae
VYCCENPAFIFHGCISVKVPFDFACSMSVSVIAKMMAAVFFNSVSSLSVMFSRSFLAKAVMKNARSPCLKNIRLR

SEQ ID NO: 1497 - DNA, 147 bp, Neisseria gonorrhoeae
atgaccgcctttgccaagaacgaccgcgaaaacatcactgataaagaacttacagaattaaagaaaaccgccgccatcatcttggcaatgacagaaaccgacatagagcaagcgaagtcaaacggcactttcacggagatacagcca

SEQ ID NO: 1498 - protein, 49 aa, Neisseria gonorrhoeae
MTAFAKNDRENITDKELTELKKTAAIILAMTETDIEQAKSNGTFTEIQP

SEQ ID NO: 1499 - DNA, 126 bp, Neisseria gonorrhoeae
atgcggatattcaaaaaccaatggatagtgaaatttgccaagaagcacaaaatcagtgattcagagctgatagaggcggtagagcgggcagataacgggctgatagatgcagatttgggcggcgcg

SEQ ID NO: 1500 - protein, 42 aa, Neisseria gonorrhoeae
MRIFKNQWIVKFAKKHKISDSELIEAVERADNGLIDADLGGA

SEQ ID NO: 1501 - DNA, 216 bp, Neisseria gonorrhoeae
atgcctgaaaaatatcagactgcgataaccgccgcttctgccttgcccttgccttgctatacgctgcttaatcacgcgccgcccaaatctgcatctatcagcccgttatctgcccgctctaccgcctctatcagctctgaatcactgattttgtgcttcttggcaaatttcactatccattggtttttgaatatccgcattgtgcaaccgtttact

SEQ ID NO: 1502 - protein, 72 aa, Neisseria gonorrhoeae
MPEKYQTAITAASALPLPCYTLLNHAPPKSASISPLSARSTASISSESLILCFLANFTIHWFLNIRIVQPFT

SEQ ID NO: 1503 - DNA, 120 bp, Neisseria gonorrhoeae
ttggtttttgaatatccgcattgtgcaaccgtttacttagtgatactggggattataccaaagacaggcaacacggcaagccgcctttttataccctgcaatttctccgtttatgccgcc

SEQ ID NO: 1504 - protein, 40 aa, Neisseria gonorrhoeae
LVFEYPHCATVYLVILGIIPKTGNTASRLFIPCNFSVYAA

SEQ ID NO: 1505 - DNA, 183 bp, Neisseria gonorrhoeae
ttggggttttccggttttttaccgtcttggcagtgggagcgtagcggaatgaaaagccaaaacgcacggaaccgcgcctattttgagcaggaatggcggttaaaccggttggttatattgcggggcataggaagacagcgaaacgcgctaaaaacgcaatttgagccattaaaagcgattgat

SEQ ID NO: 1506 - protein, 61 aa, Neisseria gonorrhoeae
LGFSGFLPSWQWERSGMKSQNARNRAYFEQEWRLNRLVILRGIGRQRNALKTQFEPLKAID

SEQ ID NO: 1507 - DNA, 282 bp, Neisseria gonorrhoeae
gtgcgttttggcttttcattccgctacgctcccactgccaagacggtaaaaaaccggaaaaccccaaaagttgttaccgattcgttaccatttgttaccgcatttgttaccaattttttatctttttcttatttttatagtgaattaaatttaaaccggtacggcgttgcctcgccttgccgtactatttgtactgtctgcggttcgccgccttgtcctgatttaaatttaattcactatatttcatatacttatttatctaacttttccccggtaacaagg

SEQ ID NO: 1508 - protein, 94 aa, Neisseria gonorrhoeae
VRFGFSFRYAPTAKTVKNRKTPKVVTDSLPFVTAFVTNFLSFSYFYSELNLNRYGVASPCRTICTVCGSPPCPDLNLIHYISYTYLSNFSPVTR

SEQ ID NO: 1509 - DNA, 117 bp, Neisseria gonorrhoeae
ttgcggtatttttcggataccgtaaaaaatcaggttagttcaattagggcggattggacgggattgcacagtcaggaaggggacggcaggataacaatcagcctgaaatccttgtat

SEQ ID NO: 1510 - protein, 39 aa, Neisseria gonorrhoeae
LRYFSDTVKNQVSSIRADWTGLHSQEGDGRITISLKSLY

SEQ ID NO: 1511 - DNA, 222 bp, Neisseria gonorrhoeae
atggaaattgttgacagtttgcatgggggcagatgtgaaagtatcaagaattttaaaatttacagggtttcactcgggatattgattgaacttgattttatttttgatatatcaaaaatattcccaaccatacttcctgaaaatggctcattgcaccggactgtattggacggcattgacagaaccaagagggctaacaacgacttaaatatattgattgta

SEQ ID NO: 1512 - protein, 74 aa, Neisseria gonorrhoeae
MEIVDSLHGGRCESIKNFKIYRVSLGILIELDFIFDISKIFPTILPENGSLHRTVLDGIDRTKRANNDLNILIV

SEQ ID NO: 1513 - DNA, 681 bp, Neisseria gonorrhoeae
atgtttgcccttttggaagccttttttgtcgaatacggctatgcggccgtgtttttcgttttggtcatctgcggtttcggcgtgccgattcccgaagatttgaccttggtaacgggcggcgtgatttcgggtatgggttataccaatccgcatattatgtttgcggtcggtatgctcggcgtgttggcgggcgacggcgtgatgtttgccgccggacgcatctgggggcagaaaatcctcaagttcaaaccgattgcgcgcatcatgacgccgaaacgttacgcgcaggttcaggaaaaattcgacaaatacggcaactgggttctgtttgtcgcccgtttcctgccgggtttgcggactgccgttttcgttaccgccggcatcagccgcaaagtatcgtatctgcgctttctgattatggacgggctggccgcgctgatttccgtgcccgtttggatttacttgggcgagtacggcgcgcacaacatcgattggctgatggcgaaaatgcacagcctgcaatcgggcatcttcatcgcattgggcgtgctggcggcggcgctggcgtggttctggtggcgcaaacgccgacattatcagctttaccgcgcacaattgagcgaaaaacgcgccaaacgcaaggcggaaaaggcagcgaaaaaagcggcacagaagcagcag

SEQ ID NO: 1514 - protein, 227 aa, Neisseria gonorrhoeae
MFALLEAFFVEYGYAAVFFVLVICGFGVPIPEDLTLVTGGVISGMGYTNPHIMFAVGMLGVLAGDGVMFAAGRIWGQKILKFKPIARIMTPKRYAQVQEKFDKYGNWVLFVARFLPGLRTAVFVTAGISRKVSYLRFLIMDGLAALISVPVWIYLGEYGAHNIDWLMAKMHSLQSGIFIALGVLAAALAWFWWRKRRHYQLYRAQLSEKRAKRKAEKAAKKAAQKQQ

SEQ ID NO: 1515 - DNA, 195 bp, Neisseria gonorrhoeae
gtggccgtaggctgtgcgagttcaaatctcgctgtcggcaccaacacacaaaaacgcttagaaattctaggcgttttttttcgtttaatcctgtctgatgccatcaaccaatcccaatcaatacaaggatttcaggctgattgttatcctgccgtccccttcctgactgtgcaatcccgtccaatccgccctaat

SEQ ID NO: 1516 - protein, 65 aa, Neisseria gonorrhoeae
VAVGCASSNLAVGTNTQKRLEILGVFFRLILSDAINQSQSIQGFQADCYPAVPFLTVQSRPIRPN

SEQ ID NO: 1517 - DNA, 366 bp, Neisseria gonorrhoeae
ttgaactcgcacagcctacggccactaccccctcaagatagcgtgtctaccaatttcaccatgtcggcatttgaaaaactgttatttctgctgctgaggaacaggggcagaaggttcggtattgcttacgggtttgggtgcttgctgagtctgtcgtatgttgctgaagtccaaaccgtgttttgtcgtgtgggtgtgaatatacaccatagccatgcaggttgcaaagaaaaatgttgctgcaacggcggtcgagcggctgaggaagttggcgttgccggcagagccgaatacgccttgcgcgctgccgcttcccgatccgaaggtcgcgccggcatccgcgcctttgccgtgttggagcaatac

SEQ ID NO: 1518 - protein, 122 aa, Neisseria gonorrhoeae
LNSHSLRPLPPQDSVSTNFTMSAFEKLLFLLLRNRGRRFGIAYGFGCLLSLSYVAEVQTVFCRVGVNIHHSHAGCKEKCCCNGGRAAEEVGVAGRAEYALRAAASRSEGRAGIRAFAVLEQY

SEQ ID NO: 1519 - DNA, 348 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatggctatggtgtatattcacacccacacgacaaaacacggtttggacttcagcaacatacgacagactcagcaagcacccaaacccgtaagcaataccgaaccttctgcccctgttcctcagcagcagaaa

SEQ ID NO: 1520 - protein, 116 aa, Neisseria gonorrhoeae
MEAFKTLIWIINIISALAVIVLVLLQHGKGADAGATFGSGSGSAQGVFGSAGNANFLSRSTAVAATFFFATCMAMVYIHTHTTKHGLDFSNIRQTQQAPKPVSNTEPSAPVPQQQK

SEQ ID NO: 1521 - DNA, 771 bp, Neisseria gonorrhoeae
atgtatcgccaaatcggaatgtgggatcaaaaatgggtcatcggcaactggaaaatgaacggccggctccaaaacaacaacgcactgatgcaccgcttccgcatcctccccaccgccgaacgcgtcctcatcggactcgccgccccgaccgtttacctgctgcaactgcacaacgccatgcaaatcgtcttaaacaaccgcatcctcacctgcgcccaagacgtgagccgcttccccgacaacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccattattgtgcgtcggcgaaagcctcgaagagcgcgaaaccggcaaagaacacgaagtcatcgcccatcagctttccatcctgcaagggctggataccaaaaacatcgccgtcgcctacgaacccgtctgggcaatcggcacaggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacggcgcactcgtcggcggcgcgtcattgtcgtacgactcctttaccgccatcatcagtgccgcacaaaatgcg

SEQ ID NO: 1522 - protein, 257 aa, Neisseria gonorrhoeae
MYRQIGMWDQKWVIGNWKMNGRLQNNNALMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEERETGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 1523 - DNA, 525 bp, Neisseria gonorrhoeae
atgtatgcaaatatgggagatatgatgcacgcgcttcatttttcggcttcggacaaggccgcgctttatcgtgaggtgttgccgcagattgagtctgtggtggcggacgaggcggattgggtggcgaatttggcgaacacggcggcggttttgaaggaggcgttcggctggttgtgggtgggtttttattttgtcgatacgcgttcggacgaattggttttggcaccgtttcagggacctttggcgtgtacgcggattccgttcgggcgcggggtgtgcggtcaggcttgggcgaagggtgaaacggtggttgttaaggatgtgaacgcgcatcccgaccatattgcctgttcgtctttgtcgcgttcggagattgtcgtgccgctgttttcagacggccgctgtatcggcgtgttggacgcggacagcgaacatttggcgcagtttgatgaggcagatgctttgtatttgggcgaactggcgaagattttggagaggcggtttgaggcttcgagtcaggcggct

SEQ ID NO: 1524 - protein, 175 aa, Neisseria gonorrhoeae
MYANMGDMMHALHFSASDKAALYREVLPQIESVVADEADWVANLANTAAVLKEAFGWLWVGFYFVDTRSDELVLAPFQGPLACTRIPFGRGVCGQAWAKGETVVVKDVNAHPDHIACSSLSRSEIVVPLFSDGRCIGVLDADSEHLAQFDEADALYLGELAKILERRFEASSQAA

SEQ ID NO: 1525 - DNA, 507 bp, Neisseria gonorrhoeae
atggagctgccgcttgccaacggtcataagatgctcgagccgaaagtcgtggcgcggctggcgcagggcttgaagctgacgaaaaacgatacggttttggaaatcggcacgggttcgggctatgcgacggctctgttggcaaaactggctggccgtgtggtttcggacgacatcgatgccgaacggcaaaagcgcgccaaagcggttttggacggcttgtctttggaaaacatcgattatgtgcaaaataacgggttgaccgaactttccgcaggtgcgccgtttgatgcggtttacgtcggcggcgcggtaacccttgtgcctgaagtgttaaaggaacagttgaaggacggcgggcgtatggcggttattgtgggacgcaggccggtgcagcgcgcgcttttgattacgcgcaggggcgatgtgtttgaagagaaggtgctgttcgatactttggtggcgcatttggacgacaaggatgcccatcctttcgacagttttaatttt

SEQ ID NO: 1526 - protein, 169 aa, Neisseria gonorrhoeae
MELPLANGHKMLEPKVVARLAQGLKLTKNDTVLEIGTGSGYATALLAKLAGRVVSDDIDAERQKRAKAVLDGLSLENIDYVQNNGLTELSAGAPFDAVYVGGAVTLVPEVLKEQLKDGGRMAVIVGRRPVQRALLITRRGDVFEEKVLFDTLVAHLDDKDAHPFDSFNF

SEQ ID NO: 1527 - DNA, 369 bp, Neisseria gonorrhoeae
ttggggcttcagacggcattttgcttggtttttttcggggggtttgtgatggatattgtgcaacttccgtcggcggcattgaaggcgtggatggacgaagggcggatgttttgtttgttggacgtgcgtacggatgaagaagcggcggtttgttcgctgccaaatgcgctgcatatcccgatgaatctgattccgctgcggcaaaacgagttgccggacgatgtgccgcttgtggtgtattgccatcacggtatccgcagcctgcatacggcgatgtatttggcggaggcgggttttgaaaacctgtacaaccttcagggcggcatcgacgcgtgggcggttgaggttgacgcggaaatggcgcggtat

SEQ ID NO: 1528 - protein, 123 aa, Neisseria gonorrhoeae
LGLQTAFCLVFFGGFVMDIVQLPSAALKAWMDEGRMFCLLDVRTDEEAAVCSLPNALHIPMNLIPLRQNELPDDVPLVVYCHHGIRSLHTAMYLAEAGFENLYNLQGGIDAWAVEVDAEMARY

SEQ ID NO: 1529 - DNA, 105 bp, Neisseria gonorrhoeae
ttttaacaaagaatgcccctgatggggcaagctattcttattcagaccaaggaccagtatgttagacaatttaaccggccgcttcagcaatgtcttcaaaaacat

SEQ ID NO: 1530 - protein, 33 aa, Neisseria gonorrhoeae
QRMPLMGQAILIQTKDQYVRQFNRPLQQCLQKH

SEQ ID NO: 1531 - DNA, 234 bp, Neisseria gonorrhoeae
ttgcctcgccttgccgtaccatctgtactgtctgcggcttcgtcgttttgtcctgatttaaatttaatccactatacaatcaatatatttaagtcgttgttagccctcttggttctgtcaatgccgtccaatacagtccggtgcaatgagccattttcaggaagtatggttgggaatatttttgatatatcaaaaataaaatcaagttcaatcaatatcccgagtgaaaccctg

SEQ ID NO: 1532 - protein, 78 aa, Neisseria gonorrhoeae
LPRLAVPSVLSAASSFCPDLNLIHYTINIFKSLLALLVLSMPSNTVRCNEPFSGSMVGNIFDISKIKSSSINIPSETL

SEQ ID NO: 1533 - DNA, 762 bp, Neisseria gonorrhoeae
ttggggtgcaggctgcctttaaggttcaggcaaattttaacttcgttgatactgcgctttagcttcgcagaagctgcactttcagacgacctttatggaacaccagaggtacacgcatttaaggaatgccgtctgaagccgccttcaataccgcgccatttccgcgtcaacctcaaccgcccacgcgtcgatgccgccctgaaggttgtacaggttttcaaaacccgcctccgccaaatacatcgccgtatgcaggctgcggataccgtgatggcaatacaccacaagcggcacatcgtccggcaactcgttttgccgcagcggaatcagattcatcgggatatgcagcgcatttggcagcgaacaaaccgccgcttcttcatccgtacgcacgtccaacaaacaaaacatccgcccttcgtccatccacgccttcaatgccgccgacggaagttgcacaatatccatcacaaaccccccgaaaaaaaccaagcaaaatgccgtctgaagccccaaacccgctttcagacggcatcacaatccgaacatcaaaaattaaaactgtcgaaaggatgggcatccttgtcgtccaaatgcgccaccaaagtatcgaacagcaccttctcttcaaacacatcgcccctgcgcgtaatcaaaagcgcgcgctgcaccggcctgcgtcccacaataaccgccatacgcccgccgtccttcaactgttcctttaacacttcaggcacaagggttaccgcgccgccgacg

SEQ ID NO: 1534 - protein, 254 aa, Neisseria gonorrhoeae
LGCRLPLRFRQILTSLILRFSFAEAALSDDLYGTPEVHAFKECRLKPPSIPRHFRVNLNRPRVDAALKVVQVFKTRLRQIHRRMQAADTVMAIHHKRHIVRQLVLPQRNQIHRDMQRIWQRTNRRFFIRTHVQQTKHPPFVHPRLQCRRRKLHNIHHKPPEKNQAKCRLKPQTRFQTASQSEHQKLKLSKGWASLSSKCATKVSNSTFSSNTSPLRVIKSARCTGLRPTITAIRPPSFNCSFNTSGTRVTAPPT

SEQ ID NO: 1535 - DNA, 2175 bp, Neisseria gonorrhoeae
atgacacgcttcaaatactccctgctttttgccgccctgctacccgtgtacgcgcaggccgatgtttctgtttcagacgaccccaaaccgcaggaaagcaccgaattgccgaccatcaccgttaccgccgaccgcaccgcgagttccaacgacggctacaccgtttccggcacgcacaccccgttcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgccggacggcacgggcgagccttctgccaccgtcaatctggtacgcaaacacccgacccgcaagccattgtttgaagtccgcgccgaagccggcaaccgcaaacatttcgggctgggcgcggacgtatcgggcagcctgaacgccgaaggcacgctgcgcggccgcctggtttccaccttcggacgcggcgactcgtggcggcagctcgaacgcagccgcgatgccgaactctacggcattttggaatacgacatcgcaccgcaaacccgcgtccacgcaggcatggactaccagcaggcgaaagaaaccgcagacgcgccgctcagctacgccgtgtacgacagccaaggttatgccaccgccttcggcccaaaagacaaccccgccacaaattggtcgaacagccgcaaccgtgcgctcaacctgttcgccggcatagaacaccgcttcaaccaagactggaaactcaaagccgaatacgactacacccgtagccgcttccgccagccctacggtgtggcaggcgtactttccatcgaccacagcactgccgccaccgacctgattcccggttattggcacgccgatccgcgcacccacagcgccagcatgtcattgaccggcaaataccgcctgttcggccgcgagcacgatttaatcgcgggtatcaacggctacaaatacgccagcaacaaatacggcgaacgcagcatcattcccaacgccattcccaacgcctacgaattttcccgcacgggcgcctatccgcagccatcatcgtttgcccaaaccatcccgcaatacgacaccaggcggcaaatcggcggctatctcgccacccgtttccgcgccgccgacaacctttcgctgatactcggcggcagatacagccgctaccgcgcaggcagctacaacagccgcacacaaggcatgacctatgtgtccgccaaccgtttcaccccctacacaggcatcgtgttcgatctgaccggcaacctgtcgctttacggctcgtacagcagcctgttcgtcccgcaattgcaaaaagacgaacacggcagctacctgaaacccgtaaccggcaacaatctggaagccgacatcaaaggcgaatggcttgaagggcgtctgaacgcatccgccgccgtgtaccgcgcccgtaaaaacaacctcgccaccgcagcaggacgcgaccagagcggcaacacctactatcgcgccgccaaccaagccaaaacccacggctgggaaatcgaagtcggcggccgcatcacgcccgaatggcagatacaggcaggctacagccaaagcaaaccccgcgaccaagacggcagccgcctgaaccccgacagcgtacccgaacgcagcttcaaactcttcaccgcctaccacttagcccccgaagcccccagcggccggaccatcggtgcgggtgtgcgccggcagggcgaaacccacaccgacccagccgcgctccgcatccccaaccccgccgccaaagcccgcgccgtcgccaacagccgccagaaagcctacgccgtcgccgacatcatggcgcgttaccgcttcaatccgcgcaccgaactgtcgctgaacgtggacaacctgttcaacaaacactaccgcacccagcccgaccgccacagctacggcgcactgcggacagtgaacgcggcgtttacctatcggtttaaa

SEQ ID NO: 1536 - protein, 725 aa, Neisseria gonorrhoeae
MTRFKYSLLFAALLPVYAQADVSVSDDPKPQESTELPTITVTADRTASSNDGYTVSGTHTPFGLPMTLREIPQSVSVITSQQMRDQNIKTLDRALLQATGTSRQIYGSDRAGYNYLFARGSRIANYQINGIPVADALADTGNANTAAYERVEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALRIPNPAAKARAVANSRQKAYAVADIMARYRFNPRTELSLNVDNLFNKHYRTQPDRHSYGALRTVNAAFTYRFK

SEQ ID NO: 1537 - DNA, 321 bp, Neisseria gonorrhoeae
atgcaaaacgaaaccatcaacctgaaacagcaccttgccgccatcaaagaatactggcagcccgaaatcatcaaccgccacgggttccaattccgcctggtcaaacttttggtcgattacggctggcacacgcacggatacagcgacaaagtgctgtttgccgtggagggcgacatggcggtggacttcgccgacggcggcaacatgacgatacgcgagggcgagatggcggtcgtgccgaagtcggtgtcgcaccgcccgcgttcggaaaacggctgctcggtggtgctgattgatctgcccgacccgtccgaggccgcc

SEQ ID NO: 1538 - protein, 107 aa, Neisseria gonorrhoeae
MQNETINLKQHLAAIKEYWQPEIINRHGFQFRLVKLLVDYGWHTHGYSDKVLFAVEGDMAVDFADGGNMTIREGEMAVVPKSVSHRPRSENGCSVVLIDLPDPSEAA

SEQ ID NO: 1539 - DNA, 969 bp, Neisseria gonorrhoeae
gtgaaaccgcgtttttattgggcagcctgcgccgtcctgccggccgcctgttcgcccgaacctgccgccgaaaaaactgtatccgccgcatcccaagccgcatccacacctgtcgccacgctgaccgtgccgaccgcgcggggcgatgccgttgtgccgaagaatcccgaacgcgtcgccgtgtacgactgggcggcgttggatacgctgaccgagccgggcgtgaatgtgggcgcaaccaccgcgccggtgcgcgtggactatttgcagcctgcatttgacaaggcggcaacggtggggacgctgtttgagcccgattgcgaatccctgcaccgccacaatccgcagtttgtcattaccggcgggccgggtgcggaagcgtatgaacagttggcgaaaaacgcgaccaccatagatttgacggtggacaacggcaatatccgcaccagcggcgagaagcagatggagaccctgtcgcggattttcggtaaggaagcgcgcgtggcggaattgaatgcgcagattgacgcgctgttcgcccaaaagcgcgaagccgccaaaggcaaaggacgcgggctggtgctgtcggttacaggcaacaaggtgtccgccttcggcacgcaatcgcggttggcaagttggatacacggcgacatcggcctgccgcccgtggacgaatctttacgcaacgaagggcacgggcagcccgtttccttcgaatacatcaaagagaaaaaccccggctggattttcatcatcgaccgcaccgccgccatcgggcaggaagggccggctgccgtggaagtgttggataacgcgctggtatgcggcacgaacgcttggaagcgcaagcaaatcatcgtcatgcctgccgcgaactacattgtcgcgggcggcgcgcggcagttgatacaggcggcggaacagttgaaggcggcgtttgaaaaggcagaacccgttgcggcgcag

SEQ ID NO: 1540 - protein, 323 aa, Neisseria gonorrhoeae
VKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 1541 - DNA, 162 bp, Neisseria gonorrhoeae
ttggaacggaaaaggtcgtctgaaagggtgtttcagacgaccttttccgtttcgggaatttgttttgccgtatcgggaattttgcgttttgcggcgtggtttctgcaggttgtttgcttaataataaacattcttattcgtatgcaaaggaaccgcacaccg

SEQ ID NO: 1542 - protein, 54 aa, Neisseria gonorrhoeae
LERKRSSERVFQTTFSVSGICFAVSGILRFAAWFLQVVCLIINILIRMQRNRTP

SEQ ID NO: 1543 - DNA, 825 bp, Neisseria gonorrhoeae
atgtgcatcaaccgcttcgactcgggcatcaccttatcacggatgcgcggcggcggaacgggtgcgtttcccaccgaaatccacaatttcagccacaactgcgccttgttcgtcatggtatcggggcagaaccggttacaaatgggcggcagggaataccgcccgtctgccggcgaaatctggctggtacgcggcgaactggcggacgtatccgaaaccctgctgccagacagcggcggcatgtgcgcgctgcatttggatttttcgctggaaaaactgcgccgctggcacgacgaaggtttactggacgaacgcctgttttcgccgcaaacgataggccgattcgccctgcaacggctggcgcaaaacgcggggacactgacggcggcggcctgccccctgctgcaacgcccgttcgaatcggacggcttcggcctgctcgccgacgaagccgacgcgctggaactctccgcccgattattacgcttcaccttccgccgccacgacaacggctaccgccgccggcgcatagacgaagccgccgatattttgaacagcgaattcgcccgcccgctgaccatcgccgaaatcgcccgccgcgtcgggctgaacgaatgctacctgaaacgctatttcaaagcgcaaaccggcgaaaccgtcgccggacgcctgcgccgcctgcggctggaacacgcgctcgccctcatcgaatcgggcagcaccatccaagccgcgatgcacttttgcggctaccgccacgcgggacggttcaacgaagcgttcaggcggcattacggatttttgccttcggatgtgaaaaagtgc

SEQ ID NO: 1544 - protein, 275 aa, Neisseria gonorrhoeae
MCINRFDSGITLSRMRGGGTGAFPTEIHNFSHNCALFVMVSGQNRLQMGGREYRPSAGEIWLVRGELADVSETLLPDSGGMCALHLDFSLEKLRRWHDEGLLDERLFSPQTIGRFALQRLAQNAGTLTAAACPLLQRPFESDGFGLLADEADALELSARLLRFTFRRHDNGYRRRRIDEAADILNSEFARPLTIAEIARRVGLNECYLKRYFKAQTGETVAGRLRRLRLEHALALIESGSTIQAAMHFCGYRHAGRFNEAFRRHYGFLPSDVKKC

SEQ ID NO: 1545 - DNA, 879 bp, Neisseria gonorrhoeae
gtgcatcaaccgcttcgactcgggcatcaccttatcacggatgcgcggcggcggaacgggtgcgtttcccaccgaaatccacaatttcagccacaactgcgccttgttcgtcatggtatcggggcagaaccggttacaaatgggcggcagggaataccgcccgtctgccggcgaaatctggctggtacgcggcgaactggcggacgtatccgaaaccctgctgccagacagcggcggcatgtgcgcgctgcatttggatttttcgctggaaaaactgcgccgctggcacgacgaaggtttactggacgaacgcctgttttcgccgcaaacgataggccgattcgccctgcaacggctggcgcaaaacgcggggacactgacggcggcggcctgccccctgctgcaacgcccgttcgaatcggacggcttcggcctgctcgccgacgaagccgacgcgctggaactctccgcccgattattacgcttcaccttccgccgccacgacaacggctaccgccgccggcgcatagacgaagccgccgatattttgaacagcgaattcgcccgcccgctgaccatcgccgaaatcgcccgccgcgtcgggctgaacgaatgctacctgaaacgctatttcaaagcgcaaaccggcgaaaccgtcgccggacgcctgcgccgcctgcggctggaacacgcgctcgccctcatcgaatcgggcagcaccatccaagccgcgatgcacttttgcggctaccgccacgcgggacggttcaacgaagcgttcaggcggcattacggatttttgccttcggatgtgaaaaagtgctgatgggccgacggcatagatattttgatttgaaacaaccattaaaaaagatcgtc

SEQ ID NO: 1546 - protein, 293 aa, Neisseria gonorrhoeae
VHQPLRLGHHLITDARRRNGCVSHRNPQFQPQLRLVRHGIGAEPVTNGRQGIPPVCRRNLAGTRRTGGRIRNPAARQRRHVRAAFGFFAGKTAPLARRRFTGRTPVFAANDRPIRPATAGAKRGDTDGGGLPPAATPVRIGRLRPARRRSRRAGTLRPIITLHLPPPRQRLPPPAHRRSRRYFEQRIRPPADHRRNRPPRRAERMLPETLFQSANRRNRRRTPAPPAAGTRARPHRIGQHHPSRDALLRLPPRGTVQRSVQAALRIFAFGCEKVLMGRRHRYFDLKQPLKKIV

SEQ ID NO: 1547 - DNA, 1278 bp, Neisseria gonorrhoeae
ttgcgcgaagtccgactcgccctgcttgaggcggatgtcgccctgcctgtcgtcaaagagttcgtcaacaacgtcaaagaaaaggccctcggtcaggaagtggcgggcagcctgacgcctgaccaagcctttatcggcgtggtcaaccaagccttagtcgaactgatgggcaaggaaaacaaaacactggatttatcggtttcaccgcctgccatcattttgatggccggtttgcagggtgccggtaagacaacaaccgtcggcaaactcgcccgcctgctgaaaaacgatcagaagaaaaaagttttggtggtatccgccgacgtttaccgccctgccgcgattgaacagctgcgcctgttggccgaacaggtcggcgtagattttttcccatccgataccaaccaaaaaccggttgagattgcaactgccgccgttgattacgccaaaaaacatttttacgatgtattgatggtcgataccgccggccgtttggcaatcgatgaagagatgatgaacgaaatcaaagcgcttcatgcggtggtcaacccggttgaaactttgttcgttatcgatgccatgctgggtcaggatgcggtaaataccgctcaggcatttaatgaagccctgccgctgaacggcgtcgtattgaccaagatggacggcgactcgcgcggcggtgcggcattgtccgtacgccatgtaaccggcaaaccgattaaatttatcggcgtcggcgagaaaatcaacggcctcgaacctttccaccccgaccgtcttgccagccgtatcctcggcatgggcgacgtattgaccctgattgaagacgttcaaaaaggtattgatgaagaagccgccgccaaaatggcgaaaaagctgcaaaaaggcaaaggctttgacctcaatgattttaaagaacaaatccagcaaatgcgcaatatgggcggtttggaaaacctgatgtcgaaaatgccgggcgaactgggtcaaatatcgaaacaaatccccgaaggtacggctgaaaaagcgatgggcaaagtagaagccatcatcaactcgatgacccctaaagaacgcgccaaccctgccctgctcaaagccggccgcaaacgccgtattgcgatgggcgcgggcacgaccgtgcaggaagtgaacaaattgctcaaacagtttgaacaaatgcagcagatgatgaagatgttcagcggcaacggtttgggcaaactgatgcgcttggccaaaggcatgaagggaataaagggaatgtttcccggtctt

SEQ ID NO: 1548 - protein, 426 aa, Neisseria gonorrhoeae
LREVRLALLEADVALPVVKEFVNNVKEKALGQEVAGSLTPDQAFIGVVNQALVELMGKENKTLDLSVSPPAIILMAGLQGAGKTTTVGKLARLLKNDQKKKVLVVSADVYRPAAIEQLRLLAEQVGVDFFPSDTNQKPVEIATAAVDYAKKHFYDVLMVDTAGRLAIDEEMMNEIKALHAVVNPVETLFVIDAMLGQDAVNTAQAFNEALPLNGVVLTKMDGDSRGGAALSVRHVTGKPIKFIGVGEKINGLEPFHPDRLASRILGMGDVLTLIEDVQKGIDEEAAAKMAKKLQKGKGFDLNDFKEQIQQMRNMGGLENLMSKMPGELGQISKQIPEGTAEKAMGKVEAIINSMTPKERANPALLKAGRKRRIAMGAGTTVQEVNKLLKQFEQMQQMMKMFSGNGLGKLMRLAKGMKGIKGMFPGL

SEQ ID NO: 1549 - DNA, 129 bp, Neisseria gonorrhoeae
ttgtcggagataaaaagtcagaacaagccgaaacattttctgcgcgaaacggcattctatcaaagattatgccgtctgaaagcggcagggggggcagattcgcgccccgccggacgttcagacggcatt

SEQ ID NO: 1550 - protein, 43 aa, Neisseria gonorrhoeae
LSEIKSQNKPKHFLRETAFYQRLCRLKAAGGADSRPAGRSDGI

SEQ ID NO: 1551 - DNA, 117 bp, Neisseria gonorrhoeae
ttgtttttgattttaaatagaatttttattattttaatcttactgttctttccgctccaaagattctgtatgattcggcaattcctgccgtacggacaacgtaaaaaaatactacat

SEQ ID NO: 1552 - protein, 39 aa, Neisseria gonorrhoeae
LFLILNRIFIILILLFFPLQRFCMIRQFLPYGQRKKILH

SEQ ID NO: 1553 - DNA, 1863 bp, Neisseria gonorrhoeae
atgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttggga

SEQ ID NO: 1554 - protein, 621 aa, Neisseria gonorrhoeae
MQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 1555 - DNA, 1161 bp, Neisseria gonorrhoeae
ttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgataggcgtgattgacggaaccgatatggaatacgcgggcgttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgc

SEQ ID NO: 1556 - protein, 387 aa, Neisseria gonorrhoeae
LSQLGIRLVLIHGAYHFLDRLAAAQGRTPHYCRGLRVTDETSLGQAQQFAGTVRSRFEAALCGSVSGFARAPSVPLVSGNFLTARPIGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 1557 - DNA, 426 bp, Neisseria gonorrhoeae
atgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgatttgcccgaagctgtttcggatgtcaaactcgtccaccgcatcggcacgcacgccattagcaagaaacagatttcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatccta

SEQ ID NO: 1558 - protein, 142 aa, Neisseria gonorrhoeae
MPACFCPHCKTRLWVKETQLNVAQGFVVCQKCEGLFKAKDHLASTKEPIFNDLPEAVSDVKLVHRIGTHAISKKQISRDEIADILNGGTTLHDTPPATAAAAPAAAPQVSVPPARQEGLNWTIATLFALIVLIMQLSYLFIL

SEQ ID NO: 1559 - DNA, 609 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgatttgcccgaagctgtttcggatgtcaaactcgtccaccgcatcggcacgcacgccattagcaagaaacagatttcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatgaacgcgcccgacagctttgtcgcccacttccgcgaagccgccccctacatccgccaaatgcgcggcacgacactggtcgccggcatagacggccgcctgctcgaaggcggcaccttaaa

SEQ ID NO: 1560 - protein, 203 aa, Neisseria gonorrhoeae
MPSEPPAASDGIKPTHTEKTSCPPVSVRTAKPASGSKKPSSTSPKASSSAKNAKGCLKPKTIWQARKNLYSTICPKLFRMSNSSTASARTPLARNRFPATKSPISSTAVQPCTIRRPQPPLPHLPPHRRFPYRPPVRKGSTGLLQPCSHLSSSLCSFPTSSSYERARQLCRPLPRSRPLHPPNARHDTGRRHRRPPARRRHLK

SEQ ID NO: 1561 - DNA, 639 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaa

SEQ ID NO: 1562 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 1563 - DNA, 804 bp, Neisseria gonorrhoeae
ttgtgcgcggtaaagctgataatgtcggcgtttgcgccaccagaaccacgccagcgccgccgccagcacgcccaatgcgatgaagatgcccgattgcaggctgtgcattttcgccatcagccaatcgatgttgtgcgcgccgtactcgcccaagtaaatccaaacgggcacggaaatcagcgcggccagcccgtccataatcagaaagcgcagatacgatactttgcggctgatgccggcggtaacgaaaacggcagtccgcaaacccggcaggaaacgggcgacaaacagaacccagttgccgtatttgtcgaatttttcctgaacctgcgcgtaacgtttcggcgtcatgatgcgcgcaatcggtttgaacttgaggattttctgcccccagatgcgtccggcggcaaacatcacgccgtcgcccgccaacacgccgagcataccgaccgcaaacataatatgcggattggtataacccatacccgaaatcacgccgcccgttaccaaggtcaaatcttcgggaatcggcacgccgaaaccgcagatgaccaaaacgaaaaacacggccgcatagccgtattcgacaaaaaaggcttccaaaagggcaaacatagcggatattccattgtcggagataaaaagtcagaacaagccgaaacattttctgcgcgaaacggcattctatcaaagattatgccgtctgaaagcggcagggggggcagattcgcgccccgccggacgttcagacggcatttaaacaggaaaaccgccgctgttgaaacggttttgcctgattttgcc

SEQ ID NO: 1564 - protein, 268 aa, Neisseria gonorrhoeae
LCAVKLIMSAFAPPEPRQRRRQHAQCDEDARLQAVHFRHQPIDVVRAVLAQVNPNGHGNQRGQPVHNQKAQIRYFAADAGGNENGSPQTRQETGDKQNPVAVFVEFFLNLRVTFRRHDARNRFELEDFLPPDASGGKHHAVARQHAEHTDRKHNMRIGITHTRNHAARYQGQIFGNRHAETADDQNEKHGRIAVFDKKGFQKGKHSGYSIVGDKKSEQAETFSARNGILSKIMPSESGRGGRFAPRRTFRRHLNRKTAAVETVLPDFA

SEQ ID NO: 1565 - DNA, 651 bp, Neisseria gonorrhoeae
atgttttccgtaccgcgttcctttttgccgggcgttttcgtacttgccgcgcttgccgcctgcaaacctcaagacaacagtgcggcgcaagccgcttcttcaagtgcatccgcgccggctgcggaaaatgcggcaaagccgcaaacgcgcggtacggatatgcgtaaggaagacatcggcggcgatttcacactgaccgacggcgaaggcaagcctttcagcctgagcgatttgaaaggcaaggtcgtgattctgtctttcggctttacgcactgtcccgatgtctgcccgacagggcttttgacgtacagcgacactttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaaatcaatcaaaaagacgacagcgaaaactatttggtcgaccactcttccggtgcgtatcttatcgataaaaacggtgaggttgccattttctcgccttacggaagcgagccggaaacgattgctgccgatgtaaggaccctgctc

SEQ ID NO: 1566 - protein, 217 aa, Neisseria gonorrhoeae
MFSVPRSFLPGVFVLAALAACKPQDNSAAQAASSSASAPAAENAAKPQTRGTDMRKEDIGGDFTLTDGEGKPFSLSDLKGKVVILSFGFTHCPDVCPTGLLTYSDTLKQLGGQAKDVKVVFVSIDPERDTPEIIGKYAKQFNPDFIGLTATGGQNLPVIKQQYRVVSAKINQKDDSENYLVDHSSGAYLIDKNGEVAIFSPYGSEPETIAADVRTLL

SEQ ID NO: 1567 - DNA, 93 bp, Neisseria gonorrhoeae
tttcaaaacaggttgatgcacccttcctcgaatttccgaatagctaaaacatgcctgctcgtgcgacaatttcacacctgcaaaatcaagcaa

SEQ ID NO: 1568 - protein, 31 aa, Neisseria gonorrhoeae
FQNRLMHPSSNFRIAKTCLLVRQFHTCKIKQ

SEQ ID NO: 1569 - DNA, 735 bp, Neisseria gonorrhoeae
atgttaagcgcgcgctacctccacctgcacgaggctttgggcttgggtccgatgtggctgaaacaggccgccgccgtcctgccgcccaaaaacacacccgcaaccccggcacaggcacgtccccaaaccgtccgcgccgccacgatccgcccttcccaaccccataacgttcagacgcggctcgaaacgatgaaagcgttggaaaccgccgccgtacatacgcgcaaacccgcgcctgagaccgaaacgcccccgcccggcctttcagacggcatcgcccccgttcccgccgcttcgggcatcaccaagcttgccgtcgtcagcctgtgtccgccgatcgaggatgcggtttacgggcaactgttccacggcaaagcgggcatcctgctcgacaacatcctcaaagccgcaggactggatgccgcctatgtccacaaaacctgttgggtgaaaaccgccgccgtcggtaacccgatgccgtctgaacaggccgtcgcggatgcgctgggtcaaatcgccagggaactcgacggctgccgcgcccccgccgtcctattcctcggacaggcgtttgtcaacctggaacggcaggcgatgattgaaactttgtgcggcagccgtcccttcttcatcatcgaccatcccgcccggctgttgcgccaacccgaactcaaagcccgaaactggcaggtgttgaaacagttgaaacgcgccttgcggcaaggcggcggcagt

SEQ ID NO: 1570 - protein, 245 aa, Neisseria gonorrhoeae
MLSARYLHLHEALGLGPMWLKQAAAVLPPKNTPATPAQARPQTVRAATIRPSQPHNVQTRLETMKALETAAVHTRKPAPETETPPPGLSDGIAPVPAASGITKLAVVSLCPPIEDAVYGQLFHGKAGILLDNILKAAGLDAAYVHKTCWVKTAAVGNPMPSEQAVADALGQIARELDGCRAPAVLFLGQAFVNLERQAMIETLCGSRPFFIIDHPARLLRQPELKARNWQVLKQLKRALRQGGGS

SEQ ID NO: 1571 - DNA, 438 bp, Neisseria gonorrhoeae
atgaacatccgcccagcctcaccgtccgactgcgccgcactggccgcgctcgataccgtctgcaacccgtccgcgtggacgcaacgccaatttgagtccgcgcttgtttcgccgtccgaacaggttttccttgcggaaaaagacggcaggattgccgcctttatcgtttggcagaacctgcccgacgaatccgaactgcacctgattgccaccgcgcccgaatgccgccgacggggcgttgcgtccgccctgctcgaatattggtacgcacatctgcccgaaggcacgcaacgcctgctgctcgaagtccgcgcaggcaacgccgccgcacaggcactgtataccaaacacggcttcagcattgcgggcaggcggaaaaactattactgcgccgccgacgggcaaaccgaagatgccgtcttaatggagaaaatatgt

SEQ ID NO: 1572 - protein, 146 aa, Neisseria gonorrhoeae
MNIRPASPSDCAALAALDTVCNPSAWTQRQFESALVSPSEQVFLAEKDGRIAAFIVWQNLPDESELHLIATAPECRRRGVASALLEYWYAHLPEGTQRLLLEVRAGNAAAQALYTKHGFSIAGRRKNYYCAADGQTEDAVLMEKIC

SEQ ID NO: 1573 - DNA, 798 bp, Neisseria gonorrhoeae
ttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccgg

SEQ ID NO: 1574 - protein, 266 aa, Neisseria gonorrhoeae
LVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 1575 - DNA, 675 bp, Neisseria gonorrhoeae
atgcaagccgatttcaaccgccccgtcctcgccgtcgataccggaacttcctatttgtcgctcgcgctgcgcgccgacggcgaaatccgtctgttccatcaggaagtcggcatccgccagtccgaactgatcctgccggaaatccgcaccctattccgaaatgcgggcattaccgccgccgatttgggggcgattgtttatgcgaaaggccccggcgcgtttaccggactgcgtatcggcatcggcgtggcgcaaggtttggcaacgccgttcgacacgcctttaatcggcatccccacgctcgatgccgccgcctcgctgccgccgccgcaaagctgcatactcgccgctgcggacgcgcgtatgggcgaagtgttttatgcgtggttcgacacgctgaaccgccgccgtttgagcgattatcaagtcggtagggcggcagacattgccctccccgaggggtacgtcttttcagacggcatcggcagtgcgttcgcactggaaaaccgtccgcccttctcaggcaaacccgatatgccgaccgccgccgattttctcgcgctcgccctcggcggcggctatcccgcaactggcgcggcacacgccgaactgctctacgtccgcaacaaaatcgccctgactgccaaagaacaggcggaacggaaggcacgaaca

SEQ ID NO: 1576 - protein, 225 aa, Neisseria gonorrhoeae
MQADFNRPVLAVDTGTSYLSLALRADGEIRLFHQEVGIRQSELILPEIRTLFRNAGITAADLGAIVYAKGPGAFTGLRIGIGVAQGLATPFDTPLIGIPTLDAAASLPPPQSCILAAADARMGEVFYAWFDTLNRRRLSDYQVGRAADIALPEGYVFSDGIGSAFALENRPPFSGKPDMPTAADFLALALGGGYPATGAAHAELLYVRNKIALTAKEQAERKART

SEQ ID NO: 1577 - DNA, 183 bp, Neisseria gonorrhoeae
ttgaaatcggcttgcatggtgtggttctcgttggttcagacggcattatatagtgaaatcggcttgcctgccgtgtcgtcgtgtcctagggcggtatggcgcaaaaatgccgtccgaacggtaaattatcgtgttcggacggcatttttcaaatactactgtttgtcggcgatgccgatttcg

SEQ ID NO: 1578 - protein, 61 aa, Neisseria gonorrhoeae
LKSACMVWFSLVQTALYSEIGLPAVSSCPRAVWRKNAVRTVNYRVRTAFFKYYCLSAMPIS

SEQ ID NO: 1579 - DNA, 732 bp, Neisseria gonorrhoeae
atgccgtctgcaccgccggtgcctgttcagacggcattattgtttcaaccgacaaaggacatccacaccatgcaggataatgctttgaccatcgccttatccaaagggcgcatttttgaggagacgctgccgctgcttgccgctgccggcattgctccgactgaagagcccgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagccgcttcgcaacccggatgccgtctgaagattgccacgaagtatcctgaaatcgcggcatctcattttgccggcaagggtgtccatgtggacattatcaaactgtacggctcgatggaacttgcgccgctggtcggcttgagcgatgcgattgtggacttggtttcgacgggaaacaccttgaaggcaaacggcttggaggcagtcgaacacatcgtcgacatttccagctacctggtggtcaacaaggctgctttgaaaacgaaatacgcgctgctggagccgattattcagtcgttcggcggcgcagtgaaggcgaagtgggcattcatt

SEQ ID NO: 1580 - protein, 244 aa, Neisseria gonorrhoeae
MPSAPPVPVQTALLFQPTKDIHTMQDNALTIALSKGRIFEETLPLLAAAGIAPTEEPEKSRKLIIGTNHENIRLVIVRATDVPTYVRYGAADFGIAGKDVLIEHGGTGLYRPLDLEIAKCRMMVAVRKGFDYEAASQPGCRLKIATKYPEIAASHFAGKGVHVDIIKLYGSMELAPLVGLSDAIVDLVSTGNTLKANGLEAVEHIVDISSYLVVNKAALKTKYALLEPIIQSFGGAVKAKWAFI

SEQ ID NO: 1581 - DNA, 303 bp, Neisseria gonorrhoeae
cacctgcaaaatcaagcaattattcagaaaatcgtaccgatccggccagggcagtatggtaagtgtgtaccttatgccggacctgcatgttgaaacataaaggaaaaaatcatgaaccgtcgtcaatttttgggcagcgccgctgccgtctctttggcttccgccgcctctttcgcgcgtgcgcacggacacgccgactaccaccatcatcacgatatgcagcctgccgccgcatccgcctacaccgccgtccgccaaactgccgcacactgtctggatgccggacaggtttgcctgacccac

SEQ ID NO: 1582 - protein, 30 aa, Neisseria gonorrhoeae
HLQNQAIIQKIVPIRPGQYGKCVPYAGPAC

SEQ ID NO: 1583 - DNA, 1335 bp, Neisseria gonorrhoeae
atgatggcaaaaaaatatttcggcacggacggcgtgcgcggcgaagtcggtcagtttccgattacgcccgattttgtattgaaactcggctatgcggcggggcaggtgctggtgcagcacgataccgatcagaaaccgaccgtcctcatcggcaaagacacgcgcatttcaggctatatgctggaagccgcgctggtagcgggctttacggcggcgggtgtgaatgtggtacagaccgggccgttgcccacgcccggtgtggcttatctgacccgcgcattgcgcctgtccgccggcgtgatgatttccgcgtcgcacaacacctattccgacaacggcatcaaattctttgccgaaggcggcgtgaaactttccgatgaagtcgagttggaaatcgaagccaaaatcgatgaagaaatgaaaacccaaccgtccgcacgtctcggacgcgcccgccgcatcagcggtgcggacgaccgctatatcgagttttgcaaatccaccttccccggccattccgaccttcggggtttgaagttggttatcgataccgccaacggtgcaggatacggcgttgcacccaaagtgttccacgaactcggcgcacaggtcgtcagcatcggcaacgaacccaacggctacaacatcaacgaaaaatgcggcgcgacccataccaaaaccctccaagccgccgtgttgcaaaacgaagccgattacggtattgccttggacggcgatggcgaccgcctgatgatggtcgataaaaacaggcaggtttacgacggcgacagcctgatttacgtcatcgccaaagcccgcgcccgagaaggtatcaacatcggcggcgtggtcggaacggtcatgaccaatatggcgatggaaatcgccctgaaagagcagggcgtcgatttctgccgcgccaaagtcggcgaccgctatgtgttggaacagctgaaccaacgcggctggctcatcggcggcgaagccagcggccatattttgtgcatggacaaacataacaccggcgacggcattatttccgcgctgcaagtcttggcggcgctgcaaatcctgaaccaagacctcgccaccgtttgcgccgactggcagccgtatccgcaaacgatgattaacgtgcgcatccaaaagggtcagaaatggcaggaggcttcgaaagacgtgttggccgaagtggaaaaagaactcgaaggcaaagggcgtgtcgtgttgcgcgcttcgggaaccgaacccgtcgtgcgcgtgatggtcgaggcgcgtcaggccgattgggcgcgcgacggggcggagcgtatcgccgccgccatcggcggcatt

SEQ ID NO: 1584 - protein, 445 aa, Neisseria gonorrhoeae
MMAKKYFGTDGVRGEVGQFPITPDFVLKLGYAAGQVLVQHDTDQKPTVLIGKDTRISGYMLEAALVAGFTAAGVNVVQTGPLPTPGVAYLTRALRLSAGVMISASHNTYSDNGIKFFAEGGVKLSDEVELEIEAKIDEEMKTQPSARLGRARRISGADDRYIEFCKSTFPGHSDLRGLKLVIDTANGAGYGVAPKVFHELGAQVVSIGNEPNGYNINEKCGATHTKTLQAAVLQNEADYGIALDGDGDRLMMVDKNRQVYDGDSLIYVIAKARAREGINIGGVVGTVMTNMAMEIALKEQGVDFCRAKVGDRYVLEQLNQRGWLIGGEASGHILCMDKHNTGDGIISALQVLAALQILNQDLATVCADWQPYPQTMINVRIQKGQKWQEASKDVLAEVEKELEGKGRVVLRASGTEPVVRVMVEARQADWARDGAERIAAAIGGI

SEQ ID NO: 1585 - DNA, 945 bp, Neisseria gonorrhoeae
ttgatttttgcttctctgacctgcctcattgatgcagtatgcaaaaaaagataccataaccaaaacgtttatatattatctattctgtgtatgactaggagtaaacctgtgaaccgaactaccttctgctgcctttctttgaccgccggccctgattctgaccgcctgcagcagcggaggggcggaggcggtggtgtcgccgccgacatcggcacggggcttgccgatgcattaaccgcgccgctcgaccataaagacaaaggtttgaaatccctaacattggaagcctccattccccaaaacggaacactgaccctgtcggcacaaggtgcggaaaaaactttcaaagccggcggcaaagacaacagcctcaacacgggcaaactgaagaacgacaaaatcagccgcttcgacttcgtgcaaaaaatcgaagtggacggacaaaccatcacactggcaagcggcgaatttcaaatatacaaacaggatcactccgccgtcgttgccctacggattgaaaaaatcaacaaccccgacaaaatcgacagcctgataaaccaacgctccttccttgtcagcgatttgggcggagaacataccgccttcaaccaactgcctgacggcaaagccgagtatcacggcaaagcattcagctccgacgatgccgacggaaaactgacctataccatagatttcgccgccaaacagggacacggcaaaatcgaacacctgaaaacacccgagcagaatgttgagcttgcctccgccgaactcaaagcagatgaaaaatcacacgccgtcattttgggcgacacgcgctacggcggcgaagagaaaggcacttaccgcctcgcccttttcggcgaccgcgcccaagaaatcgctggctcggcaaccgtgaagataggggaaaaggttcacgaaatcggcatcgccgacaaacag

SEQ ID NO: 1586 - protein, 315 aa, Neisseria gonorrhoeae
LIFASLTCLIDAVCKKRYHNQNVYILSILCMTRSKPVNRTTFCCLSLTAGPDSDRLQQRRGGGGGVAADIGTGLADALTAPLDHKDKGLKSLTLEASIPQNGTLTLSAQGAEKTFKAGGKDNSLNTGKLKNDKISRFDFVQKIEVDGQTITLASGEFQIYKQDHSAVVALRIEKINNPDKIDSLINQRSFLVSDLGGEHTAFNQLPDGKAEYHGKAFSSDDADGKLTYTIDFAAKQGHGKIEHLKTPEQNVELASAELKADEKSHAVILGDTRYGGEEKGTYRLALFGDRAQEIAGSATVKIGEKVHEIGIADKQ

SEQ ID NO: 1587 - DNA, 1137 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaa

SEQ ID NO: 1588 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 1589 - DNA, 930 bp, Neisseria gonorrhoeae
ttgtgtgggacggttatggttttggacgggtttgcggcgtattttgacgcttatttggaaaacatcgtgcgcgagggcaagtcggagcacacggttgcggcataccggcgcgatttggaagaactgtttgcactgttggcacaaatgccgtctgaagatgcaggcggcgtgccgcaggacttgtcgcggcgcgattttacggcggcgttgcggcggctgtcgcagcgcggtttggacggtcggacgctggcgcgcaagctgtcggcgtggcggcagtattgcgcctggctggtcaaacgcgggctgatgcgcgccgacccgaccgccgacatcaaaccgccgaagcagcccgagcgcgtacccaaagccctgccgcaggaatggctgaaccggatgttggatttgcccgtggacggcggcgacccgctggcggtgcgcgaccacgcgctgttcgagctgatgtacggcagcggtttgcgcgtgagcgagatacacggcttgaatgcagatgatgtatatttggacgaagcgtgggtacacgttaccggcaaagggcgcaagcagcgtcaggttccgctgaccggcaaaagcgtggaagccttgaaaaactatctgccgctgcgtcagacggcatcggacggcaaagccctgtttaccggcaggaacggcacgcgcctgagccaacgccaaatccaaaaacgcctcgaatcgtgggcggcgcaatacggcgacggcaggcacgtttcgccgcatatgatgcgccacagctacgccggccacctgttgcaggcttcgcgcgacatcagggcggtgcaggagctgctcggacacagcagcctttcgaccacgcagatttataccaagctcgatttcgaccacatcgcccgcctctatgacgaagcccacccgcgcgccaagcggcaggacgaa

SEQ ID NO: 1590 - protein, 310 aa, Neisseria gonorrhoeae
LCGTVMVLDGFAAYFDAYLENIVREGKSEHTVAAYRRDLEELFALLAQMPSEDAGGVPQDLSRRDFTAALRRLSQRGLDGRTLARKLSAWRQYCAWLVKRGLMRADPTADIKPPKQPERVPKALPQEWLNRMLDLPVDGGDPLAVRDHALFELMYGSGLRVSEIHGLNADDVYLDEAWVHVTGKGRKQRQVPLTGKSVEALKNYLPLRQTASDGKALFTGRNGTRLSQRQIQKRLESWAAQYGDGRHVSPHMMRHSYAGHLLQASRDIRAVQELLGHSSLSTTQIYTKLDFDHIARLYDEAHPRAKRQDE

SEQ ID NO: 1591 - DNA, 921 bp, Neisseria gonorrhoeae
gtgggcttcgtcatagaggcgggcgatgtggtcgaaatcgagcttggtataaatctgcgtggtcgaaaggctgctgtgtccgagcagctcctgcaccgccctgatgtcgcgcgaagcctgcaacaggtggccggcgtagctgtggcgcatcatatgcggcgaaacgtgcctgccgtcgccgtattgcgccgcccacgattcgaggcgtttttggatttggcgttggctcaggcgcgtgccgttcctgccggtaaacagggctttgccgtccgatgccgtctgacgcagcggcagatagtttttcaaggcttccacgcttttgccggtcagcggaacctgacgctgcttgcgccctttgccggtaacgtgtacccacgcttcgtccaaatatacatcatctgcattcaagccgtgtatctcgctcacgcgcaaaccgctgccgtacatcagctcgaacagcgcgtggtcgcgcaccgccagcgggtcgccgccgtccacgggcaaatccaacatccggttcagccattcctgcggcagggctttgggtacgcgctcgggctgcttcggcggtttgatgtcggcggtcgggtcggcgcgcatcagcccgcgtttgaccagccaggcgcaatactgccgccacgccgacagcttgcgcgccagcgtccgaccgtccaaaccgcgctgcgacagccgccgcaacgccgccgtaaaatcgcgccgcgacaagtcctgcggcacgccgcctgcatcttcagacggcatttgtgccaacagtgcaaacagttcttccaaatcgcgccggtatgccgcaaccgtgtgctccgacttgccctcgcgcacgatgttttccaaataagcgtcaaaatacgccgcaaacccgtccaaaaccataaccgtcccacacaaatatcaaaaaaccag

SEQ ID NO: 1592 - protein, 307 aa, Neisseria gonorrhoeae
VGFVIEAGDVVEIELGINLRGRKAAVSEQLLHRPDVARSLQQVAGVAVAHHMRRNVPAVAVLRRPRFEAFLDLALAQARAVPAGKQGFAVRCRLTQRQIVFQGFHAFAGQRNLTLLAPFAGNVYPRFVQIYIICIQAVYLAHAQTAAVHQLEQRVVAHRQRVAAVHGQIQHPVQPFLRQGFGYALGLLRRFDVGGRVGAHQPAFDQPGAILPPRRQLARQRPTVQTALRQPPQRRRKIAPRQVLRHAACIFRRHLCQQCKQFFQIAPVCRNRVLRLALAHDVFQISVKIRRKPVQNHNRPTQISKNQ

SEQ ID NO: 1593 - DNA, 1911 bp, Neisseria gonorrhoeae
atgaacccaagccccctactccacctgattgacagcccgcaagatttgcgccgcctggacaaaaaacagctgccgcgccttgccggcgagttgcgcgcctttctgctggaatctgtcgggcagaccggcgggcatttcgccagcaatctgggtgcggtcgaactgaccatcgccctgcactatgtgtacgacacgcccgaagacaagctggtgtgggatgtcggacaccaaagctacccgcacaaaatcctgacaggcaggaaaaaccagatgcacaccatgcgccaatacggcggtttggcgggttttccgaaacgttgcgagtccgagtacgacgcgttcggcgtggggcattcctccacctccatcggcgcggctttgggcatggcggcggcggacaaactcttgggcggcgaccgccgcagcgtcgccatcatcggagacggcgcgatgacggcggggcaggcgtttgaagccttgaattgcgcgggcgatatggatgtggatttgctggtcgtcctcaacgacaacgaaatgtcgatttcccccaacgtcggcgcgttgcccaaatatcttgccagcaacgtcgtgcgcgatatgcacggactgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtcgctgtttgaaaatttcggcttccgctacaccggccccgtggacggacacaacgtcgagaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaggcggggcgcaaatgccgtctgaaaaagaacccaagcccgccgccaaaccgacctatacccaagtattcggcaaatggctgtgcgaccgggcggcggcagattcccgactggttgcgattacccccgccatgcgcgagggcagcggactggtggagtttgaacaacgattccccgaccgctatttcgatgtcggcatcgccgagcagcacgccgttacctttgccggcggtttggcgtgcgaaggcatgaagcccgtcgtggcgatttattccacctttttacaacgcgcctacgaccaactggtgcacgacatcgccctgcaaaacctgcccgttttgtttgccgtcgaccgtgcgggcatcgtcggcgcggacggtccgacccatgccggcttgtacgatttgagcttcttgcgctgtgtgccgaacatgattgttgccgcgccgagcgatgaaaacgaatgccgcctgctgctttcgacctgctatcaggcggatgcgcccgccgccgtccgctatccgcgcggcacgggtacgggcgcgccggtttcagacggcatggaaaccgtggaaatcggcaagggcattatccgccgcgaaggtgagaaaaccgccttcattgccttcggcagtatggtcgccaccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtcttggaagtgttggcgaaacacggcatctgcaaacccgttttgcttttgggcgttgccgataccgtaaccgaacacggcgatccgaaaaaacttttggacgatttgggtttgagtgccgaagcggtggaacgccgggtgcgcgagtggctgccggaccgtgatgcggcaaat

SEQ ID NO: 1594 - protein, 637 aa, Neisseria gonorrhoeae
MNPSPLLHLIDSPQDLRRLDKKQLPRLAGELRAFLLESVGQTGGHFASNLGAVELTIALHYVYDTPEDKLVWDVGHQSYPHKILTGRKNQMHTMRQYGGLAGFPKRCESEYDAFGVGHSSTSIGAALGMAAADKLLGGDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKEGGAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVATALAVAEKLNATVADMRFVKPIDEELIVRLARSHDRIVTLEENAEQGGAGGAVLEVLAKHGICKPVLLLGVADTVTEHGDPKKLLDDLGLSAEAVERRVREWLPDRDAAN

SEQ ID NO: 1595 - DNA, 93 bp, Neisseria gonorrhoeae
gtgcttggtgtgccgttgcgcgtttggaaatttattccgcttgtccgtataacggcggcggtgccgtctgccgatacaaggcaaaatgccgtc

SEQ ID NO: 1596 - protein, 31 aa, Neisseria gonorrhoeae
VLGVPLRVWKFIPLVRITAAVPSADTRQNAV

SEQ ID NO: 1597 - DNA, 177 bp, Neisseria gonorrhoeae
ttgccttgtatcggcagacggcaccgccgccgttatacggacaagcggaataaatttccaaacgcgcaacggcacaccaagcaccgcccgaaagccgccgcccgaacccttcctgccgcctgcggggtttcaataaaaaaaccgcagaaacaaacgccgtttaaaaacgccgcccga

SEQ ID NO: 1598 - protein, 59 aa, Neisseria gonorrhoeae
LPCIGRRHRRRYTDKRNKFPNAQRHTKHRPKAAARTLPAACGVSIKKPQKQTPFKNAAR

SEQ ID NO: 1599 - DNA, 162 bp, Neisseria gonorrhoeae
atgccgcctgaagcgtttcagacggcattttgccttgtatcggcagacggcaccgccgccgttatacggacaagcggaataaatttccaaacgcgcaacggcacaccaagcaccgcccgaaagccgccgcccgaacccttcctgccgcctgcggggtttcaa

SEQ ID NO: 1600 - protein, 54 aa, Neisseria gonorrhoeae
MPPEAFQTAFCLVSADGTAAVIRTSGINFQTRNGTPSTARKPPPEPFLPPAGFQ

SEQ ID NO: 1601 - DNA, 414 bp, Neisseria gonorrhoeae; identical to SEQ ID NO: 129

SEQ ID NO: 1602 - protein, 138 aa, Neisseria gonorrhoeae; identical to SEQ ID NO: 130

SEQ ID NO: 1603 - DNA, 885 bp, Neisseria gonorrhoeae
atggttgcaaaaataaaaaaattctcagattcgaccctttccgttttgaataacggcgagcgtcggttttatgtctattgtctgaccgacctgaaaaaagacaaaatcctctacatcggaaaaggttgcggtaatcgtatcttcgagcatgaatgggttgctagtcgttcacaagacccagtctccggcgagattatcgatcggaaactcaaagccatctccaaatgcaagaaactcggtcgctatatcatcagctatcatctgactgaagtcgaagcgctcgccgccgaatctgccttaattcattttgttaaatctgtcttgggtaaaaaactcaaaaataaaattgccgggcatggtccgggtggtattagcgtagaagaactagatcgccgctttggattctcttctctcccacttagcgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcgtacgaagtggacggttttgaaacaatgactgaggaaaccaaaaacggcagaaaacaaacccgttaccgtttccgtactacctctcgtagcgaagaggtattagccaaactcggtctgcaacaaaaatgcctgcccgaattgaagtttggtagcgggggaggaaaagcgtatatcagacccaaaaccgagcaagagacgcttcagacgatcccaagtcccaaaataacaaaggagaatcccaaatca

SEQ ID NO: 1604 - protein, 295 aa, Neisseria gonorrhoeae
MVAKIKKFSDSTLSVLNNGERRFYVYCLTDLKKDKILYIGKGCGNRIFEHEWVASRSQDPVSGEIIDRKLKAISKCKKLGRYIISYHLTEVEALAAESALIHFVKSVLGKKLKNKIAGHGPGGISVEELDRRFGFSSLPLSEINPDGLILAIKIHNAFDLDTDEELDYLFDNQDDANLKSRTLGNWVIGKDVASKVKYVIGVHTGLQNAVVSAYEVDGFETMTEETKNGRKQTRYRFRTTSRSEEVLAKLGLQQKCLPELKFGSGGGKAYIRPKTEQETLQTIPSPKITKENPKS

SEQ ID NO: 1605 - DNA, 171 bp, Neisseria gonorrhoeae
ttgagttgtcaaccggaagtttgcaaccgaaccgtcggttccgggttggcggccgcatcgggggaagtgtcggcattccccccgattttttacatatcgggcggacgcggcaaatttttgccgttttgtttgcgcgaagggggcgttatacaaaattatcaggcgcaccaa

SEQ ID NO: 1606 - protein, 57 aa, Neisseria gonorrhoeae
LSCQPEVCNRTVGSGLAAASGEVSAFPPIFYISGGRGKFLPFCLREGGVIQNYQAHQ

SEQ ID NO: 1607 - DNA, 105 bp, Neisseria gonorrhoeae
atgatagttattatcatatatgtatttgttctatatgtgagtttgtttgaacaaatgtttatttgcgcggtaaaccatgctacaatctttaacattcatattttg

SEQ ID NO: 1608 - protein, 35 aa, Neisseria gonorrhoeae
MIVIIIYVFVLYVSLFEQMFICAVNHATIFNIHIL

SEQ ID NO: 1609 - DNA, 111 bp, Neisseria gonorrhoeae
gtgatgacgagtgtttacggacacgaagcaaccgataccacgcttccaggaaaagccactaagcttcagtttgaatcgaaccgtaccgcaaaccgacacaggtgggcagga

SEQ ID NO: 1610 - protein, 37 aa, Neisseria gonorrhoeae
VMTSVYGHEATDTTLPGKATKLQFESNRTANRHRWAG

SEQ ID NO: 1611 - DNA, 1521 bp, Neisseria gonorrhoeae
atgccgtctgaaacgcttcaggcggcatttttcggcgtgagggttttaggcttcgacaattttgccgcgcagggaaaaggtgtaggcttcggtgatttccaaatcgatcatttggttgatcatgtcgggcgtgccggtaaagttgacgacgcggttgttgacggtacgggcttggagctggtcggggtcttttttggagatgccttcgaccaggcagcgttgaaccgtgccgatcatggtttggttgatgcgggcggtttcggcttcgatgacttcgttcaaggcttcgaggcggcgcactttttcttcgtgcggcgtgtcgtccggcaggttggcggcaggcgtgccggggcgcgggctgtaaataaacacgaagctcaagtcgaaggcaatgtctttcaccagtttcaaggtttgctcgaactcgcgttcggtctcgccggggaaaccgacgatgaagtcgctgctcaggcacaaatcaggacggatggcgcgcagtttgcggatgatggatttgtattccaaagcggtgtagccgcgtttcatcgcgctcaatacgcggtcggaaccgctttgaatcggcaggtgcaggtgggaaaccagtttgggcaggtcgcggtagcactcgataatcgagtcggtaaactcgcgcgggtggctggtggtgaagcgcatacgttcgatgccggggatttcgtggacgatacgcagcagggtggcgaagtcgcagatttcgccgtcgtccatttcgccgcgataggcattgacgttttgtcccaagaggttgatttctttcacgccttgctgggcaaggttggcgatttcggtcaatacgtcgttgagcgggcgggagaattcttcgccgcgcgtgtaggggacgacgcagaaggagcagtatttggaacagccttccataatcgacacaaatgccgcgccgccttcgacgcgggcgggcggcaggtggtcgaatttttcgatttcggggaaggaaatatcgacttgcgacagcccgctggtttctttgtccacaatcattttgggcaggcggtgcagcgtttgcgggccgaaaaccacatcaacataaggcgcgcgtttgatgatgttttcgccttcttgcgaggcgacgcagccggcaacgccgatgatgaggccggggtttttttctttgagcggacggacgcgccccaagtcggagaacactttttcctgtgctttttcgcgcacggaacaggtgttgaacaagatgatgtcggcttcgtcggcttgggtaacctgttcgatgccgccgtgttcttcggcaaggacggacagcattttttcgctgtcgtactcgttcatctggcagccgaaggtgcggataaatacttttttcatggtttgtgtctttctcgggcagccgtaatcgcggggctgatggttgttggaatgaaaaaatttcagacggcacgacgatgccgtctgaaaatcggtgcggattatagcacgatgtgggtttgggaggcaaaatattgttttaaaata

SEQ ID NO: 1612 - protein, 507 aa, Neisseria gonorrhoeae
MPSETLQAAFFGVRVLGFDNFAAQGKGVGFGDFQIDHLVDHVGRAGKVDDAVVDGTGLELVGVFFGDAFDQAALNRADHGLVDAGGFGFDDFVQGFEAAHFFFVRRVVRQVGGRRAGARAVNKHEAQVEGNVFHQFQGLLELAFGLAGETDDEVAAQAQIRTDGAQFADDGFVFQSGVAAFHRAQYAVGTALNRQVQVGNQFGQVAVALDNRVGKLARVAGGEAHTFDAGDFVDDTQQGGEVADFAVVHFAAIGIDVLSQEVDFFHALLGKVGDFGQYVVERAGEFFAARVGDDAEGAVFGTAFHNRHKCRAAFDAGGRQVVEFFDFGEGNIDLRQPAGFFVHNHFGQAVQRLRAENHINIRRAFDDVFAFLRGDAAGNADDEAGVFFFERTDAPQVGEHFFLCFFAHGTGVEQDDVGFVGLGNLFDAAVFFGKDGQHFFAVVLVHLAAEGADKYFFHGLCLSRAAVIAGLMVVGMKKFQTARRCRLKIGADYSTMWVWEAKYCFKI

SEQ ID NO: 1613 - DNA, 1326 bp, Neisseria gonorrhoeae
atgaaaaaagtatttatccgcaccttcggctgccagatgaacgagtacgacagcgaaaaaatgctgtccgtccttgccgaagaacacggcggcatcgaacaggttacccaagccgacgaagccgacatcatcttgttcaacacctgttccgtgcgcgaaaaagcacaggaaaaagtgttctccgacttggggcgcgtccgtccgctcaaagaaaaaaaccccggcctcatcatcggcgttgccggctgcgtcgcctcgcaagaaggcgaaaacatcatcaaacgcgcgccttatgttgatgtggttttcggcccgcaaacgctgcaccgcctgcccaaaatgattgtggacaaagaaaccagcgggctgtcgcaagtcgatatttccttccccgaaatcgaaaaattcgaccacctgccgcccgcccgcgtcgaaggcggcgcggcatttgtgtcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaatgcctatcgcggcgaaatggacgacggcgaaatctgcgacttcgccaccctgctgcgtatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcgatgaaacgcggctacaccgctttggaatacaaatccatcatccgcaaactgcgcgccatccgtcctgatttgtgcctgagcagcgacttcatcgtcggtttccccggcgagaccgaacgcgagttcgagcaaaccttgaaactggtgaaagacattgccttcgacttgagcttcgtgtttatttacagcccgcgccccggcacgcctgccgccaacctgccggacgacacgccgcacgaagaaaaagtgcgccgcctcgaagccttgaacgaagtcatcgaagccgaaaccgcccgcatcaaccaaaccatgatcggcacggttcaacgctgcctggtcgaaggcatctccaaaaaagaccccgaccagctccaagcccgtaccgtcaacaaccgcgtcgtcaactttaccggcacgcccgacatgatcaaccaaatgatcgatttggaaatcaccgaagcctacaccttttccctgcgcggcaaaattgtcgaagcc

SEQ ID NO: 1614 - protein, 442 aa, Neisseria gonorrhoeae
MKKVFIRTFGCQMNEYDSEKMLSVLAEEHGGIEQVTQADEADIILFNTCSVREKAQEKVFSDLGRVRPLKEKNPGLIIGVAGCVASQEGENIIKRAPYVDVVFGPQTLHRLPKMIVDKETSGLSQVDISFPEIEKFDHLPPARVEGGAAFVSIMEGCSKYCSFCVVPYTRGEEFSRPLNDVLTEIANLAQQGVKEINLLGQNVNAYRGEMDDGEICDFATLLRIVHEIPGIERMRFTTSHPREFTDSIIECYRDLPKLVSHLHLPIQSGSDRVLSAMKRGYTALEYKSIIRKLRAIRPDLCLSSDFIVGFPGETEREFEQTLKLVKDIAFDLSFVFIYSPRPGTPAANLPDDTPHEEKVRRLEALNEVIEAETARINQTMIGTVQRCLVEGISKKDPDQLQARTVNNRVVNFTGTPDMINQMIDLEITEAYTFSLRGKIVEA

SEQ ID NO: 1615 - DNA, 171 bp, Neisseria gonorrhoeae
gtgtgtatgaaaccggttgtatgggcggcattgctgctgtgtgcgtgtaccagcaatttcggcgacagggaacatcagttcctgcgttatagtggattaaatttaaaccagtacagcgttgcctcgccttgccgtactatttgtactgtctgcggcttcgtcgccttgtcc

SEQ ID NO: 1616 - protein, 57 aa, Neisseria gonorrhoeae
VCMKPVVWAALLLCACTSNFGDREHQFLRYSGLNLNQYSVASPCRTICTVCGFVALS

SEQ ID NO: 1617 - DNA, 192 bp, Neisseria gonorrhoeae
ttgccgaccaatttcatctatatgaaatcggagcggcggcattgggaatggtgcgcggattacgacggggagggagtcgtccgggactaccgctttacacataaagtggaaaaagacgagcgttccgtcatccgggatacggttggcgtaatccgcaaagaagcgggcaaatccttgtcgcaacctgaaaaa

SEQ ID NO: 1618 - protein, 64 aa, Neisseria gonorrhoeae
LPTNFIYMKSERRHWEWCADYDGEGVVRDYRFTHKVEKDERSVIRDTVGVIRKEAGKSLSQPEK

SEQ ID NO: 1619 - DNA, 240 bp, Neisseria gonorrhoeae
atgtgtaaagcggtagtcccggacgactccctccccgtcgtaatccgcgcaccattcccaatgccgccgctccgatttcatatagatgaaattggtcggcaaaaaattataaatcggcaggctgacctcgtgataggcataacagccgaaagggttgcgcttcccgaaacgtgcctctacctccgcccgggtcgttttgcctttaacaaccgtttgtgcgattccctcttccgtctgata

SEQ ID NO: 1620 - protein, 80 aa, Neisseria gonorrhoeae
MCKAVVPDDSLPVVIRAPFPMPPLRFHIDEIGRQKIINRQADLVIGITAERVALPETCLYLRPGRFAFNNRLCDSLFRLI

SEQ ID NO: 1621 - DNA, 1290 bp, Neisseria gonorrhoeae
ttgaggataaatatgaaccgtaacgaaattttattcgaccgcgccaaggccatcatccccggcggcgtgaattcgcccgtgcgcgcattcggcagcgtcggcggcgtgccgcgcttcatcaaaaaagccgaaggcgcgtatgtttgggacgaaaacggcacgcgctacaccgattatgtcggctcttgggggcctgcgattgtcggacacgcgcatcccgaagtcgtcgaagccgtgcgcgaagctgcgttgggcggtttgtcgttcggcgcgcccaccgaaggcgaaatcgccattgccgaacaaattgccgaaattatgccgtctgtcgaacggctgcgcctcgtcagctccggcacggaagcgacgatgactgccatccgtctggcacgcggttttaccggccgcgacaaaatcatcaaatttgaaggctgctaccacggccattccgacagcctgttggtgaaagcaggcagcggtctgcttaccttcggcaatccttcttccgccggtgtgcctgccgactttaccaaacatactttggtactcgaatacaacaacatcgcccaactcgaagaagcctttgcccaaagcggcgacgaaatcgcctgcgtgattgtcgaacccttcgtcggcaatatgaacctcgtccgcccgaccgaagcctttgtcaaagccttgcgcggattgaccgaaaaacacggcgcggtgttgatttacgacgaagtgatgaccggtttccgcgtcgcgctcggcggcgcgcagtcgctgcacggcatcacgcccgacctgaccacgatgggcaaagtcatcggcggcggtatgccgcttgccgcgttcggcggacgcaaagacatcatggaatgtatttccccgttgggcggcgtgtatcaggcaggtacattatcaggcaacccgattgccgtcgccgccggcttgaaaacgctggaaatcatccagcgcgaaggcttctatgaaaacctgaccgccttgacacaacgccttgccaacggtattgccgccgccaaagcgcacggtatcgagtttgccgccgacagcgtgggcggtatgttcggtctgtatttcgccgcacacgtgccgcgaaactatgccgatatggcgcgctccaatatcgacgctttcaaacgcttcttccacggcatgctcgaccgcggcattgccttcggcccgtccgcttatgaagcgggtttcgtttccgccgcgcatacgcccgagctgattgacgaaacggttgcggttgcggttgaagtgttcaaggcgatggctgca

SEQ ID NO: 1622 - protein, 430 aa, Neisseria gonorrhoeae
LRINMNRNEILFDRAKAIIPGGVNSPVRAFGSVGGVPRFIKKAEGAYVWDENGTRYTDYVGSWGPAIVGHAHPEVVEAVREAALGGLSFGAPTEGEIAIAEQIAEIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGDEIACVIVEPFVGNMNLVRPTEAFVKALRGLTEKHGAVLIYDEVMTGFRVALGGAQSLHGITPDLTTMGKVIGGGMPLAAFGGRKDIMECISPLGGVYQAGTLSGNPIAVAAGLKTLEIIQREGFYENLTALTQRLANGIAAAKAHGIEFAADSVGGMFGLYFAAHVPRNYADMARSNIDAFKRFFHGMLDRGIAFGPSAYEAGFVSAAHTPELIDETVAVAVEVFKAMAA

SEQ ID NO: 1623 - DNA, 126 bp, Neisseria gonorrhoeae
ttgactatatatttcagacggcatttttacagtagattgaaatcaaaaatgtacacgcccgtcattcccgcgcaggcgggaatccggaaggtcgggcttgccgttattttcaatcattacagaaac

SEQ ID NO: 1624 - protein, 42 aa, Neisseria gonorrhoeae
LTIYFRRHFYSRLKSKMYTPVIPAQAGIRKVGLAVIFNHYRN

SEQ ID NO: 1625 - DNA, 228 bp, Neisseria gonorrhoeae
atgtccgactgtgcggttgccgtgcgccagatgcttgccttatgcggcgcggtgcacgaccttgccgcacaaaattcccctctgacacgcgacgcggcaaaagtgtgcctcgaagcgtgcaaacagtgtgccaaagcctgtaaagaacactccgcccaccatgcggaatgcaaagcctgttacgagtcctgcctcgactgtatcaaagaatgcgaaaaactcgccgcc

SEQ ID NO: 1626 - protein, 76 aa, Neisseria gonorrhoeae
MSDCAVAVRQMLALCGAVHDLAAQNSPLTRDAAKVCLEACKQCAKACKEHSAHHAECKACYESCLDCIKECEKLAA

SEQ ID NO: 1627 - DNA, 1287 bp, Neisseria gonorrhoeae
  MISC_FEATURE (1)..(1287): n = g, a, t, or c
atgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattcnnnnnnnnnnnnnnnnnnnnnnnnnnaccgccgcccgccgtgtcgaaagctaccaccaacgccaaaaaatggaatcgtggagctacaccgatgaagacggcacgctgctggggcaacagattaccccgcttgaccgcgtcggcatttacgtcccaggcggcaaggcggcatatccgagttccgtcatcatgaacgcgatgcccgcccacgtcgcaggcgtgaaagaaatcattatggtcgtaccgacaccgaaaggcgaacgcaacgacatcgtgcttgccgccgcatacgtcgccggcgtaaccaaagtcttcaccgtcggcggcgcgcaagccatcgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatactggtcatcgccgacggcacgacacccgccgattgggtggcgatggatttgttcagccaggccgaacacgacgaaattgcccaagccatcctcatcggcacgtcgcaagcgtatctcgacgaagtagaagccgctatggacaggctcatcgaaaccatgccgcgccgcgacatcatcgaggcctcgctcggcaacaggggcgcgatgatactcgttaaagacttgaacgaagcctgcgaaatctccaactacatttcccccgaacacttggaactgtcagtcgaaaacccgcaggaatgggcgaaaaaaatccgccatgccggcgcgattttcatgggacgctacaccggcgaaagcctcggcgactactgcgccggcccgaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcacgcgcggcagagttccgtatgaaa

SEQ ID NO: 1628 - protein, 429 aa, Neisseria gonorrhoeae
  MISC_FEATURE (1)..(429): Xaa = any amino acid
MKKLNTQSPDFQAGLKALLAFETAQNPETERIVADICADVQKRGDAALIEYTNKFDQTNAKSIDDLILTQADLNAAFERIXXXXXXXXXTAARRVESYHQRQKMESWSYTDEDGTLLGQQITPLDRVGIYVPGGKAAYPSSVIMNAMPAHVAGVKEIIMVVPTPKGERNDIVLAAAYVAGVTKVFTVGGAQAIAALAYGTETIPQVDKITGPGNAFVAAAKRRVFGVVGIDMVAGPSEILVIADGTTPADWVAMDLFSQAEHDEIAQAILIGTSQAYLDEVEAAMDRLIETMPRRDIIEASLGNRGAMILVKDLNEACEISNYISPEHLELSVENPQEWAKKIRHAGAIFMGRYTGESLGDYCAGPNHVLPTSRTARFSSPLGTYDFQKRSSLIQVSEQGAQKLGETASVLAHGESLTAHARAAEFRMK

SEQ ID NO: 1629 - DNA, 810 bp, Neisseria gonorrhoeae
ttggacaaaccgaaaatcatgggcatcgtgaatctcacgcccgattctttttccgacggcggcgcgtattcgcaaaacgcccaaacagctttggcgcatgccgaacggcttttgaaagagggtgcggacattctcgacatcggcggcgaatcgacgcggccgggtgcggatttcgttccgcccgaagaagaagaatgggcgcgggttgagcctgtattggcggaagcggcggggtggggcgttcccgtcagtttggacacgcgccgcacggtggttatggaaaaggcgttggcactcggcggcatcgatattatcaatgatgtggcggcgttgaccgacgaaggtgcggtcgaattgctggcgcgccaggcggacacgggcatttgcctgatgcatatgcggggcttgcccgaaaccatgcaggacaatccgaaatatcaggatgtggtcggcgaagtggcacgttatctgaaaacacggtcagaaacctgtgtcgcggcaggcatcgcgccgcaacggattacgctcgacccgggtttcggcttcggcaagaacctgcaacacaatatcgcactgatgcggcatttgcccgaattgatggcggaaaccggtttgccgctgctgatcggtgtgtcgcgcaaacgcatgataggtgagctgaccggtgaggcggacgcggcggcgcgcgtacacggcagcgtggcagcggctttggcttccgtggcacgcggagcgcaaatcgtgcgcgtgcacgatgtgaaggcgacggcggacgcgttgaaggtgtgggaagcgttgggcgtgaaccgg

SEQ ID NO: 1630 - protein, 270 aa, Neisseria gonorrhoeae
LDKPKIMGIVNLTPDSFSDGGAYSQNAQTALAHAERLLKEGADILDIGGESTRPGADFVPPEEEEWARVEPVLAEAAGWGVPVSLDTRRTVVMEKALALGGIDIINDVAALTDEGAVELLARQADTGICLMHMRGLPETMQDNPKYQDVVGEVARYLKTRSETCVAAGIAPQRITLDPGFGFGKNLQHNIALMRHLPELMAETGLPLLIGVSRKRMIGELTGEADAAARVHGSVAAALASVARGAQIVRVHDVKATADALKVWEALGVNR

SEQ ID NO: 1631 - DNA, 591 bp, Neisseria gonorrhoeae
ttgtacggcagccgccgtttgccatgcgcccaaacagatgcggatggcgcgcaaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagtgggaaaagataccggcgcttatctttggtgtccgcacaagtcggcaaccggccgattgctccgatggtttgtcaaaatacggtggccggggtcttttttgaagcgcggtttcagcaatgcctactgcccgcattggctcaaaaatcggtgattatttcagataatgcgcgatttcgccgtatgggtgccttacggggaacggcggaaaaattgggacataaggtattgcctcccgcaccttgttcgcccgagcccaacccgattgagaaagtgtgggcgaatattaagcggtatctgcgaaccgttttgtctgattacgcccgatttgacgatgcactactgtcctattttgattttaat

SEQ ID NO: 1632 - protein, 197 aa, Neisseria gonorrhoeae
LYGSRRLPCAQTDADGAQKKTAAYKGQDPAKVTHYLTRPAGFSDCQRVCPDETGFDRRLFRPYARSLKGQMAKARISGKRYRRLSLVSAQVGNRPIAPMVCQNTVAGVFFEARFQQCLLPALAQKSVIISDNARFRRMGALRGTAEKLGHKVLPPAPCSPEPNPIEKVWANIKRYLRTVLSDYARFDDALLSYFDFN

SEQ ID NO: 1633 - DNA, 294 bp, Neisseria gonorrhoeae
atggcatactctgcggacttaagaaacaaagctttaaaccatagcggattaacaaaaatcaggacaaggcggcgggccgcagacggtacaaatggtacggaaccgatccgcccggcgctccatcaccttagggaatcgttccctttgagccggggcggggcaacgccgtaccggtttttgttaatccgctatattacggacaatgcaaaaacaccggccaaaccgcagcaacgtttaacttgtcaagaaacacgctttacctgcggattcgccttaaaaaacaaacaggcagcc

SEQ ID NO: 1634 - protein, 98 aa, Neisseria gonorrhoeae
MAYSADLRNKALNHSGLTKIRTRRRAADGTNGTEPIRPALHHLRESFPLSRGGATPYRFLLIRYITDNAKTPAKPQQRLTCQETRFTCGFALKNKQAA

SEQ ID NO: 1635 - DNA, 561 bp, Neisseria gonorrhoeae
gtgcaggacaaaaacaacctctgctggctcgatatggaaatgacggggctgaatcccgaaaccgaccgcattatcgaagtcgcgatgattattaccgactcggatttgaatgtgttggcgcaatccgaagtttacgccatccaccaaagcgacgatctgctcgacaatatggacgagtggaacaccgccacacacggcaggacggggctgacgcagcgcgtgcgcgaatcgtcgcataccgaagccgaagtcgaacagaaactgctggactttatgtcggaatggatacccggacgcgccacaccgatgtgcggcaactccatccaccaagaccggcgttttatggtcaaatatatgccgaaactggaaaactacttccactaccgcaacctcgacgtttccacgctgaaagaactcgccaaacgctggaatccgcccattgccaaaagcgtcgtcaaacgcggttcgcacaaggcattggacgacattttggagagcatcgaagaaatgcgccactaccgcgaacacttcctgatttccgccccgaaagccgaagcgcaa

SEQ ID NO: 1636 - protein, 187 aa, Neisseria gonorrhoeae
VQDKNNLCWLDMEMTGLNPETDRIIEVAMIITDSDLNVLAQSEVYAIHQSDDLLDNMDEWNTATHGRTGLTQRVRESSHTEAEVEQKLLDFMSEWIPGRATPMCGNSIHQDRRFMVKYMPKLENYFHYRNLDVSTLKELAKRWNPPIAKSVVKRGSHKALDDILESIEEMRHYREHFLISAPKAEAQ

SEQ ID NO: 1637 - DNA, 933 bp, Neisseria gonorrhoeae
ttgccccgccgtctgaaaccgatttcgatatttccaagaaagcccgttatgccctaccaacaaatcaccgtcaacgtcaacgatgccgtcgccgaacgcctcgccgacgcgctgatggaacacggtgcactctccgccgccatcgaagatgcctgcgccggcacgcaaaacgaacaggcgattttcggcgaacccggtatgcccaccgaacaaatctggcagcagagcaaagtcatcgccctgttcggcgaacacgacgaagccgccgccgtcatcgatgccgccgcacaagaatgcgggttaaaagacttggcatacaccggcgaaaccatcgaaaaccaagactgggtgcgcctcacgcaatcgcaattcgaccccatccgaatttccgaccgcctgtggattaccccctcttggcacgaagcccccgaaggctgcgccgtcaacctccgcctcgatcccggactcgccttcggcaccggcagccacccgaccacgcgcctctgcctcaaatggctggatacgcaactcaaaaacggcgaaagcgtcctcgactacggctgcggttcgggcatcctgaccatcgccgccctcaaactcggtgcaggttccgccgtcggcgtggatattgacgaacaggccgtccgctccggcagggacaacgccgaacagaacaacgtcgatgcacaattcttcctgcccgacagtctgcctcaagggcaattcgacgtagttgtcgccaacatcctcgccaaccctttgcgtatgctcggcgaaatgcttgcagcccgcaccaaacagggcggacgcatcgtgttgtccggtttgttggatgaacaggccgaagaactcggcggcatttacagccaatggttcgatctcgacccggcggaaactgacgaaggctgggcgcgcttgagcggcgtaaaacgc

SEQ ID NO: 1638 - protein, 311 aa, Neisseria gonorrhoeae
LPRRLKPISIFPRKPVMPYQQITVNVNDAVAERLADALMEHGALSAAIEDACAGTQNEQAIFGEPGMPTEQIWQQSKVIALFGEHDEAAAVIDAAAQECGLKDLAYTGETIENQDWVRLTQSQFDPIRISDRLWITPSWHEAPEGCAVNLRLDPGLAFGTGSHPTTRLCLKWLDTQLKNGESVLDYGCGSGILTIAALKLGAGSAVGVDIDEQAVRSGRDNAEQNNVDAQFFLPDSLPQGQFDVVVANILANPLRMLGEMLAARTKQGGRIVLSGLLDEQAEELGGIYSQWFDLDPAETDEGWARLSGVKR

SEQ ID NO: 1639 - DNA, 204 bp, Neisseria gonorrhoeae
atgccggcagattcaaaggcggcgcagacattgggacaacatgccgtctgccgcccgaatagcggtgccgtccgaagcgcacaagacggtttcagacggcatataatctgttttttatttcgggaggagttcagatggcacgacacgtttggcgggcaggacggtttgaaatcggtttggacaaaccgaaaatcatgggcatcg

SEQ ID NO: 1640 - protein, 68 aa, Neisseria gonorrhoeae
MPADSKAAQTLGQHAVCRPNSGAVRSAQDGFRRHIICFLFREEFRWHDTFGGQDGLKSVWTNRKSWAS

SEQ ID NO: 1641 - DNA, 1359 bp, Neisseria gonorrhoeae
atgctgaaaaaagttttaatcgccaaccggggcgaaatcgccttgcgcgtactccgtgcctgccgcgaaatgggcattgccaccgttgccgtgcattccgaaaccgacaaaggcagcctgcacgtcaaactcgccgacgaatccgtgtgcatcggtcctgccgcttctgcgcaaagttatctgaacattcccgccatcattgccgccgccgaagtaacctgcgcggacgctgtccacccgggctacggcttccttgccgaaaacgccgatttcgccgaacaggtcgaacagtccggctttaccttcatcggcccgaaacccgacaccatccgcctgatgggcgacaaagtctccgccaaacacgcgatgatagcggcaggcgtgccctgcgtccccggctctgacggcgcattgcccgacgatgatgccgaaatcctcaaaatcgccgacaaagtcggttatcccgtgattatcaaagcatcgggcggcggcggcgggcgcggtatgcgcgtggtcgagaaaaaagaagacctcctccagtctgtcgaaatgaccaaggctgaagcgggcgcggcgttcggcaacccgatggtttatatggaacgctacctgcaacgcccgcgccacgtcgaaatccaagtgcttgccgacgaacacggcaacgccgtctatcttgccgagcgcgactgttcgctgcaacgccgccaccagaaagtcatcgaggaagcacccgccccgtttatcgatgaaaaggcacgcaaaaaaatcggcaaagcctgtaccgacgcgtgcaaacgcatcggctaccggggcgcgggcacgtttgaatttttatacgaagacggcgaatttttctttatcgagatgaacacgcgcgttcaggtcgagcatccggttaccgaactcattaccggcgtggacatcgtccaagagcaactccgcatcgcatccggcctgccgctgcaatacaaacagaaagacatcaaaatcgaaggccacgccttcgagtgccgcatcaatgccgaagacccgtacaacttcatccccagcccgggcccgattgaaagctgccacctgcccggcggcttcggcatccgcgtggacagccacatctaccaaggctaccgcatcccgccgtactacgacagcctgatcggcaaaatctgcgtacacggcaaaacgcgtgaacaggcaatggcgaaaatgcgcgtcgcactcgccgagctggcggtaaccggcatcaaaaccaatacgccgttgcaccgcgacctgttcgccgatgcgggtttccaagaaggcggagtgagcatccattacctggagcactggctggaagcgcgcaaaaccaaacaggacaaa

SEQ ID NO: 1642 - protein, 453 aa, Neisseria gonorrhoeae
MLKKVLIANRGEIALRVLRACREMGIATVAVHSETDKGSLHVKLADESVCIGPAASAQSYLNIPAIIAAAEVTCADAVHPGYGFLAENADFAEQVEQSGFTFIGPKPDTIRLMGDKVSAKHAMIAAGVPCVPGSDGALPDDDAEILKIADKVGYPVIIKASGGGGGRGMRVVEKKEDLLQSVEMTKAEAGAAFGNPMVYMERYLQRPRHVEIQVLADEHGNAVYLAERDCSLQRRHQKVIEEAPAPFIDEKARKKIGKACTDACKRIGYRGAGTFEFLYEDGEFFFIEMNTRVQVEHPVTELITGVDIVQEQLRIASGLPLQYKQKDIKIEGHAFECRINAEDPYNFIPSPGPIESCHLPGGFGIRVDSHIYQGYRIPPYYDSLIGKICVHGKTREQAMAKMRVALAELAVTGIKTNTPLHRDLFADAGFQEGGVSIHYLEHWLEARKTKQDK

SEQ ID NO: 1643 - DNA, 459 bp, Neisseria gonorrhoeae
atggatttgcgcaaattaaaaaaactgattgatttggttgaagaatcgggtatcgccgaaatcgaagtaaccgaaggcgaggaaaaagtccgcattacccgtaccattgcagctgcggcagctcccgtttacgccgcgcccgtacctgccgccgcgccggccgtaacgccggccgccgcacccgttgcggcatccgcgcccgccgccgcgccggccgcccgcgatttgtccgacgctcaaaaatcgcctatggtcggcacgttctaccgcgcgcccggcccgaatgccgccgcatttgtcgaagtcggtcaacaggtcaaagccggcgacacgctgtgcatcatcgaagcgatgaagctgatgaacgaaatcgaagccgaaaaatccggcacggtcaaagaaattctggtcgaaaacggtacgcccgtcgaattcggcgaaccgctcttcatcatcgga

SEQ ID NO: 1644 - protein, 153 aa, Neisseria gonorrhoeae
MDLRKLKKLIDLVEESGIAEIEVTEGEEKVRITRTIAAAAAPVYAAPVPAAAPAVTPAAAPVAASAPAAAPAARDLSDAQKSPMVGTFYRAPGPNAAAFVEVGQQVKAGDTLCIIEAMKLMNEIEAEKSGTVKEILVENGTPVEFGEPLFIIG

SEQ ID NO: 1645 - DNA, 255 bp, Neisseria gonorrhoeae
gtgcgcaaaatcaaacttcctgcacatttcccccaaaaaccgccgttttttgatattttactggacatttaccgacaacttcgggaaaatgaacacaatttcacggtcgtttcccaccacaggaaaaccgtatccgaacaccattccgcccggtttgcgccgttgccgcaagccggctgttttctgaaaaaccaacgcaacaacccgccggaacaccggcagcctttaaaggaacagaaatggatttgcgcaaat

SEQ ID NO: 1646 - protein, 85 aa, Neisseria gonorrhoeae
VRKIKLPAHFPQKPPFFDILLDIYRQLRENEHNFTVVSHHRKTVSEHHSARFAPLPQAGCFLKNQRNNPPEHRQPLKEQKWICAN

SEQ ID NO: 1647 - DNA, 111 bp, Neisseria gonorrhoeae
atgtgcaggaagtttgattttgcgcacaagatgccccgagtcaagagtgtttattctaatctgttggtttttcgggcaaagatgccgtctgaaaaagggctaaagtgcgta

SEQ ID NO: 1648 - protein, 37 aa, Neisseria gonorrhoeae
MCRKFDFAHKMPRVKSVYSNLLVFRAKMPSEKGLKCV

SEQ ID NO: 1649 - DNA, 1077 bp, Neisseria gonorrhoeae
gtgcgtataatggcggcttgcccgaacgagagtgtaaaaatggatatttcagattttgactttaccctgcccgaacacctgattgcccagcatccgcccgaggtgcgcggcagcagccggcttttggtcgcgctgtccgatatgccgctgcaagaccgggtgtttggcgatttgcccgattatgtcgaggcaggcgacgttttggtattcaacaacaccaaagtcatgaaggcgcggctgtttgggcagaaagacagcggcggcaggatcgaagccctgattgagcgtgtgttggacaaccataccgcattggcgcacatccgttcgtccaagtcccccaagcccggtatggggctggtgtttgaaggcggtatccgtgccgtgatggtcgggcgtgagggcgaactgttctgcctgcgttttgaaggcggtcaaaccgtttacgaacttttggaacagaacggacacctgcccctgccgccttatatcgaacgtgccgccgatgcggacgacgacagccgttatcaaactgtttatgccaaatatcagggcgcggtcgccgcgccgacggcgggcctgcattttacggaagaacttttgcgccgtctgaaagacaaaggcgcggtaaccgcagaagtaaccctgcacgtcggtgcggggacattccaacccgtgcgcgtcgataaaatcgaagaacacaaaatgcacagcgaatggtttgaagtgccgtctgaaaccgtcgccgccgttgaggcggcaaaagcccgggggaacaaagcctgggcggtcggcacgacttccatgcgcgccctcgagtctgccgcgcgcgcaacgggatatttgaaagacggacagggcgacaccgatattttcatcacgccgggctaccgttttaatgttgtcgacaggctggttaccaattttcatctgccgaaatcgacgctgctgatgttggtcggcgcgttttcgggtatgggtcatatccgcgccgtgtaccgtcatgcgattgaacgtgaataccgtttcttcagctacggagatgcgatggttttggggcggaacgaagggggcgggctt

SEQ ID NO: 1650 - protein, 359 aa, Neisseria gonorrhoeae
VRIMAACPNESVKMDISDFDFTLPEHLIAQHPPEVRGSSRLLVALSDMPLQDRVFGDLPDYVEAGDVLVFNNTKVMKARLFGQKDSGGRIEALIERVLDNHTALAHIRSSKSPKPGMGLVFEGGIRAVMVGREGELFCLRFEGGQTVYELLEQNGHLPLPPYIERAADADDDSRYQTVYAKYQGAVAAPTAGLHFTEELLRRLKDKGAVTAEVTLHVGAGTFQPVRVDKIEEHKMHSEWFEVPSETVAAVEAAKARGNKAWAVGTTSMRALESAARATGYLKDGQGDTDIFITPGYRFNVVDRLVTNFHLPKSTLLMLVGAFSGMGHIRAVYRHAIEREYRFFSYGDAMVLGRNEGGGL

SEQ ID NO: 1651 - DNA, 117 bp, Neisseria gonorrhoeae
ttgacctttaagcaccctaatttggggcggtggattatccaactgccggacatccataaaaataccgcccgaaccacggttcagacggcatctgccttgcaacggacagcagcagtt

SEQ ID NO: 1652 - protein, 39 aa, Neisseria gonorrhoeae
LTFKHPNLGRWIIQLPDIHKNTARTTVQTASALQRTAAV

SEQ ID NO: 1653 - DNA, 3213 bp, Neisseria gonorrhoeae
atgcccaaacgtaccgacctaaaatccatccttatcatcggcgccggccctatcgttatcggtcaggcctgcgaatttgactattcgggcgcacaggcctgcaaggctttgcgtgaagaaggctataaagtcattctggtgaattccaaccccgccacgatcatgaccgaccccgaaatggcggatgttacctacatcgagccgattatgtggcagacggtggagaagattatcgccaaggagcggcccgatgcgattctgcccacgatgggcggtcagaccgcgctgaactgtgcgctggatttggcgcgtaacggcgtgctggcgaaatataatgtcgagttaatcggcgcaacggaagacgcgatcgacaaggcggaagaccgcggccgctttaaagaagcgatggaaaaaatcggcctctcttgcccgaaatcttttgtctgccacaccatgaacgaagccttggcggcgcaagaacaggtcggctttccgacgctgattcgtccgtctttcacgatgggcggttcgggcggcggcattgcctacaataaggatgagtttttggcgatttgcgaacgcggtttcgatgcgtcgcctacgcatgagctgctgattgagcagtctgtgctcggctggaaagagtacgagatggaagtggtgcgcgataaggcggacaactgcatcatcatctgttcgattgaaaacttcgacccgatgggcgttcatacgggcgactcgattacggttgcgccggcgcaaacgctgacggacaaggaataccaaatcatgcgcaacgcttcgttggcggtattgcgcgaaatcggcgtggacacgggcggctcgaacgtgcagtttgcggtgaaccctgaaaacggcgagatgattgtgatcgagatgaacccgcgtgtgagccgttcgtccgcgctggcttccaaagcaacgggcttcccgattgcgaaggtggcggcgaagctggcggtcggctttacgctggacgagttgcgcaacgacatcaccggcggccgcacgcccgcgtcgttcgagccttccatcgactatgtggtaaccaaaatcccgcgtttcgcgtttgaaaaattccccgccgcagacgaccgcctgaccacgcagatgaaatctgtgggtgaagtaatggcgatgggccgtaccattcaggaaagcttccaaaaagccctgcgcggtttggaaaccggcttgtgcggtttcaatccgcgcagcgaagacaaagcggaaatccgccgcgaactggccaaccccggccccgaacgtatgctgtttgtggcagacgcgttccgcgcgggcttcacgccggaagaaatccacgagatctgcgccatcgacccttggttcttggcgcaaatcgaagacttgatgaaggaagaaaaatcggtttcagacggccagttgcaagatttggattacgccgccctacgccgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatcccgtccttccgaccgtaaaaaagtgatgattctcggcggcggcccgaaccgcatcggtcagggcatcgagtttgactactgctgcgttcacgccgcactcgccctgcgcgaatcgggctttgaaacgattatggtcaactgcaaccccgaaaccgtgtccaccgacttcgacaccagcgaccgcctctatttcgagccgctgacattggaagacgtgttggaaatcgtccgcaccgaaaacccgtggggcgtgattgttcattacggcggtcaaaccccgctgaaactcgccaacgcattggttgaaaacggcgtgaacatcatcggcacatccgccgacagcatcgatgccgccgaagaccgcgaacgcttccaaaaagtgttgaacgacttaggcctgcgccaaccgcccaaccgcatcgcccacaacgaagaagaagcactcgtcaaagccgaagaaatcggttatccgctggtcgtgcgcccgtcttatgttttgggcggccgcgccatgcagattatccactccgccgagcagttgcaaaaatatatgcgcgaagccgtgcaggtttccgaagacagccccgtgctgctcgatttcttcctcaacaacgcgattgaagtcgatgtggactgcgtttcagacggcaaagatgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtgcaggacggcgtggtgttcgtgttggaagtgaacccgcgcgccagccgtaccgtcccctttgtctccaaagccaccggcgtgccgctcgccaaagtcggcgcgcgctgcatggcaggcatttccctgaaagaacaaggcgtggaaaaagaagtcgtccccgatttctatgccgttaaagaagccgtgttcccattcatcaaattcccgggcgtggatacgattttgggtccggaaatgcgctccaccggcgaagtgatgggcgtgggcgcaagtttcggcgaagcctactacaaagcccaactcggcgcgggcgaacgcctcaacccgaccggcaaaatcttcctctccgtgcgcgaagaagacaaagaacgcgtcattaaaaccgccaaaaacttccaagccttaggctacggcatctgcgccacgcgcggcacggcgcaatacctgaccgaacacgggctgattgtgcaggccatcaacaaagtccccgaaggccgcccgcacatcggcgacgcgctgaaaaacggcgaaatcgcactggtcgtaaataccgtttccagcgatccgcaatccgtgtccgacagccacatcatccgccaaagcgcattgcagcaacgcgtgccgcaatacaccaccaccgccggcggcgaagcgatgagcgaaggcgcgaaaagccgggattatctgggtgtgtacagcgttcaagagctgcacggtcgtttgaaaaaccgcaac

SEQ ID NO: 1654 - protein, 1071 aa, Neisseria gonorrhoeae
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKADNCIIICSIENFDPMGVHTGDSITVAPAQTLTDKEYQIMRNASLAVLREIGVDTGGSNVQFAVNPENGEMIVIEMNPRVSRSSALASKATGFPIAKVAAKLAVGFTLDELRNDITGGRTPASFEPSIDYVVTKIPRFAFEKFPAADDRLTTQMKSVGEVMAMGRTIQESFQKALRGLETGLCGFNPRSEDKAEIRRELANPGPERMLFVADAFRAGFTPEEIHEICAIDPWFLAQIEDLMKEEKSVSDGQLQDLDYAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQIIHSAEQLQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQALGYGICATRGTAQYLTEHGLIVQAINKVPEGRPHIGDALKNGEIALVVNTVSSDPQSVSDSHIIRQSALQQRVPQYTTTAGGEAMSEGAKSRDYLGVYSVQELHGRLKNRN

SEQ ID NO: 1655 - DNA, 531 bp, Neisseria gonorrhoeae
tgcgccgaacactttcaaacgttccgcaacgggttcaaagaccttttcacctgccgccccttcaataccaccgataaccatttgcgcgcgcaacagccagttttcgggaatattccacgctttagcaatcgccacatcgggcaaggggttgtaatgttgcagatttgcacctgcaccgaccgcggcaagtgtcgtccagacggcatactgtaccatagcgttcgcctggtccgcccaaacgggaaagttggcggcataagcagggaactgctcctgcaaacctttgacgacattttgatcttcataaaacaaaatggttgccgcgcccgccttaaacagcttcaatttttgcgcggtcggttcaaaactgtcggcaggcacgacggcacgcagcgcgtcttcgacaaattgccacaccttatatattgcgccccttcttagggacgcaatatataagggtaatcccatgcgtaacaccgtaggattggacatatccaagctgacatttgacgcaacggccatggtcggcaa

SEQ ID NO: 1656 - protein, 146 aa, Neisseria gonorrhoeae
CAEHFQTFRNGFKDLFTCRPFNTTDNHLRAQQPVFGNIPRFSNRHIGQGVVMLQICTCTDRGKCRPDGILYHSVRLVRPNGKVGGISRELLLQTFDDILIFIKQNGCRARLKQLQFLRGRFKTVGRHDGTQRVFDKLPHLIYCAPS

SEQ ID NO: 1657 - DNA, 531 bp, Neisseria gonorrhoeae
atgtttagtgatatctacttgaacccaaaaaactattttggtatagaaaaaagattgccttttaaggcattttgggataatggcggacaatgctatctagacttaaaagtagtagatggaaaaataattgcgctttgtggacaacttattaattatacaaacacgtctattgtaaatgctgcagaggaagtttatcggtcaataattgattatttaatttccaatgagattttaattgttagaactaaattttctttcaaaaatattttttcaactaacgaaaaaaaatataaggaaatagaaaaagaaataaataaattcttatataagaatatggactggtatttattttttaacaatgacataacattagatccatatacagggaatgatttaatatggcatgtgcaaatcgatccaaatgatgggggtgcgcaattcttggaaacttatcaatcatgggaaaagttacagcaaaagtatcctaatattacattttcgtatgataaaaatgatttaattttaactaaa

SEQ ID NO: 1658 - protein, 177 aa, Neisseria gonorrhoeae
MFSDIYLNPKNYFGIEKRLPFKAFWDNGGQCYLDLKVVDGKIIALCGQLINYTNTSIVNAAEEVYRSIIDYLISNEILIVRTKFSFKNIFSTNEKKYKEIEKEINKFLYKNMDWYLFFNNDITLDPYTGNDLIWHVQIDPNDGGAQFLETYQSWEKLQQKYPNITFSYDKNDLILTK

SEQ ID NO: 1659 - DNA, 231 bp, Neisseria gonorrhoeae
ttgccaccattcggagaatgccctctccccagccctcccccacgggggagggagtgggtttcggcagatttttcggttgccggtggtttgaaaaataacttaaatttgcaaccgttgatttcaggtcgtctgaaaaagaatgcccgaaatatcaacagcgggaatttttcaggcagcctttatcgcaaggcaggtggaacaaacgccgcgagcattttttcagacgacctt

SEQ ID NO: 1660 - protein, 77 aa, Neisseria gonorrhoeae
LPPFGECPLPSPPPRGREWVSADFSVAGGLKNNLNLQPLISGRLKKNARNINSGNFSGSLYRKAGGTNAASIFSDDL

SEQ ID NO: 1661 - DNA, 555 bp, Neisseria gonorrhoeae
ttgttgccctctctccagctctctcccacggggagagaggacgggtcggctgttggggttgaggtttgctgcaaggaaaacaggttattcaggttgcttttttgcttttcagacgacctttttaaacgcttaattcagttaattttaccttattattttcaaaatctaatcaaaatcaaccgtttgctaccgtgctggctgcttttccaattcctgcaatacgcgcaggatttccgccagtacatcgtttgtctgctgcaaaatttcgtgattccaaaaacgcagcacggtaaagcccaagctgttgagatataccgtccgcgcgtggtcgtatacggcttgttccgcgtgctgcccgccgtctgcttcgacaatcagcttgggcgttacgcacataaaatcaacaatataattccccatcggctgctgtcggcggaatttatagccgttcagacggcctgcccgcaggtgttgccacaattttgcttccgcctcgctcatttcttgacgcatggctttggcgcgttggcgcagggcggggttttcggcggtcaa

SEQ ID NO: 1662 - protein, 185 aa, Neisseria gonorrhoeae
LLPSLQLSPTGREDGSAVGVEVCCKENRLFRLLFCFSDDLFKRLIQLILPYYFQNLIKINRLLPCWLLFQFLQYAQDFRQYIVCLLQNFVIPKTQHGKAQAVEIYRPRVVVYGLFRVLPAVCFDNQLGRYAHKINNIIPHRLLSAEFIAVQTACPQVLPQFCFRLAHFLTHGFGALAQGGVFGGQ

SEQ ID NO: 1663 - DNA, 387 bp, Neisseria gonorrhoeae
atgaacccgcccgagaaactattgaccgccgaaaaccccgccctgcgccaacgcgccaaagccatgcgtcaagaaatgagcgaggcggaagcaaaattgtggcaacacctgcgggcaggccgtctgaacggctataaattccgccgacagcagccgatggggaattatattgttgattttatgtgcgtaacgcccaagctgattgtcgaagcagacggcgggcagcacgcggaacaagccgtatacgaccacgcgcggacggtatatctcaacagcttgggctttaccgtgctgcgtttttggaatcacgaaattttgcagcagacaaacgatgtactggcggaaatcctgcgcgtattgcaggaattggaaaagcagccagcacgg

SEQ ID NO: 1664 - protein, 129 aa, Neisseria gonorrhoeae
MNPPEKLLTAENPALRQRAKAMRQEMSEAEAKLWQHLRAGRLNGYKFRRQQPMGNYIVDFMCVTPKLIVEADGGQHAEQAVYDHARTVYLNSLGFTVLRFWNHEILQQTNDVLAEILRVLQELEKQPAR

SEQ ID NO: 1665 - DNA, 165 bp, Neisseria gonorrhoeae
atgcctgctgaccgatacgccccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttat

SEQ ID NO: 1666 - protein, 55 aa, Neisseria gonorrhoeae
MPADRYAPLETVLQELSAHGIKPLSGIVARTGAMGKIQSVYLRDPDGNLLEISSY

SEQ ID NO: 1667 - DNA, 282 bp, Neisseria gonorrhoeae
atgaaaattagcgcactcgaccatctagtactgactgttgccgacattgaccgaaccatcgcgttttacacacaagttttgggcatggaagaagtttcatttggcaacaaccgtaaagctttgttgtttggcagtcagaaaatcaacctacacgggcgcggtgcggaaattcagcctaacgcgcaacacgccgcctgcggcacagcggatttatgcctgctgaccgatacgccccactggaaacggttttacaggaattatccgcacacggcatcaaacctt

SEQ ID NO: 1668 - protein, 94 aa, Neisseria gonorrhoeae
MKISALDHLVLTVADIDRTIAFYTQVLGMEEVSFGNNRKALLFGSQKINLHGRGAEIQPNAQHAACGTADLCLLTDTPHWKRFYRNYPHTASNL

SEQ ID NO: 1669 - DNA, 126 bp, Neisseria gonorrhoeae
atggtcgagtgcgctaattttcatttccagctttctttttcagacggcagcagcatactgttgccgtctgaaaatcattatgcttgttttgcagccttcatattgccaatgaatttgtcgaacaaa

SEQ ID NO: 1670 - protein, 42 aa, Neisseria gonorrhoeae
MVECANFHFQLSFSDGSSILLPSENHYACFAAFILPMNLSNK

SEQ ID NO: 1671 - DNA, 1197 bp, Neisseria gonorrhoeae
atgccccctgccgaagtcccttcagacggcattgtcaagaattttattaaaaacaggattcccatcatgaacacccccgccctcctcgtcctcgctgacggcagcgtattccacggcacatcaatcggttacgaaggttcggcttccggcgaagtcgtgttcaatacttcgatgaccggctatcaggaaatcctgaccgacccgtcctactgcaaacaaatcgttaccctcacctacccccacatcggcaataccggcaccaacgccgaagatgaagaaagccgcagcgtttacgccgcaggcctgattatccgcgacctgccgctcttgcacagcagcttccgcgcctccgaaagcctgcacgactatttggtacgcaacgaaaccgtcgccatcgccgacatcgacacccgccgcctgaccatgctgttgcgcgaaaaaggcgcgcaaggcggcgcgattctgacaggtgcggatgccaccgttgaaaaagcgcaagaactcatcgccgcgttcggcagcatggtcggcaaagatttggcaaaagaagtttcctgcacggaaacttacgaatggacggaaggcgaatgggaattgggcaaaggtttcgttacccctgacaaacagccttaccacgtcgtcgcctacgatttcggcgtgaaaaccaacatcctgcgtatgctcgcctcgcgcggctgccgcctgaccgtcgtccccgcacaaacgagcgcggaagacgtgttggcactcaatcccgacggcgtgttcctgtccaacggccccggcgaccccgagccttgcacctacgccatcgaagccgtgcaaaaactgatggaaagcggcaaaccgattttcggcatctgcttgggacaccagctcatcagcctcgccatcggcgcgaaaaccctgaaaatgcgcttcagccaccacggtgcgaaccatcctgtgcaagatttggacagcggcaaagtcgtcattaccagccaaaaccacggtttcgccgtcgatgccgacaccctgcccgccaacgcacgcattacccacaaatccttgttcgacaataccttgcaaggcatcgagctgaccgacaaacccgtgttctgtttccaaggacaccccgaagccagcccgggtccgcaagatgtcggctatttgttcgacaaattcattggcaatatgaaggctgcaaaacaagca

SEQ ID NO: 1672 - protein, 399 aa, Neisseria gonorrhoeae
MPPAEVPSDGIVKNFIKNRIPIMNTPALLVLADGSVFHGTSIGYEGSASGEVVFNTSMTGYQEILTDPSYCKQIVTLTYPHIGNTGTNAEDEESRSVYAAGLIIRDLPLLHSSFRASESLHDYLVRNETVAIADIDTRRLTMLLREKGAQGGAILTGADATVEKAQELIAAFGSMVGKDLAKEVSCTETYEWTEGEWELGKGFVTPDKQPYHVVAYDFGVKTNILRMLASRGCRLTVVPAQTSAEDVLALNPDGVFLSNGPGDPEPCTYAIEAVQKLMESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKQA

SEQ ID NO: 1673 - DNA, 942 bp, Neisseria gonorrhoeae
ttggacatatccaagctgacatttgacgcaacggccatggtcggcaaaacggagcattcggcaaagtttgacaacgattcaaaaggtttagatcagttttcggaccggttgaaaagcttgggatatcagaatctgcatatctgcatggaggcaaccggcagttattatgaagaagttgccgactacttcgcgcagtattacagcgtttacgtagtgaacccgctgaaaataagcaagtatgcagaaagcaggttcaagcgaaccaaaacagacaaacaggatgcaaaactgatagcgcagtattgccggtcggcgcaggaaagcgagcttgtaaagaggcagaagcctacggacgagcaatacaggctttcacggatgaccgcagcatacgcgcaaatcaaaagcgaatgcgcggcaatgaaaaaccgtcatcacgcggcaaaagatgaagaagcggccaaagcatatgcggaaatcatcaaagccatgaatgaacagcttgaagttttaaaggagaagataaaagagcagacggagaagcctaactgcaaggaaggcgtgaagcgtcttgaaaccataccggcaataggcagaatgaccgcagccgtattgtttcatcatctaacatcttcgaaatttgaaacatcaaacaaatttgcagcattcgcaggcttaagcccgcaacaaaaagaatccgggacaagcgtaaggggaaaaggcaaactgaccaagtttggcaacaggaaattacgcgccgtcttgtttatgccggccatggtcgcataccggataagggcatttcccgacttcatcaaaaggctggaagaaaagaagaagcctaaaaaagtcatcatcgcagcattgatgcgtaaactcgccgttattgcgtatcacgtacataagaaaggcggagattacgatccatcgcgttacaaatcggcg

SEQ ID NO: 1674 - protein, 314 aa, Neisseria gonorrhoeae
LDISKLTFDATAMVGKTEHSAKFDNDSKGLDQFSDRLKSLGYQNLHICMEATGSYYEEVADYFAQYYSVYVVNPLKISKYAESRFKRTKTDKQDAKLIAQYCRSAQESELVKRQKPTDEQYRLSRMTAAYAQIKSECAAMKNRHHAAKDEEAAKAYAEIIKAMNEQLEVLKEKIKEQTEKPNCKEGVKRLETIPAIGRMTAAVLFHHLTSSKFETSNKFAAFAGLSPQQKESGTSVRGKGKLTKFGNRKLRAVLFMPAMVAYRIRAFPDFIKRLEEKKKPKKVIIAALMRKLAVIAYHVHKKGGDYDPSRYKSA

SEQ ID NO: 1675 - DNA, 1077 bp, Neisseria gonorrhoeae
atgaaatccgtccgctccttcatccgcaacgacatcctcgccatgtccgcatacaaaatcaccgatgttccgcccggttttgccaaactcgatgcgatggaaagccccgcccatccttttgaggggcacgaagccctgatgcgggaatggcgggcgcaactggcatccgcccccatccacctctatcccaacccctccggctgcggtttgcaggaagcattgcgttcggcgttcgacatccctgactgcgccgccgtcgccttaggcaacggttcggacgaactgatacagttcatcaccatgctgaccgccaaacccggcgcggcaatgttggcagccgaacccggtttcatcatgtaccgccacaacgccgcgctgtacggcatggattatgtcggcgttccactgaacggagatttcaccctcaacctgcccgccgtcctcgaagccgtcaggaagcaccgccctgccctgacctttatcgcctacccgaacaacccgaccggcgtatgtttcacgcgtgccgaaatcgaagccgccatcgaagcttcagacggcatcgtcgtcgtcgacgaagcctacggcgcattcaacggcgacagcttcctgccgcaggcgggcaggattcccaacctgatagtcttacgcaccctcagcaaaatcggttttgccggactgcgtatcggttatgcgacaggctgtcccgaagtcatcggcgaactgcaaaaaatcctgccgccctacaatatgaaccaactgagcctgaccaccgccaaactcgccctgcaacactacggcatcatttctgccaacatcgacagcctgaaaaacgaacgcgaacgaatgttcgccgaattgggcaaaatatgccgtctgaacgcctttccaagtcaggcaaacttcattaccatacgcgtacccgatgccgatttgttgtttgacacactcaaacaaaaccgcatcctcgtcaaaaaactgcacggcgcacatccgcttttggaacactgcctgcgcattaccataggcagctccgcacaaaacgatgccgtcctcgacgttatccgccggctctaccga

SEQ ID NO: 1676 - protein, 359 aa, Neisseria gonorrhoeae
MKSVRSFIRNDILAMSAYKITDVPPGFAKLDAMESPAHPFEGHEALMREWRAQLASAPIHLYPNPSGCGLQEALRSAFDIPDCAAVALGNGSDELIQFITMLTAKPGAAMLAAEPGFIMYRHNAALYGMDYVGVPLNGDFTLNLPAVLEAVRKHRPALTFIAYPNNPTGVCFTRAEIEAAIEASDGIVVVDEAYGAFNGDSFLPQAGRIPNLIVLRTLSKIGFAGLRIGYATGCPEVIGELQKILPPYNMNQLSLTTAKLALQHYGIISANIDSLKNERERMFAELGKICRLNAFPSQANFITIRVPDADLLFDTLKQNRILVKKLHGAHPLLEHCLRITIGSSAQNDAVLDVIRRLYR

SEQ ID NO: 1677 - DNA, 315 bp, Neisseria gonorrhoeae
atgcccgttacgcatttccccacgtccgcccggcgaaactatgggaatacccgaaccgtcattcccgcgcaggcgggaatccggttttttgagtttcagtcattcccgataaattgccttagtattgaatgtctagattcccgcctgcgcgggaatgacggcggagcggtttctgttttttccgataaattcctaaaactcaaaatttcatcattcctacaaaaacagaaaaccaaaatcagaaacctaaaatcccgtcattcccacgaaagtgggaatccggttcgttcggtttcgcttgttttaagtttcggg

SEQ ID NO: 1678 - protein, 105 aa, Neisseria gonorrhoeae
MPVTHFPTSARRNYGNTRTVIPAQAGIRFFEFQSFPINCLSIECLDSRLRGNDGGAVSVFSDKFLKLKISSFLQKQKTKIRNLKSRHSHESGNPVRSVSLVLSFG

SEQ ID NO: 1679 - DNA, 207 bp, Neisseria gonorrhoeae
gtgggaatccggttttttgagtttcagtcattcccgataaattgccttagtattgaatgtctagattcccgcctgcgcgggaatgacgcgtttcatttgccgccccctcccgaaaaacgcaaaaaaatgccgtccgaagacctttcggacggcatttgcggaaaaaccggccgcgcaggcgggtcagaagaagacttcgcgccagct

SEQ ID NO: 1680 - protein, 69 aa, Neisseria gonorrhoeae
VGIRFFEFQSFPINCLSIECLDSRLRGNDAFHLPPPPEKRKKMPSEDLSDGICGKTGRAGGSEEDFAPA

SEQ ID NO: 1681 - DNA, 864 bp, Neisseria gonorrhoeae
atgtaccgctttgatttgagcgattccaatcctgataaatggtctgtaaggactattttcgaaggcgacaagccgattacttccgcgcccgccgtttcccgactggcagacaaacgcgtcgtcatcttcggtacgggcagcgatttgaccgaagatgatgtactgaatacgggcgaacaatatatttacggtatctttgacgacgataaggggacggttaaggtaacggtacaaaacggcacgggaggcgggttgctcgagcaagtgcttaaagaggaaaataaaacattattcctgaacaagggatccgacggatcgggcagtaaggggtgggtagtgaagctgaaggaaggacaacgcgttaccgtcaaaccgaccgtggtattgcgtaccgcctttgtcaccatccgcagctatacgggtaatgacaaatgcggcgcacaaaccgccattttgggcatcaataccgccgacggcggcgcattgactccgagaagcgcgcgcccgattgtgccggataaccaggttgcgcaatattccggccatcagaaaatgaacggcaagtccatccccataggctgcatgtggaaaaacggcaaaaccgtctgcccgaacggatatgtttacgacaaaccggttaatgtgcgttacctggacgaaaagaaaacagacgatttccccgtcacggcagacggtgatgcaggcggcagcggaacattcaaagagggtaaaaaacccgcccgcaataaccggtgcttctccggaaaaggtgtgcgcaccctgctgatgaacgatttggacagcttggatattaccggcccgatgtgcggtatcaaacgcttaagctggcgcgaagtcttcttc

SEQ ID NO: 1682 - protein, 288 aa, Neisseria gonorrhoeae
MYRFDLSDSNPDKWSVRTIFEGDKPITSAPAVSRLADKRVVIFGTGSDLTEDDVLNTGEQYIYGIFDDDKGTVKVTVQNGTGGGLLEQVLKEENKTLFLNKGSDGSGSKGWVVKLKEGQRVTVKPTVVLRTAFVTIRSYTGNDKCGAQTAILGINTADGGALTPRSARPIVPDNQVAQYSGHQKMNGKSIPIGCMWKNGKTVCPNGYVYDKPVNVRYLDEKKTDDFPVTADGDAGGSGTFKEGKKPARNNRCFSGKGVRTLLMNDLDSLDITGPMCGIKRLSWREVFF

SEQ ID NO: 1683 - DNA, 93 bp, Neisseria gonorrhoeae
ttgcgtttgcgcctgcgcccccccccccccgccggtatgggaaaacatcaagatggcggcataaagcgcggtatggcggaaaacccgcctttt

SEQ ID NO: 1684 - protein, 31 aa, Neisseria gonorrhoeae
LRLRLRPPPPAGMGKHQDGGIKRGMAENPPF

SEQ ID NO: 1685 - DNA, 2334 bp, Neisseria gonorrhoeae
atgtccgagcggcggggtttcaaccgaaaaggaaatacgatgaataaaactttaaaaaggcgggttttccgccataccgcgctttatgccgccatcttgatgttttcccataccggcgggggggggggggcgcaggcgcaaacgcaaacccgtaaatacgctattatcatggacgaacgaaatcagccggaggtaaagtgggagggttcatattcaaccttaagggaaaaagacggggaacgcaaatttatctatacgaaccagagaaacaagttgaaccaacaaaacaattttatctcattcgacaataccgatacccttgtttcccgacaaagcggtactgccgtttttggcacagccacctacctgccgccctacggcaaggtttccggctttgataccgccgagctgaacaagcgcggcaatgccgtcaattggattcataccacccgggccgggctggcaggctacgtctacaccggcgtcatatgcagagacacagggcaatgcccccaacttgtctataaaacccgattttccttcgacaacaccggtttggcaaaaaatacgggcaggctggataggcacacagagccaagccgcgaaaattcgcccatttacaaattgtcggattatccttggttgggcgtgtctttcaatttgggcagcgagggtaccgccaaagatggcagatcatccaacaaattggtatcttcttttgatgaaaacaatagtaatagtaatcaaaacctcgtctatacgacagaaggccaccgtatttcccttggcgactggcagcgcgaaagtaccgccatggcctattatctgaacgccaaactgcacctgctggataaacaacggattgaaaatatcgcgccaggcaaaacagtggatttgggcaccttgagaccgcgcgtcgagacgaagacaaataattgggggaatctgctaagtttttgggctacgtggaagattgaagataaagggaacattacagtccgcctcggcctgccggaagtcaaagcaggccgctgcaccaacaccgcccaccccaatcccaacgccaaagccccttcgccggccctgaccgcccccgcgctgtggttcggccctgtgcaaaatggcaaggtgcagatgtattccgcttcggtttccacctaccccggcagttcgagcagccgcatcttcctccaagagctgaaaactcgaaccgaccccgcccggcccggccggcattccctcgccgctttggatacgcagaacatcaaaagccgcgagccgaatttcaactcaaggcagaccgtcatccgattgccgggcggcgtgtacaagatcaactcgggcaagaacggcggccgggtcgcgggtattaatggcaatgacggcaaaaacgacactttcggcatctacaaggacaggctcgtcacacctgaggccgacgagtggagcaacatactgctgccttggacggcccggtattacggtaatgacgatatatttaaaacattcaaccaaccaaacagcaaaacacaaaacggcaaaaaacaatacagccaaaaataccgcatccgcacaaaagaagatgacaatgacaaaccccgcgatttgggcgacatcgtcaacagcccgattgtcgcggtcggcgggtatttggcaacttctgccaacgacgggatggtgcacctgtttaaaagaaacggcacagaccaacgaggctacgaactgaagctcagctacatccccggtacgatggagcgtaaggatattgaaggcaatgactccgacctcgccaaagagctgcgcgcctttgccgaaaaaggctatgtgggcgaccgctacggcgtggacggcggctttgtcttgcgccgcattacagatgaccaagacaagcaaaaacatttctttatgtttggtgcgatgggccttggcggcagaggcgcgtatgccttggatttaagcaaaatcgacggaaattatccagccgccgctcccctgtttgatgtcaaaaatggcgataataacggcaaaaatcgcgtgaaagtggaattaggctacaccgtcggcacgccgcaaatcggcaaaacccaaaacggcaaatacgccgccttcctcgcttccggttatgcggctaaaaatattggcagcggcgataataaaaccgcgctgtatgtatatgatttggaaaacggcagtggtagtctgattaaaaaaatcgaagtgcagggcggcaagggcgggctttcgtcccccacgctggtggataaagatttggacggcacggtcgatatcgcctatgccgggcgaccgggggcggcaatatgtaccgctttgatt

SEQ ID NO: 1686 - protein, 778 aa, Neisseria gonorrhoeae
MSERRGFNRKGNTMNKTLKRRVFRHTALYAAILMFSHTGGGGGAQAQTQTRKYAIIMDERNQPEVKWEGSYSTLREKDGERKFIYTNQRNKLNQQNNFISFDNTDTLVSRQSGTAVFGTATYLPPYGKVSGFDTAELNKRGNAVNWIHTTRAGLAGYVYTGVICRDTGQCPQLVYKTRFSFDNTGLAKNTGRLDRHTEPSRENSPIYKLSDYPWLGVSFNLGSEGTAKDGRSSNKLVSSFDENNSNSNQNLVYTTEGHRISLGDWQRESTAMAYYLNAKLHLLDKQRIENIAPGKTVDLGTLRPRVETKTNNWGNLLSFWATWKIEDKGNITVRLGLPEVKAGRCTNTAHPNPNAKAPSPALTAPALWFGPVQNGKVQMYSASVSTYPGSSSSRIFLQELKTRTDPARPGRHSLAALDTQNIKSREPNFNSRQTVIRLPGGVYKINSGKNGGRVAGINGNDGKNDTFGIYKDRLVTPEADEWSNILLPWTARYYGNDDIFKTFNQPNSKTQNGKKQYSQKYRIRTKEDDNDKPRDLGDIVNSPIVAVGGYLATSANDGMVHLFKRNGTDQRGYELKLSYIPGTMERKDIEGNDSDLAKELRAFAEKGYVGDRYGVDGGFVLRRITDDQDKQKHFFMFGAMGLGGRGAYALDLSKIDGNYPAAAPLFDVKNGDNNGKNRVKVELGYTVGTPQIGKTQNGKYAAFLASGYAAKNIGSGDNKTALYVYDLENGSGSLIKKIEVQGGKGGLSSPTLVDKDLDGTVDIAYAGRPGAAICTALI

SEQ ID NO: 1687 - DNA, 288 bp, Neisseria gonorrhoeae
ttgaaaccccgccgctcggacatccgtccttcgggacggcaggatcaggctttgtccgggaggggtgcaagcccttccgaatcagggcggcgccttatgtgccgccctgcgtgttggaacatattttatcccttaaatcttgcttcgcgggataccgtcggcggcaggcgcgccgcaaacggcgggattcggcaaaccgcccgatcccgcgcccgccggattgccggttgcaaagcccccttcgcccggctgccaaagggggatgttcgcaaaggtaacgcgcccctc

SEQ ID NO: 1688 - protein, 96 aa, Neisseria gonorrhoeae
LKPRRSDIRPSGRQDQALSGRGASPSESGRRLMCRPACWNIFYPLNLASRDTVGGRRAANGGIRQTARSRARRIAGCKAPFARLPKGDVRKGNAPL

SEQ ID NO: 1689 - DNA, 174 bp, Neisseria gonorrhoeae
gtgcaatgtatagggttgccgcatcattctccttgcgcgcttatccatggtacagcggtttttggcaatccgcaaccgtttgcccggcccgccattgccgcctgcgcggcaatggcgggccggggaggcggcattttccaagttgcggcaacctttcccaacaacttaaccgcc

SEQ ID NO: 1690 - protein, 58 aa, Neisseria gonorrhoeae
VQCIGLPHHSPCALIHGTAVFGNPQPFARPAIAACAAMAGRGGGIFQVAATFPNNLTA

SEQ ID NO: 1691 - DNA, 402 bp, Neisseria gonorrhoeae
ttgttgggaaaggttgccgcaacttggagaatgccgcctccccggccctcccccacgggggagggagcggattgcggcagatttttcggttgcaggcgatttgaaaggcaacttaaatttgcagctgttgtttcaggtcgtctgaaaaataaaaagcagcctgcacaacctgttttccttgcagcaaacctcaaccccaacagccgacccgtcctctctccctgtgggagagagctggagagagggcaacaagccgcaaggcttgtatttaggcggttaagttgttgggaaaggttgccgcaacttggaaaatgccgcctccccggcccgccattgccgcgcaggcggcaatggcgggccgggcaaacggttgcggattgccaaaaaccgctgtaccatgga

SEQ ID NO: 1692 - protein, 134 aa, Neisseria gonorrhoeae
LLGKVAATWRMPPPRPSPTGEGADCGRFFGCRRFERQLKFAAVVSGRLKNKKQPAQPVFLAANLNPNSRPVLSPCGRELERGQQAARLVFRRLSCWERLPQLGKCRLPGPPLPRRRQWRAGQTVADCQKPLYHG

SEQ ID NO: 1693 - DNA, 528 bp, Neisseria gonorrhoeae
atgtatagggttgccgcatcattctccttgcgcgcttatccatggtacagcggtttttggcaatccgcaaccgtttgcccggcccgccattgccgcctgcgcggcaatggcgggccggggaggcggcattttccaagttgcggcaacctttcccaacaacttaaccgcctaaatacaagccttgcggcttgttgccctctctccagctctctcccacagggagagaggacgggtcggctgttggggttgaggtttgctgcaaggaaaacaggttgtgcaggctgctttttatttttcagacgacctgaaacaacagctgcaaatttaagttgcctttcaaatcgcctgcaaccgaaaaatctgccgcaatccgctccctcccccgtgggggagggccggggaggcggcattctccaagttgcggcaacctttcccaacaactcaaccgccccaatacaagcctttcggcttgttgccctctctccagccctctcccacggggagagaggacggggaggctgttggaat

SEQ ID NO: 1694 - protein, 176 aa, Neisseria gonorrhoeae
MYRVAASFSLRAYPWYSGFWQSATVCPARHCRLRGNGGPGRRHFPSCGNLSQQLNRLNTSLAACCPLSSSLPQGERTGRLLGLRFAARKTGCAGCFLFFRRPETTAANLSCLSNRLQPKNLPQSAPSPVGEGRGGGILQVAATFPNNSTAPIQAFRLVALSPALSHGERGRGGCWN

SEQ ID NO: 1695 - DNA, 156 bp, Neisseria gonorrhoeae
ttggggcggttgagttgttgggaaaggttgccgcaacttggagaatgccgcctccccggccctcccccacgggggagggagcggattgcggcagatttttcggttgcaggcgatttgaaaggcaacttaaatttgcagctgttgtttcaggtcgtc

SEQ ID NO: 1696 - protein, 52 aa, Neisseria gonorrhoeae
LGRLSCWERLPQLGECRLPGPPPRGRERIAADFSVAGDLKGNLNLQLLFQVV

SEQ ID NO: 1697 - DNA, 171 bp, Neisseria gonorrhoeae
ttgggaaaggttgccgcaacttggagaatgccctctccccggccctcccccacgggggagggagtgggtttcggcagatttttcggttgcaggcgatttgaaaggcaacttagatttgcagctgttgtttcaggtcgtctgaaaagcaaaaagcagcctgcacaacctgat

SEQ ID NO: 1698 - protein, 57 aa, Neisseria gonorrhoeae
LGKVAATWRMPSPRPSPTGEGVGFGRFFGCRRFERQLRFAAVVSGRLKSKKQPAQPD

SEQ ID NO: 1699 - DNA, 1098 bp, Neisseria gonorrhoeae
ttgcgaacagaggcacacatcatgaatatacaaaacatccgcaccctcctcgacaccgtcgccgttccgaatacggcacgcacgctcggcggcgaaaaggccgtccgctcggtcggacagcgttcagacggcatccatatcgccctgcatttcggcttccctgtcgcgcacatcgccgccgccctcgccgatgccgtacaagaaaccctgatgcccgaaacaggcggcgcgcacatccacttgggcatagacaccgaaatcggcacacacaaagtccggcccggcgttactactatcaaaggcgtgaaaaacatcattgccgtcgcctcgggaaaaggcggcgtgggcaaatcaacaaccaccgccaaccttgccgccgcaatggcgcgcatgggcgcgcgcgtcggcgtgctcgatgccgacctttacggtccgagccagcccacgatgctgggcgtacacgaccgcaaacccgatcagaaaaaccaaaaactcattcccgtcgaatcttcagacggcatacaggtcatgtccatcggctttctcgtcgataccggccaagccgtcgtctggcgcgggccgatggtcagccaagccttgcagcagctgatgttccaaagcgagtgggacgaagtggactatcttttcatcgacctgccccccggcacgggcgacatccaactcacgctgtcccaacgcatccccgtaaccgggtccgtcatcgtaaccacgccgcaggacatcgcgctgatagacgcgcgcaaggctgtggatatgttccgcaaggtcaacattccgattttgggcgtattggaaaacatgtccgtccatatctgctccaactgcgggcacagcgaagcactgttcggcacggacggcggcaaagatttggcggcacgcctcaacgtccccctgctcggacagcttcccctaagcctgcccgtacgcgaagccatggacggcggcacaccggcgcgactgttcgacgaacaccccgccatcgcccgaatctacaccgatgccgcattccaaatcgccctgggcattgccgacaaaggcaaagacttcagcagccggttccctaaaattgtcgtcgaa

SEQ ID NO: 1700 - protein, 366 aa, Neisseria gonorrhoeae
LRTEAHIMNIQNIRTLLDTVAVPNTARTLGGEKAVRSVGQRSDGIHIALHFGFPVAHIAAALADAVQETLMPETGGAHIHLGIDTEIGTHKVRPGVTTIKGVKNIIAVASGKGGVGKSTTTANLAAAMARMGARVGVLDADLYGPSQPTMLGVHDRKPDQKNQKLIPVESSDGIQVMSIGFLVDTGQAVVWRGPMVSQALQQLMFQSEWDEVDYLFIDLPPGTGDIQLTLSQRIPVTGSVIVTTPQDIALIDARKAVDMFRKVNIPILGVLENMSVHICSNCGHSEALFGTDGGKDLAARLNVPLLGQLPLSLPVREAMDGGTPARLFDEHPAIARIYTDAAFQIALGIADKGKDFSSRFPKIVVE

SEQ ID NO: 1701 - DNA, 99 bp, Neisseria gonorrhoeae
ttgtgcgaacttttacacggtatgcggcggattgtgaaaatccgttgccaaaatatcccgtgcaaacagcagtctgcaattaagcctgtaaaaattgct

SEQ ID NO: 1702 - protein, 33 aa, Neisseria gonorrhoeae
LCELLHGMRRIVKIRCQNIPCKQQSAIKPVKIA

SEQ ID NO: 1703 - DNA, 459 bp, Neisseria gonorrhoeae
ttggtgtttttgctggtgtcgctgtttttggattgggtacgcaagcccgacgaacctgccggggcggcagggcggcctttgaccctgctgtcggggcagcggctgactttgggacagtttagccgggataggacggtgctggtgtatttttggggaagctggtgcggcgtgtgccgttatcagtcgccgataatcgatgatttggcggcggacggcgtgccggtcgtcggtgtggcggtacgttccggcagcgcgtccgaagtggcggcatatatggcaaaacggggcttgggctttccgactgtcagcgatgaggacgggggtttggcaaggtcttggcggattgccgcaacgcctgccgtcgttttggtcaaaaatgggaaaatggtccgctatacgacgggaatcagcagttattggggcttgcgcgcacgaatttttcaggcggattttttcggt

SEQ ID NO: 1704 - protein, 153 aa, Neisseria gonorrhoeae
LVFLLVSLFLDWVRKPDEPAGAAGRPLTLLSGQRLTLGQFSRDRTVLVYFWGSWCGVCRYQSPIIDDLAADGVPVVGVAVRSGSASEVAAYMAKRGLGFPTVSDEDGGLARSWRIAATPAVVLVKNGKMVRYTTGISSYWGLRARIFQADFFG

SEQ ID NO: 1705 - DNA, 93 bp, Neisseria gonorrhoeae
ttgattctctacatagcggaaagtttgacaaaaacaaaagttaaccgaaaaaatccgcctgaaaaattcgtgcgcgcaagccccaataactgc

SEQ ID NO: 1706 - protein, 31 aa, Neisseria gonorrhoeae
LILYIAESLTKTKVNRKNPPEKFVRASPNNC

SEQ ID NO: 1707 - DNA, 96 bp, Neisseria gonorrhoeae
ttgggtaggcattgtttaagtctccaagttatcgaaaatcaaactttcaaaccgtcgggaaagcctgtgggcgtaatttttgatgcaaccgttata

SEQ ID NO: 1708 - protein, 32 aa, Neisseria gonorrhoeae
LGRHCLSLQVIENQTFKPSGKPVGVIFDATVI

SEQ ID NO: 1709 - DNA, 963 bp, Neisseria gonorrhoeae
atgccgtcctcgacgttatccgccggctctaccgataaaccaaacggaatccctatgaccaagacacaactccacctgaacaacttcctgactctcgcccaagaagcaggttcgctgcccaagcttgccaaactctgcggctaccgtacccccgtcgcactttacaaactcaaacaacgccttgaaaagcaggcagaagaccccgatgcgcgcggcatccgtcccagcctgatggcaaaactcgaaaaacacaccggcaaacccaaaggctggctcgacagaaaacaccgcgaacgcactgtccccgaaaccgccgcagaaagcaccggaactgccgaaacccgaattgccgaaaccgcatctgctgccggctgccgcagcgttaccgtcaaccgcaatacctgcgaaacccaaatcaccgtctccatcaacctcgacggcagcggcaaaagcaggctggataccggcgttcccttcctcgaacacatgatcgaccaaatcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcacactaatcggacgtttcgatgtcgatttgtttgaagaatttttccacggcatcgtcaaccacagcatgatgaccctgcacatcgacaacctcagcggcaaaaacgcccaccatcaggcggaaaccgtattcaaagccttcgggcgcgccctgcgtatggcagtcgaacacgacccgagaatggctgggcaaaccccctcgaccaaaggcacgctgaccgca

SEQ ID NO: 1710 - protein, 321 aa, Neisseria gonorrhoeae
MPSSTLSAGSTDKPNGIPMTKTQLHLNNFLTLAQEAGSLPKLAKLCGYRTPVALYKLKQRLEKQAEDPDARGIRPSLMAKLEKHTGKPKGWLDRKHRERTVPETAAESTGTAETRIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRTLIGRFDVDLFEEFFHGIVNHSMMTLHIDNLSGKNAHHQAETVFKAFGRALRMAVEHDPRMAGQTPSTKGTLTA

SEQ ID NO: 1711 - DNA, 195 bp, Neisseria gonorrhoeae
aagtagtatctcgtcatgctcttcgccaaacagcacgaccacgcgggcagattgggaattgaacgaaaaaggtgtgtgcaaaacggcgtgttcgacgatttggacgatttcatctttgccaacgggcaggtttttatttaacgaataaacggaacggcggctttcggcagcctgttgcagggattgacggctcat

SEQ ID NO: 1712 - protein, 44 aa, Neisseria gonorrhoeae
YLVMLFAKQHDHAGRLGIERKRCVQNGVFDDLDDFIFANGQVFI

SEQ ID NO: 1713 - DNA, 924 bp, Neisseria gonorrhoeae
ttgggcgggccgtctcttgtgtcaggaggaaatatgattattgtcatgagcaggcgtgccgccgaagcggacattgccggcgttgtcgccttcatccgcagcagaggtctgcgagaacacatttctcacggcgacgagcgtaccgtcatcggcgcaatcggcgacgatagggttttgagcgtcagggaggtacagacgctgccggaggtcgagaaagccgtccgcattttggacacatggaaaaccgtcagtcgggaaaatcgggcggaagacagccgcgttgccgccaaaggcgtggctttcggcggcggggaaaccgtccgtatcgctgcagaaccgtcagtatggagcaatgcggatgcagtgtttctggatccgtttttcacttcggcaaacttatacgacactttaagtgcggatgaagggcggggacggtgcagacggttggcggaacaggccgcatcggcgcatggcgcagggaaacccgtattggtgcgcgttcgcaacgtccgccatgtcgaagcggctttgaatgcgggagcggacatcctgtatttgggcggcgggctgatgtccgatcttgccgtattgaatgaagccggaagtctgaacattcccttggttctgtgtaaagacaagcaccattctgccgaagattggttgaatgccgcagaatatgtcgtctcgcgcggcaaccgccacctgattctgggcgagtcgggtgtgttgggccataccaaaggccatccctaccgtttggatgtcgaatccatcgtgaaagtccgccaaatcagccatctgcccgtgattgcgaatattacgggattatggagccgcgatatgccgcaggaaatcctgtacggcttggcaaaggcggcaggcgcgtgcggaatcgtcggaacctgttttgaaaaggcgggcgga

SEQ ID NO: 1714 - protein, 308 aa, Neisseria gonorrhoeae
LGGPSLVSGGNMIIVMSRRAAEADIAGVVAFIRSRGLREHISHGDERTVIGAIGDDRVLSVREVQTLPEVEKAVRILDTWKTVSRENRAEDSRVAAKGVAFGGGETVRIAAEPSVWSNADAVFLDPFFTSANLYDTLSADEGRGRCRRLAEQAASAHGAGKPVLVRVRNVRHVEAALNAGADILYLGGGLMSDLAVLNEAGSLNIPLVLCKDKHHSAEDWLNAAEYVVSRGNRHLILGESGVLGHTKGHPYRLDVESIVKVRQISHLPVIANITGLWSRDMPQEILYGLAKAAGACGIVGTCFEKAGG

SEQ ID NO: 1715 - DNA, 375 bp, Neisseria gonorrhoeae
atgacccaattcaggcctattctgaatcaggcgaatattaccgatcagcaatggcggattatccgtcttttggcggaaaacggcacattggattttcaggatttggcgaatcaggcgtgcattttgcgccccagcctgaccggtatcctgacccgccttgaaaaagcggggttggtcgtccgcctgaaaccttccaacgaccaacggcgcgtttatctgaagctgacttccgagggcgagaagctgtatgaggaaatcggcgaagaagtggacgagcgttacgacgctatcgaggaagtgctgggccgcgagaaaatgctgctgcttaaagacctgttggcagaacttgccaaaatcgaggatgcgttgaactcg

SEQ ID NO: 1716 - protein, 125 aa, Neisseria gonorrhoeae
MTQFRPILNQANITDQQWRIIRLLAENGTLDFQDLANQACILRPSLTGILTRLEKAGLVVRLKPSNDQRRVYLKLTSEGEKLYEEIGEEVDERYDAIEEVLGREKMLLLKDLLAELAKIEDALNS

SEQ ID NO: 1717 - DNA, 486 bp, Neisseria gonorrhoeae
atgtgcagcagttctgattcaaaaagccgtcggtcggacgtttccgcgcattacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggaagtcagcttcagataaacgcgccgttggtcgttggaaggtttcaggcggacgaccaaccccgctttttcaaggcgggtcaggataccggtcaggctggggcgcaaaatgcacgcctgattcgccaaatcctgaaaatccaatgtgccgttttccgccaaaagacggataatccgccattgctgatcggtaatattcgcctgattcagaataggcctgaattgggtcatcagggcttcccttgcctgtatcagaccgatattgatagacgcatgttt

SEQ ID NO: 1718 - protein, 162 aa, Neisseria gonorrhoeae
MCSSSDSKSRRSDVSAHYGVLRVQRILDFGKFCQQVFKQQHFLAAQHFLDSVVTLVHFFADFLIQLLALGSQLQINAPLVVGRFQADDQPRFFKAGQDTGQAGAQNARLIRQILKIQCAVFRQKTDNPPLLIGNIRLIQNRPELGHQGFPCLYQTDIDRRMF

SEQ ID NO: 1719 - DNA, 96 bp, Neisseria gonorrhoeae
ttgaaaagttttctgcaaatccgccatttttcccctttaaaccgtcccctatataagaatgctgcacacaaggcatccccccatgtgcagcagttc

SEQ ID NO: 1720 - protein, 32 aa, Neisseria gonorrhoeae
LKSFLQIRHFSPLNRPLYKNAAHKASPHVQQF

SEQ ID NO: 1721 - DNA, 498 bp, Neisseria gonorrhoeae
atggcggatttgcagaaaacttttcaaacttcgttccgtgatgcgatggcatcctgtgcggcaggcgttcatgtcatcacgacagacggtgcggcagggcgttacggcattacaatgacggcggttgcgccggttaccgacgagccgccgaccgtgatgctgtgcataaaccggagtgcgcgaatcattccgatcctgtcggaaaacggcagcctctgcatcaatatgctggcggacgaacatcaggatgttgccgaacattttgccgggctgaccggcctgtcgcccgaagagcggtttgcctaccatatttggcatcgcggcaaaacgggacaacttgaaatagaaggcgcgttggcgcacctgcacgggcatattgtcggcaaacatgaaatcggcacgcattttgtgttttacgtcaggctcgacgaaatcaaaaactgcgggtgcaaacgccccgcgctgctgtatttcagacggcagtttaggcctttagac

SEQ ID NO: 1722 - protein, 166 aa, Neisseria gonorrhoeae
MADLQKTFQTSFRDAMASCAAGVHVITTDGAAGRYGITMTAVAPVTDEPPTVMLCINRSARIIPILSENGSLCINMLADEHQDVAEHFAGLTGLSPEERFAYHIWHRGKTGQLEIEGALAHLHGHIVGKHEIGTHFVFYVRLDEIKNCGCKRPALLYFRRQFRPLD

SEQ ID NO: 1723 - DNA, 693 bp, Neisseria gonorrhoeae
atgaaagcgatgatactggcggcaggacgcggcgagcgtatgcgccctttgaccgacaccactccgaagccgctgctcgatgtggcgggtaagcctctaatcggttggcacttgtgccgtctgaagcaggcggggtttaccgaaatcgtcatcaaccacgcttggctgggtcggcagatagaaaatgctttgggcgacggctcggcttatggcgtgaacatcgcctattcgcccgaacccgcaggcggtttggaaacggcaggcggcatcgcgcaggcattgccgctgttgggtgggcagccgtttttggtggccaacggcgacgtgctgaccgacatcgattttaccgccgcgtttcagacggcatcgtccctgcccgggcacatttccgcacatttgtggctggtgggaaatcccccgcacaaccccgacggcgatttttccctgctgcccgacggcagcgtgcggccggaagtatccggcggcaacggactgacattcagcggcgtgggtatttaccgtcctgaaatgtttgacggaatcgaagcgggcagtgtggcaaaactcgcgcccgtattgctgaacgaaatgcggcaaaaccgcgtgagcggtcagaagcatacgggcctgtggctggatgtcggcacggtatgccgtctgaaggaagcgcaagcccttgcagcggcttggaag

SEQ ID NO: 1724 - protein, 231 aa, Neisseria gonorrhoeae
MKAMILAAGRGERMRPLTDTTPKPLLDVAGKPLIGWHLCRLKQAGFTEIVINHAWLGRQIENALGDGSAYGVNIAYSPEPAGGLETAGGIAQALPLLGGQPFLVANGDVLTDIDFTAAFQTASSLPGHISAHLWLVGNPPHNPDGDFSLLPDGSVRPEVSGGNGLTFSGVGIYRPEMFDGIEAGSVAKLAPVLLNEMRQNRVSGQKHTGLWLDVGTVCRLKEAQALAAAWK

SEQ ID NO: 1725 - DNA, 354 bp, Neisseria gonorrhoeae
ttgaccgccgttttcgccaaaatgggcttgcagggcatagattcggatttcgccacctttatccgcaccttggtcatcctcgccgccttggtattgtttttgacctacaccggcaaatggcagggcgtaaacggcttcacggggcgcaaccggacgtttctggttttgtccggactcgccaccggcgcatcttggctcgcctacttcaaagccctgcaactgggcaaagccccgcaagtcgcgcccgtcgacaaattcagcctggtcttggtcgcgctgatggcggtgattttcttagacgaacgcccgaacacgcaggaatggatagacttggggctggttacggcggcgtgt

SEQ ID NO: 1726 - protein, 118 aa, Neisseria gonorrhoeae
LTAVFAKMGLQGIDSDFATFIRTLVILAALVLFLTYTGKWQGVNGFTGRNRTFLVLSGLATGASWLAYFKALQLGKAPQVAPVDKFSLVLVALMAVIFLDERPNTQEWIDLGLVTAAC

SEQ ID NO: 1727 - DNA, 405 bp, Neisseria gonorrhoeae
ttgggcattggcatcggcaggcttcgcctcattgaccgccgttttcgccaaaatgggcttgcagggcatagattcggatttcgccacctttatccgcaccttggtcatcctcgccgccttggtattgtttttgacctacaccggcaaatggcagggcgtaaacggcttcacggggcgcaaccggacgtttctggttttgtccggactcgccaccggcgcatcttggctcgcctacttcaaagccctgcaactgggcaaagccccgcaagtcgcgcccgtcgacaaattcagcctggtcttggtcgcgctgatggcggtgattttcttagacgaacgcccgaacacgcaggaatggatagacttggggctggttacggcggcgtgttgacgttggcactgaaacgt

SEQ ID NO: 1728 - protein, 135 aa, Neisseria gonorrhoeae
LGIGIGRLRLIDRRFRQNGLAGHRFGFRHLYPHLGHPRRLGIVFDLHRQMAGRKRLHGAQPDVSGFVRTRHRRILARLLQSPATGQSPASRARRQIQPGLGRADGGDFLRRTPEHAGMDRLGAGYGGVLTLALKR

SEQ ID NO: 1729 - DNA, 153 bp, Neisseria gonorrhoeae
ttggcgaaaacggcggtcaatgaggcgaagcctgccgatgccaatgcccaaaacagctatgcgttgctgcccatgttttctccttggattgtgaacaatatgaacggtatttttgttgctgcgtcaaaaatttcactgcgggtttggtgcgga

SEQ ID NO: 1730 - protein, 51 aa, Neisseria gonorrhoeae
LAKTAVNEAKPADANAQNSYALLPMFSPWIVNNMNGIFVAASKISLRVWCG

SEQ ID NO: 1731 - DNA, 90 bp, Neisseria gonorrhoeae
ttgttgctgcgtcaaaaatttcactgcgggtttggtgcggataacgttataatatgcctgatattattttcaatccacctgtttgtcgcc

SEQ ID NO: 1732 - protein, 30 aa, Neisseria gonorrhoeae
LLLRQKFHCGFGADNVIICLILFSIHLFVA

SEQ ID NO: 1733 - DNA, 1674 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttc

SEQ ID NO: 1734 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 1735 - DNA, 1089 bp, Neisseria gonorrhoeae
atgagtttgaaatgcggcatcgtcggtttgcccaacgtcggcaaatccaccctttttaacgcgctgacccaatcgggcatcgaagcggcaaactatcccttctgcaccatcgaacccaacgtcggcatcgtcgaagtgcccgacccgcgtatggcggagctggcgaaaatcgtcaatccgcaaaaaatgcagcccgccatcgtcgagtttgtcgatattgccggcttggttgcgggcgcgagcaaaggcgaaggcttgggcaaccggttccttgccaacatccgtgaaaccgatgccatcgtcaacgtcgtgcgctgctttgacgacgacaacatcgtccacgtttccggcaaagtcgatccgattgccgacatcgaaaccatcggcaccgaattggcgcttgccgacttggcaagtgtggaaaaagccatcgtccgcgaagaaaaacgcgcccgatcaggcgacaaagacgcgcaaaaactagtcgatttgtgcaaaaaactgctgccgcatctggacgaaggcaaacccgtgcgttccttcggtttggacgcggaagaacgcgcgctgctgaagccgctgttcctgctgaccgccaaacctgcgatgtatgtgggaaacgttgccgaagacggttttgaaaacaacccgcacctcgaccgcctgaaagaattggcggcaaaagaaaacgcccccgtcgttgccgtctgcgccgcgatggagagcgaaatcgccgaattggaagacggtgaaaaagccgaatttcttgccgaaatgggcttggaagaaccgggcttgaaccgcctcatccgcgcgggttacgaccttttgggactgcaaacctacttcaccgccggcgtgaaagaagtccgcgcgtggacgatacacaaaggcgacaccgcgccgcaagccgccggcgtgatccatacggattttgaacgcggcttcatccgcgcccaagtgattgcctacgatgattttgtctcgctcggcggcgaagccaaagccaaagaagccggcaaaatgcgcgtggaaggcaaggaatacgtcgtgcaggacggcgacgtgatgcactttttgtttaacgtg

SEQ ID NO: 1736 - protein, 363 aa, Neisseria gonorrhoeae
MSLKCGIVGLPNVGKSTLFNALTQSGIEAANYPFCTIEPNVGIVEVPDPRMAELAKIVNPQKMQPAIVEFVDIAGLVAGASKGEGLGNRFLANIRETDAIVNVVRCFDDDNIVHVSGKVDPIADIETIGTELALADLASVEKAIVREEKRARSGDKDAQKLVDLCKKLLPHLDEGKPVRSFGLDAEERALLKPLFLLTAKPAMYVGNVAEDGFENNPHLDRLKELAAKENAPVVAVCAAMESEIAELEDGEKAEFLAEMGLEEPGLNRLIRAGYDLLGLQTYFTAGVKEVRAWTIHKGDTAPQAAGVIHTDFERGFIRAQVIAYDDFVSLGGEAKAKEAGKMRVEGKEYVVQDGDVMHFLFNV

SEQ ID NO: 1737 - DNA, 246 bp, Neisseria gonorrhoeae
ttgccggaaatgccgtctgaagccggttttggtggttttcgacgttcccataccgccggaatgcagccgcatcaaaataaaatcccgcccgcatttccgatttgccctccccgattcctgcaaaacaaactgcctgccctgccgttacgggaagccgtccggtattccgaatatcccgaaccccgatacaaaatgacctttcagacggcatttgcacagcccgccgcgtttcaagtaaaaacatta

SEQ ID NO: 1738 - protein, 82 aa, Neisseria gonorrhoeae
LPEMPSEAGFGGFRRSHTAGMQPHQNKIPPAFPICPPRFLQNKLPALPLREAVRYSEYPEPRYKMTFQTAFAQPAAFQVKTL

SEQ ID NO: 1739 - DNA, 1872 bp, Neisseria gonorrhoeae
atgagccaagccttaccctaccgcccggacatcgacacattgcgcgccgccgccgtcttgtccgtcatcgtgttccatatcgaaaaggattggctgccgggcgggtttctcggtgtcgatatattctttgtgatttcaggctttttgatgacggcgatcctccttcgcgaaatgtccggggggcgtttcttcctcaagacattttatatccgccgcatcaaacggattttgcccgcatttttcgccgtattggcggcaacgctggcaggcggcttctttttattcaccaaagatgatttctttcttttgtggaaatccgcgctgaccgccttgggtttcgcctccaacctgtattttgcaagggggaaggattatttcgatcccgcgcaggaagaaaagcccctgctgcacatctggtctttgtcggtcgaagaacaattttactttgtctttccgatattgctgttgcttgtcgcccgcaaaagcctgcgcgtacagttcggcttcctcgccgcattgtgcgccttaagccttgccgcttcctttatgccttccgcgctcgataaatattacctgccccacctgcgcgcctgcgaaatgctggtcggatcgctgaccgccgtgcggatgcggtaccggcaacagcggaatcccgccgtcgggaaacggtatgccgccgtcggcgcattgttttccgcgtgcatactgtccgcctgcctgtttgcctattcggaacaaaccgcctatttcccgggccccgccgctttgattccctgtctggctgttgccgcgctgatttatttcaaccattacgaacacccgcttaaaaaatttttccaatggaaaatcaccgttgccgccggtttgatttcctattcgctttatctgtggcattggccgatattggcctttatgcgctatatcggcccggacaacctgccgccttattcgccggcggcagcgatcgtcctgaccctggcgttttccctgatttcttatcactgcatcgaaaagccgtttaaaaaatggaaaggctcgttcgcacaatccgttttatggatttatgccttgcctatgctcgttttgggcgcgggctcgtttttcgcgatgaggctgccgtttatggcgcaatacgaccgcttggggctgacgcgttccaacacctcctgccacaacaataccggcaaacaatgcctgtggggggatacggaaaaacagccggaactgctggttttgggcgactcccacgccgaccattacaaaacattcttcgatgccgtgggcaaaaaagaaaaatggtccgccactatggtttccgccgacgcctgcgcctatgtggaaggctacgcgtcccgtgtgttccaaaactgggccgcctgccgcgccgtttaccgctatgccgaagaacacctgccccggtatccgaaagtggttttggcgatgcgctggggcagccagatgcccgaaaacagccgctcccttgcctacgatgccggttttttccaaaaattcgaccgtatgctgcacaaactctcatccgaaaaacaagccgtttacctgatggcggacaacttggcttcgtcttacaacgtccagcgcgcctatatcttgtcttcacgcataccgggttgccgccaaacactgcgcccggacgacgaaagcaccctgaaagccaatgcccgcatcagggaattggcagccaaataccccaacgtctatattattgatgccgccgcctatatccccgcagatttccaaatcggcggattgccggtttactcggacaaagaccacatcaacccttacggcggcacagaattggcgaagcgtttttccgaaaaacaaaggtttctcgatacgcgccataaccat

SEQ ID NO: 1740 - protein, 624 aa, Neisseria gonorrhoeae
MSQALPYRPDIDTLRAAAVLSVIVFHIEKDWLPGGFLGVDIFFVISGFLMTAILLREMSGGRFFLKTFYIRRIKRILPAFFAVLAATLAGGFFLFTKDDFFLLWKSALTALGFASNLYFARGKDYFDPAQEEKPLLHIWSLSVEEQFYFVFPILLLLVARKSLRVQFGFLAALCALSLAASFMPSALDKYYLPHLRACEMLVGSLTAVRMRYRQQRNPAVGKRYAAVGALFSACILSACLFAYSEQTAYFPGPAALIPCLAVAALIYFNHYEHPLKKFFQWKITVAAGLISYSLYLWHWPILAFMRYIGPDNLPPYSPAAAIVLTLAFSLISYHCIEKPFKKWKGSFAQSVLWIYALPMLVLGAGSFFAMRLPFMAQYDRLGLTRSNTSCHNNTGKQCLWGDTEKQPELLVLGDSHADHYKTFFDAVGKKEKWSATMVSADACAYVEGYASRVFQNWAACRAVYRYAEEHLPRYPKVVLAMRWGSQMPENSRSLAYDAGFFQKFDRMLHKLSSEKQAVYLMADNLASSYNVQRAYILSSRIPGCRQTLRPDDESTLKANARIRELAAKYPNVYIIDAAAYIPADFQIGGLPVYSDKDHINPYGGTELAKRFSEKQRFLDTRHNH

SEQ ID NO: 1741 - DNA, 1293 bp, Neisseria gonorrhoeae
atgagcgtcatccaagacctgcaatcgcgcggccttatcgcgcaaaccaccgacatcgaagccttagacgctttgctgaacgaacaaaaaatcgccctttactgcggtttcgacccgacagccgacagcctgcacatcggacacctgctgcccgtattggcattgcgccgcttccaacaggcggggcatacgccgattgcactggtgggcggcgcgaccggtatgatcggcgaccccagcttcaaagccgccgaacgcagcttgaattccgccgaaaccgttgccggctgggtaggaagcatacgcagccaattaacccctttcttgagctttgaaggcggaaacgccgccattatggcgaacaatgccgactggttcggcagcatgaactgcctcgacttcctgcgcgacatcggcaagcatttctccgtcaacgccatgctgaacaaagaatccgtcaaacagcgcatcgaccgcgacggcgcaggcatttccttcaccgagttcgcctattccctgctgcaaggctacgacttcgccgagttgaacaaacgccacggcgcggttttggaaatcggcggttccgaccagtggggcaacatcaccgccggtatcgacctgacccgccgcctgaaccaaaaacaagtgttcggtctgaccctgcctttggttaccaaatccgacggtaccaaattcggcaaaaccgaaggcggcgcggtgtggctgaacgcgaaaaaaacctcgccgtaccagttctaccagttctggctgaaagtcgccgatgccgatgtgtataaattcctgaaatactttaccttcctgtccatcgaagaaatcggtgtcgtcgaagccaaagacaaggcaagcggcagcaagcccgaagcgcaacgcatcctcgccgaagaaatgacccgcctgattcacggcgaagaagcccttgccgccgcgcaacgcatttccgaaagcctgtttgccgaagaccaaagccggcttaccgaaagcgacttcgagcagctcgccctcgacggcctgcctgcatttgaagtttcagacggcatcaacgccgtcgaagccttggtcaaaaccggcttggcagcgtccaacaaagaagcgcgcggctttgtcaatgccaaagcggttctgctcaacggcaaaccggctgaagccaacaaccccaaccacgccgccgaacgccccgacgatgcctatctgttgataggcgaatacaaacgtttcggcaaatacaccatcctccggcgcggcaaacgcaaccacgcgcttttggtttggaaa

SEQ ID NO: 1742 - protein, 431 aa, Neisseria gonorrhoeae
MSVIQDLQSRGLIAQTTDIEALDALLNEQKIALYCGFDPTADSLHIGHLLPVLALRRFQQAGHTPIALVGGATGMIGDPSFKAAERSLNSAETVAGWVGSIRSQLTPFLSFEGGNAAIMANNADWFGSMNCLDFLRDIGKHFSVNAMLNKESVKQRIDRDGAGISFTEFAYSLLQGYDFAELNKRHGAVLEIGGSDQWGNITAGIDLTRRLNQKQVFGLTLPLVTKSDGTKFGKTEGGAVWLNAKKTSPYQFYQFWLKVADADVYKFLKYFTFLSIEEIGVVEAKDKASGSKPEAQRILAEEMTRLIHGEEALAAAQRISESLFAEDQSRLTESDFEQLALDGLPAFEVSDGINAVEALVKTGLAASNKEARGFVNAKAVLLNGKPAEANNPNHAAERPDDAYLLIGEYKRFGKYTILRRGKRNHALLVWK

SEQ ID NO: 1743 - DNA, 195 bp, Neisseria gonorrhoeae
ttggaaataatccgattgccgcagaaatgccgtctgaagctttcagacggcatttttatcaaatgcaaaacaccctgcgcctgtcgatatgtcgtcatttccatgcaggcgggaattcaaacttgtccgcacggaaacttatcgggcaaaacggtttcttcagttctacgttctagattcccgcctgcgcgggaa

SEQ ID NO: 1744 - protein, 65 aa, Neisseria gonorrhoeae
LEIIRLPQKCRLKLSDGIFIKCKTPCACRYVVISMQAGIQTCPHGNLSGKTVSSVLRSRFPPARE

SEQ ID NO: 1745 - DNA, 2100 bp, Neisseria gonorrhoeae
atggatttattatcggttttccacaaataccgtctgaaatatgcggtggcggtgctgacgatgctgcttttggcggcagtcgggctgcacgcttccgtatatcgcaccttcacgcccgaaaacatccgcagccgcctccaacaaagcattgcccatacccaccggaaaatctcgtttgatgcggatatacggcgcaggcttctgccccgcccgaccgtcatcctgaaaaacctgaccattaccgaacccgacggcggccgggtcgccgtttccgtcaaagaaaccaaaatcggattgagctggaaaaacctgtggtcggatcggatacaggttgaaaaatgggtggtttcgggtgcggatcttgccctgacgcgcgacagaaacggcgcttggaacatccaagacctgttcgacggcgcgaaacactccgcctcagtcaaccgcattatcgtcgaaaacagcaccgtccgcctcaatttcctgcagcaacagcttatcctgaaggaaatcagcctcaacctgcaatcccccgattcgtcggggcagcagtttgaaagttcgggcatactggtttggagaaagctgtccgtcccgtggaaaagcagggggctgttcctttcagacggcatcggcacgcccgaaatctcaccgttccattttgaagcttccacttcgctggacggacacggcatcaccatttccaccaccggcagcccttctgtccgcttcaacgccggcggagcggatgccgccggcctcggcctgcgtgcagacacttccttccgcaacctccacctgaccgcgcaaatccccgcactggcactcaaaaacaacagcatcaaaaccggcacggtcaacggcacgtttaccgccggcggcgaatatgcccgatgggacggttcgttcaaactcgacaaagccaacctgcactccggcatcgccaacatcggcaacgccgaaatctccggcagcttcaaaacaccgcgccttcaaaccaatttctccctcggctcgccgttggtttggagtcgggacaacgggctggacgccccgcgcctgcacatatcgacccttcaggataccgtcgaccgcctgccgcaaccccgtttcatcagccggctcgacggttcgctgtccataccgaatctgcaaaattggaatgccgaattaaacggcacattcgaccgccaacccgttgccgcaaaattcaaatatacgcgggaaggcgcaccgcacctggaagccgccgccgcgctgcaaaaattaaacctcgccccctatcttgacgaatttcggcaacaaaacggcaaaatattccccgacatcctcggcaggctgtccggcaacgtcgaggcacacctcaaaatcggcagcatccaactccccggcttgcaactggacgatatggaaacctacctccacgccgacaaagaccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgatgcggtcatcgacctgaccgcaagcggcgaaaaccgcaaacagcttatccgctcgctgcaaggcagcctgtcgctgaatatttccaacggcgcgtggcacggcatcgatatggacagcattttaaaaaacggcctttccgggaaaatctcgggcagcacacccttctaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaagccgtccattaccgtcgattacggcaggctgaccggcggcatcaattcgcgcaaagagaaacagaaaatcctcgaagacaccctgctggaacaatggcagtggctcaaacctaaagaaccg

SEQ ID NO: 1746 - protein, 700 aa, Neisseria gonorrhoeae
MDLLSVFHKYRLKYAVAVLTMLLLAAVGLHASVYRTFTPENIRSRLQQSIAHTHRKISFDADIRRRLLPRPTVILKNLTITEPDGGRVAVSVKETKIGLSWKNLWSDRIQVEKWVVSGADLALTRDRNGAWNIQDLFDGAKHSASVNRIIVENSTVRLNFLQQQLILKEISLNLQSPDSSGQQFESSGILVWRKLSVPWKSRGLFLSDGIGTPEISPFHFEASTSLDGHGITISTTGSPSVRFNAGGADAAGLGLRADTSFRNLHLTAQIPALALKNNSIKTGTVNGTFTAGGEYARWDGSFKLDKANLHSGIANIGNAEISGSFKTPRLQTNFSLGSPLVWSRDNGLDAPRLHISTLQDTVDRLPQPRFISRLDGSLSIPNLQNWNAELNGTFDRQPVAAKFKYTREGAPHLEAAAALQKLNLAPYLDEFRQQNGKIFPDILGRLSGNVEAHLKIGSIQLPGLQLDDMETYLHADKDHIALSRFKSGLYGGHTEGGISIANTRPATYRLQQNASNIQIQPLLQDLFGFHSFSGNGDAVIDLTASGENRKQLIRSLQGSLSLNISNGAWHGIDMDSILKNGLSGKISGSTPFYRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 1747 - DNA, 159 bp, Neisseria gonorrhoeae
atgcttccaacggtttcagacggcattttttacacaattcccgccattttccatcattcccgacaacaccgcaatctcgaaacccgtcattcccgcgcaggcgggaatctagatctgtcagtgcaggaacttatcgggcaaaacggtttcttgagattt

SEQ ID NO: 1748 - protein, 53 aa, Neisseria gonorrhoeae
MLPTVSDGIFYTIPAIFHHSRQHRNLETRHSRAGGNLDLSVQELIGQNGFLRF

SEQ ID NO: 1749 - DNA, 144 bp, Neisseria gonorrhoeae
ttggagtcgatgaatcggtgggcttcagtccgccattcccatcaatccaacatttctaccgttttcatcgaatccatcgaatccgcccctttcgacaatctgaccctatgcaaccgaaccgtcattcccacggaagtgggaatc

SEQ ID NO: 1750 - protein, 48 aa, Neisseria gonorrhoeae
LESMNRWASVRHSHQSNISTVFIESIESAPFDNLTLCNRTVIPTEVGI

SEQ ID NO: 1751 - DNA, 213 bp, Neisseria gonorrhoeae
atgccgtctgaaccttcagacggcatttttgatgcacctgccgtttacgggcgcggggcgggcgcagtaaaatacccgaaccgtcattcccgacaacaccgtaatctcgaaacccgtcattcccgcgcaggcggaaatccggacccccgacgcggcgggaatctatcggaaatgactgaaaccccgcgtcctagattcccacttccgtgggaa

SEQ ID NO: 1752 - protein, 71 aa, Neisseria gonorrhoeae
MPSEPSDGIFDAPAVYGRGAGAVKYPNRHSRQHRNLETRHSRAGGNPDPRRGGNLSEMTETPRPRFPLPWE

SEQ ID NO: 1753 - DNA, 687 bp, Neisseria gonorrhoeae
gtgcaggcggatttagcctacgccgccgaacgcattacccacgattatccggaaccaaccggtgcaaaaaaaggcaaaataagcacggtaagcgattatttcagaaacatccgtacgcattccatccaccccagggtgtcggtcggctacgacttcggcggctggaggatagcggcagattatgcccgttacagaaagtggaacaacagtaaatattccgtcaacacaaaaaaggtgaacgaaaacaagggcgaaaagataaacgtgacgcaatatctgaaggcggaaaatcaggaaaacggtacgttccacgccgtttcttctctcggcttgtccgccgtttacgatttcaaactcaacgacaaattcaaaccctatatcggcatgcgcgtcggctacgggcacgtcagacatcaggttcgttcggttgaacaagaaaccacgactgttaccacttacctacagagtggtaagccaagtcctatcgtacgaggttcgaccctcaaacttccccatcacgaaagccgcagcagccgccgcttgggcttcggcgcgatggcgggcgtgggcatagacgtcgcgcccggtctgaccttggacgccggctaccgctaccactattggggacgcctggaaaacacccgcttcaaaacccacgaagcctcgttgggcgtgcgctaccgcttc

SEQ ID NO: 1754 - protein, 229 aa, Neisseria gonorrhoeae
VQADLAYAAERITHDYPEPTGAKKGKISTVSDYFRNIRTHSIHPRVSVGYDFGGWRIAADYARYRKWNNSKYSVNTKKVNENKGEKINVTQYLKAENQENGTFHAVSSLGLSAVYDFKLNDKFKPYIGMRVGYGHVRHQVRSVEQETTTVTTYLQSGKPSPIVRGSTLKLPHHESRSSRRLGFGAMAGVGIDVAPGLTLDAGYRYHYWGRLENTRFKTHEASLGVRYRF

SEQ ID NO: 1755 - DNA, 141 bp, Neisseria gonorrhoeae
gtgtttcaacacatagcaccgcgcctgctgcgcgtttttgtgcgtttggcgcgttcggcggcgggaaatttgcctacttttcccgcgtcgggcgggcggaacgggcggcacactgtctataaaccgcaataccgtttacaa

SEQ ID NO: 1756 - protein, 47 aa, Neisseria gonorrhoeae
VFQHIAPRLLRVFVRLARSAAGNLPTFPASGGRNGRHTVYKPQYRLQ

SEQ ID NO: 1757 - DNA, 189 bp, Neisseria gonorrhoeae
ttgtgcgtttggcgcgttcggcggcgggaaatttgcctacttttcccgcgtcgggcgggcggaacgggcggcacactgtctataaaccgcaataccgtttacaatgaccgcctgtttcaccacactcccgaacgcaacaatgtttcaacacacgggacggcacatcaagcaccgccctatgtgtcgtcc

SEQ ID NO: 1758 - protein, 63 aa, Neisseria gonorrhoeae
LCVWRVRRREICLLFPRRAGGTGGTLSINRNTVYNDRLFHHTPERNNVSTHGTAHQAPPYVSS

SEQ ID NO: 1759 - DNA, 957 bp, Neisseria gonorrhoeae
atgtccgagtggcggggtttcaaccgaaaaggaaatacaatgaaaatcaggccggggcggcacaacgcgcccgactttccgcacggggccgccgtaaccataggcaatttcgacggcgtacacctcggacacaaacacatcctccaaaaactccgcctcgaagccgacgcacgcggattgcccgtcgtggccgtcgttttcgaaccccaacccaaagaatttttcgcactccgtaccggcaaaaccccgccctgccgtatcagccccctgcgtaccaaactggaattgctggaagggacgggttgcgtcgatgccgcctgggttttgcgtttcgatcggaatttttccgaaatatccgcgcaagcatttatcgaccgcctgctgcgtcaaaccttgaatacgcgctatttgctcgtcggcgatgatttccgtttcggggcggggcgggaaggctgttttgaacttttggcacaacagcccgatatgcagaccgagcgcacgccttctgtcattgtcgaagacatccgcaccagcagtaccgccgtccgccaagccctttcagacggcaaccttgcctatgcgaaaaaacttttggggcacgactacgttttggggggcagggtggtgcacggcagaaaactcgggcgcaccttaaacgccccgaccgccaacatccgactgcccggccaccgttatgcactcggcggcgtgttcgtcgtcgaggcggacggcgcattcggcacgcggcgcggcgtggcgagcttcggcttcaatcccaccgttgatggcggctgttctcaaaagctggaagtccatttgttcgactttcaaggcgatttgtacggacaacggttgaacgtccgcttcctgcacaaactgcgcgacgaggaaaagtttgacggtatggaagaactgaaaaggcggattgaagccgatatggaagccgcaaagtgttgg

SEQ ID NO: 1760 - protein, 319 aa, Neisseria gonorrhoeae
MSEWRGFNRKGNTMKIRPGRHNAPDFPHGAAVTIGNFDGVHLGHKHILQKLRLEADARGLPVVAVVFEPQPKEFFALRTGKTPPCRISPLRTKLELLEGTGCVDAAWVLRFDRNFSEISAQAFIDRLLRQTLNTRYLLVGDDFRFGAGREGCFELLAQQPDMQTERTPSVIVEDIRTSSTAVRQALSDGNLAYAKKLLGHDYVLGGRVVHGRKLGRTLNAPTANIRLPGHRYALGGVFVVEADGAFGTRRGVASFGFNPTVDGGCSQKLEVHLFDFQGDLYGQRLNVRFLHKLRDEEKFDGMEELKRRIEADMEAAKCW

SEQ ID NO: 1761 - DNA, 867 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacac

SEQ ID NO: 1762 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 1763 - DNA, 396 bp, Neisseria gonorrhoeae
ggctttacgcttgaaaaacagcctgtccagcgaccatgctccgccgcccgctgccgcgatatagagaaatacgaagcagaacagcactgcggactcgccgccgttggcaatcgggaacaaagcatttccggaagcgtgcgccataaaataggcaaccgccatctggccggacaaaacaaacgcggcagggcgcgcaaacaggcccaacaccagcaaaatgccgccgacaatttctaaaataccggcaagcagcaacagcccgccgggcgaaccgctgcccatttcaatggggaaggcgaagattttcgacgtaccgtgcaacaaaaacaggtaggcggttacgatacgcaaaacagaaagcaaaacaggttggatacggttgcagcaatcggacat

SEQ ID NO: 1764 - protein, 78 aa, Neisseria gonorrhoeae
GFTLEKQPVQRPCSAARCRDIEKYEAEQHCGLAAVGNREQSISGSVRHKIGNRHLAGQNKRGRARKQAQHQQNAADNF

SEQ ID NO: 1765 - DNA, 111 bp, Neisseria gonorrhoeae
ttgggctacaatcagccttttaactgttcagacggcataggggtttcccgttgtgaaatactgtttgaggggcaatgccgtctgaaaccgaaatattgtaacaatagagat

SEQ ID NO: 1766 - protein, 37 aa, Neisseria gonorrhoeae
LGYNQPFNCSDGIGVSRCEILFEGQCRLKPKYCNNRD

SEQ ID NO: 1767 - DNA, 864 bp, Neisseria gonorrhoeae
ttgatacaccacgtccgcgccggcagacacggcctggctcgcaggcagagtccaaggcgtggtcgtccaaatgacggcaaacgctttgccttcgatacctgccaagccgaatgcggcggcaagcgcgacggtgtttttaaacggataggcaacgtcaatcgcaggcgatactttgtctttgtattccacttccgcttccgccagcgaagagccgcaatccaagcagaattgaaccggtttcgcgccccggtagagatagccggatttgtagatttcgccgagcatacgcacggtatcggcttcggttttgaaatccatggtcaagtaaggattgtcccagtcgcccaacacgcccaagcggataaagtcttttttctgacgggcaatctgttcggcggcatattcgcggcacaattcgcggaaacgggctttaggcatatctttgccgtgcagtttttccaccatcacttcgatgggcaggccgtggcagtcccaacccggtacataaggcgcgtcaaaaccggcttgggttttgctgcggataataatgtctttaagaattttattgacggcatgaccgatatggatgtcgccgttggcatacggcgggccgtcgtgcagaatgaatttcggacggcctttggcgatttcgcgcagtttttggtaacgtttttgctcgtaccagcttttcagccacgcaggctcgcgcttggcaagattgccgcgcatcggaaacgggctttcgagcaggttgacggttttactgtaatcggtcattttttaatctctattgttacaatatttcggtttcagacggcattgcccctcaaacagtatttcacaacgggaaacccctatgccgtc

SEQ ID NO: 1768 - protein, 288 aa, Neisseria gonorrhoeae
LIHHVRAGRHGLARRQSPRRGRPNDGKRFAFDTCQAECGGKRDGVFKRIGNVNRRRYFVFVFHFRFRQRRAAIQAELNRFRAPVEIAGFVDFAEHTHGIGFGFEIHGQVRIVPVAQHAQADKVFFLTGNLFGGIFAAQFAETGFRHIFAVQFFHHHFDGQAVAVPTRYIRRVKTGLGFAADNNVFKNFIDGMTDMDVAVGIRRAVVQNEFRTAFGDFAQFLVTFLLVPAFQPRRLALGKIAAHRKRAFEQVDGFTVIGHFLISIVTIFRFQTALPLKQYFTTGNPYAV

SEQ ID NO: 1769 - DNA, 909 bp, Neisseria gonorrhoeae
atgaccgattacagtaaaaccgtcaacctgctcgaaagcccgtttccgatgcgcggcaatcttgccaagcgcgagcctgcgtggctgaaaagctggtacgagcaaaaacgttaccaaaaactgcgcgaaatcgccaaaggccgtccgaaattcattctgcacgacggcccgccgtatgccaacggcgacatccatatcggtcatgccgtcaataaaattcttaaagacattattatccgcagcaaaacccaagccggttttgacgcgccttatgtaccgggttgggactgccacggcctgcccatcgaagtgatggtggaaaaactgcacggcaaagatatgcctaaagcccgtttccgcgaattgtgccgcgaatatgccgccgaacagattgcccgtcagaaaaaagactttatccgcttgggcgtgttgggcgactgggacaatccttacttgaccatggatttcaaaaccgaagccgataccgtgcgtatgctcggcgaaatctacaaatccggctatctctaccggggcgcgaaaccggttcaattctgcttggattgcggctcttcgctggcggaagcggaagtggaatacaaagacaaagtatcgcctgcgattgacgttgcctatccgtttaaaaacaccgtcgcgcttgccgccgcattcggcttggcaggtatcgaaggcaaagcgtttgccgtcatttggacgaccacgccttggactctgcctgcgagccaggccgtgtctgccggcgcggacgtggtgtatcaattaatcgatacgcccaaaggcaaattggtgctggcgaaagatttggcggaaggcgctttgaaacgctacggcttttcagacggcatcgccatccttgccgaaaccaccggcgacaagctggaaaactgcaca

SEQ ID NO: 1770 - protein, 303 aa, Neisseria gonorrhoeae
MTDYSKTVNLLESPFPMRGNLAKREPAWLKSWYEQKRYQKLREIAKGRPKFILHDGPPYANGDIHIGHAVNKILKDIIIRSKTQAGFDAPYVPGWDCHGLPIEVMVEKLHGKDMPKARFRELCREYAAEQIARQKKDFIRLGVLGDWDNPYLTMDFKTEADTVRMLGEIYKSGYLYRGAKPVQFCLDCGSSLAEAEVEYKDKVSPAIDVAYPFKNTVALAAAFGLAGIEGKAFAVIWTTTPWTLPASQAVSAGADVVYQLIDTPKGKLVLAKDLAEGALKRYGFSDGIAILAETTGDKLENCT

SEQ ID NO: 1771 - DNA, 1878 bp, Neisseria gonorrhoeae
atgaatcatccgttcctcgaacgcgatattcccatgctcaacggcgaacacgttaccaccgatgccggtaccggcttggtgcatactgcgcctgcgcacggtttggaagactacgccgtctgcaataaatacggcatcgagctttacaaccctgtcaacgccgaaggcaaatacataagcgaaacgcctcgtgtcgcaggcatgagcgtttgggaggcgaatcccgtcatcctgcaatggccggaagaaaccggcaacctcttggcaagcagcaaaatcgaacacagctacgcccactgctggcgccacaaaaccccgctgatttaccgagcgacaggtcagtggtttgtcggcatggacaaagccggcagcgacggtaaaaccctgcgcgacaaagccatcaaagccgtggacgacaccgaattcttcccgccatggggtcgtgcgcgtttggaatccatgattgaaggccgtcctgactgggtggtttcacgccaacgctattggggcacgccgatgactttctttgttcacaaagaaacgggcgagctgcatccgaactctgccgaacttttggaaaaagtcgcgcaacgcatcgaagaaaaaggcatcgaggcttggttctccctcgataaaagcgaattattaagcgcggaagattgcgaacattacgacaaactccccgataccatggacgtatggttcgactcaggctcgacgcattattccgttgtaaaacaacgcgaagaattggaatggccggctgacttgtacctcgaaggcagcgaccaacaccgcggctggttccaatcctctatgctgaccggttgcgcctcatccatgggacgcgcaccgtataaacagctgctgacccacggtttcgtggttgaccaaaacggccgcaaaatgtcgaaatccatcggcaacgtcgtcgcgccgcaggaagtctataacgaattcggcgcggacatcctgcgcctgtgggcggcatccaccgattacagcggcgaattggcgatttccaaagaaatcctcaaacgcgttaccgaaagctaccgccgcatccgcaataccttgagcttcctgtttgccaatttgagcgactttaatccgattgaagatgccgtgcaacaggcggatatggtggaaatcgaccgctacgccttggtattggcgcggcggctgcaagagcgtttggcaggcggttactatccgcgctatgccttccacttcgccgtgaaagacattgtttctttctgctcggaagacttgggcgcgttctacctcgacatcctgaaagaccgcctctacaccaccaaagccgacagccgcgcccgccgcagcgcgcaaaccgccctgtaccacatcacgcgcagcctggttctcttgattgcaccgattttgtgcttcaccggcgaagaagcgtgggacatcatcggcggcggcgaagaagacagcgtcctcttccatacttggcacgagttcccggccatcaacgaaaaagccgaagccgaactggtgaaaaaatggacggcaatccgcgaagcgcgcgaagcagtaaccgccgccatcgagcctttgcgcgccgacaaaaccgtcggttcgtccttgcaggcggaagccgaaattaccgcgccggaagaaatggccggctatctgaatgctttgggcgaagaattgcgctttgccctgctggtgtctaaagcagaagtgaaagtcggtgatgaacttgccgttgccgccaaagccagcgacggcgaaaaatgcgaacgctgctggcattacacccgcgatgtgggcgcggttgcaggttatgaaaccgtctgcaaacgctgtgcggagaatgtcggcggagaaggcgaaacgcgccattacgcc

SEQ ID NO: 1772 - protein, 626 aa, Neisseria gonorrhoeae
MNHPFLERDIPMLNGEHVTTDAGTGLVHTAPAHGLEDYAVCNKYGIELYNPVNAEGKYISETPRVAGMSVWEANPVILQWPEETGNLLASSKIEHSYAHCWRHKTPLIYRATGQWFVGMDKAGSDGKTLRDKAIKAVDDTEFFPPWGRARLESMIEGRPDWVVSRQRYWGTPMTFFVHKETGELHPNSAELLEKVAQRIEEKGIEAWFSLDKSELLSAEDCEHYDKLPDTMDVWFDSGSTHYSVVKQREELEWPADLYLEGSDQHRGWFQSSMLTGCASSMGRAPYKQLLTHGFVVDQNGRKMSKSIGNVVAPQEVYNEFGADILRLWAASTDYSGELAISKEILKRVTESYRRIRNTLSFLFANLSDFNPIEDAVQQADMVEIDRYALVLARRLQERLAGGYYPRYAFHFAVKDIVSFCSEDLGAFYLDILKDRLYTTKADSRARRSAQTALYHITRSLVLLIAPILCFTGEEAWDIIGGGEEDSVLFHTWHEFPAINEKAEAELVKKWTAIREAREAVTAAIEPLRADKTVGSSLQAEAEITAPEEMAGYLNALGEELRFALLVSKAEVKVGDELAVAAKASDGEKCERCWHYTRDVGAVAGYETVCKRCAENVGGEGETRHYA

SEQ ID NO: 1773 - DNA, 237 bp, Neisseria gonorrhoeae
gtgggaatgacggttcggttgctacggcccgctgattccccgacaccgatgccgtctgaaccttcagacggcatttttgatgcgctcgccgtttacaggcgcggggcgggcgcagtaaaatacccgaaccgtcatccccgacaacaccgtaatctcgaaacccgtcattcccgcgcaggcgggaatctagatctgtcagtgcaggaacttatcgggcaaaacggtttcttgagattt

SEQ ID NO: 1774 - protein, 79 aa, Neisseria gonorrhoeae
VGMTVRLLRPADSPTPMPSEPSDGIFDALAVYRRGAGAVKYPNRHPRQHRNLETRHSRAGGNLDLSVQELIGQNGFLRF

SEQ ID NO: 1775 - DNA, 168 bp, Neisseria gonorrhoeae
atgccgtctgaaccttcagacggcatttttgatgcacctgccgtttacaggcgcggggcgggcgcggggaaatacccgaaccgtcattcccgacaataccgcaatctcgaaacccgtcattcccgcgcaggcggaaatccggacctgtccgcacggaaacttatcgga

SEQ ID NO: 1776 - protein, 56 aa, Neisseria gonorrhoeae
MPSEPSDGIFDAPAVYRRGAGAGKYPNRHSRQYRNLETRHSRAGGNPDLSARKLIG

SEQ ID NO: 1777 - DNA, 795 bp, Neisseria gonorrhoeae
atgaatccagcccgcaaaaaaccttctcttctcttctcttctcttctcttctcttctcttctcttctcttcggcagcgcaggcggcaagtgaaggcaatggccgcggcccgtatgtgcaggcggatttagcctacgccgccgaacgcattacccacgattatccggaaccaaccgctccaggcaaaaacaaaataagcacggtaagcgattatttcagaaacatccgtacgcattccatccaccccagggtgtcggtcggctacgacttcggcggctggaggatagcggcagattatgcccgttacagaaagtggaacgacaataaatattccgtcgacataaaagagttggaaaacaagaatcagaataagagagacctgaagacggaaaatcaggaaaacggcagcttccacgccgtttcttctctcggcttatcagccgtttacgatttcaaactcaacgacaaattcaaaccctatatcggtgcgcgcgtcgcctacggacacgtcagacacagcatcgattcgactaaaaaaataacaggtactcttaccgcctaccctagtgatgctgacgcagcagttacggtttatcctgacggacatccgcaaaaaaacacctatcaaaaaagcaacagcagccgccgcttgggcttcggcgcgatggcgggcgtgggcatagacgtcgcgcccggcctgaccttggacgccggctaccgctaccacaactggggacgcttggaaaacacccgcttcaaaacccacgaagcctcattgggcatgcgctaccgcttc

SEQ ID NO: 1778 - protein, 265 aa, Neisseria gonorrhoeae
MNPARKKPSLLFSSLLFSSLLFSSAAQAASEGNGRGPYVQADLAYAAERITHDYPEPTAPGKNKISTVSDYFRNIRTHSIHPRVSVGYDFGGWRIAADYARYRKWNDNKYSVDIKELENKNQNKRDLKTENQENGSFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 1779 - DNA, 105 bp, Neisseria gonorrhoeae
atgaatcgtcattcccgcgcaggcgggaatccggtccgttcggtttcagttatttccgataaattcctgctgctttttatttctagattcccacttccgtgggaa

SEQ ID NO: 1780 - protein, 35 aa, Neisseria gonorrhoeae
MNRHSRAGGNPVRSVSVISDKFLLLFISRFPLPWE

SEQ ID NO: 1781 - DNA, 234 bp, Neisseria gonorrhoeae
ttgatggaaatggcgggccgaagcacaccctacggcccgccggatttccgcctgcgcgggaatgacggggtttcaggttgctgtttcaggtttctgtttttaagtttctgtttcggtttgctattttatagaaatgacgaaattttagattgcaagaacttatcccctccgccgtcattcccacggaagtgggaatctagaaataaaaagcagcaggaatttatcggaaataac

SEQ ID NO: 1782 - protein, 78 aa, Neisseria gonorrhoeae
LMEMAGRSTPYGPPDFRLRGNDGVSGCCFRFLFLSFCFGLLFYRNDEILDCKNLSPPPSFPRKWESRNKKQQEFIGNN

SEQ ID NO: 1783 - DNA, 1176 bp, Neisseria gonorrhoeae
atgaaacgccaagcattagccgcaatgattgcttccttattcgcattggccgcctgcggcggcgaacctgccgcgcaagcccctgccgaaacccctgccgcttccgcagaagccgcaagttccgccgcacaagctaccgccgaaacgcctgcaggcgaactgcccgtcatcgatgcggtgaccacccacgctcccgaagtacctcccgcaatcgaccgcgactatcctgccaaagtacgcgtaaaaatggaaaccgtcgaaaaaaccatgaaaatggacgacggggtggaataccgctactggacatttgacggcgacgttccgggccgtatgatccgcgtacgcgaaggcgatacggttgaagtcgaattctccaacaatccttcttctaccgttccgcacaacgtcgacttccacgccgcaaccggtcagggcggcggtgcagccgcgacctttaccgccccgggccgcacttccacattcagcttcaaagccctgcaaccgggcctgtacatctaccactgcgccgtcgcgccggtcggtatgcacatcgccaacggtatgtacggtctgattttggtcgagcctaaagaaggcctgccgaaagtggataaagagttctacatcgtccaaggcgacttctacaccaaaggcaaaaaaggcgcgcaaggcctgcaaccgttcgatatggacaaagccgttgccgaacagcctgaatacgtcgtattcaacggccacgtaggcgctatcgccggcgataacgccctgaaagccaaagcaggcgaaaccgtgcgtatgtacgtcggtaacggcggcccgaacttggtgtcttccttccacgtcatcggcgaaatcttcgacaaagtttatgttgaaggcggcaaactgattaacgaaaacgtacaaagcaccatcgtgcctgccggcggttctgccatcgtcgaattcaaagtcgacatcccgggcaactacactttggtcgaccactccatcttccgcgcattcaacaaaggcgcgttggggcaattgaaagtagagggtgcggaaaaccctgaaatcatgactcaaaaattgagtgataccgcttacgccggcagcggcgcggcttctgcccctgctgcttccgcaccggctgcttctgccccggcagcctctgcatccgaaaaaagcgtttat

SEQ ID NO: 1784 - protein, 392 aa, Neisseria gonorrhoeae
MKRQALAAMIASLFALAACGGEPAAQAPAETPAASAEAASSAAQATAETPAGELPVIDAVTTHAPEVPPAIDRDYPAKVRVKMETVEKTMKMDDGVEYRYWTFDGDVPGRMIRVREGDTVEVEFSNNPSSTVPHNVDFHAATGQGGGAAATFTAPGRTSTFSFKALQPGLYIYHCAVAPVGMHIANGMYGLILVEPKEGLPKVDKEFYIVQGDFYTKGKKGAQGLQPFDMDKAVAEQPEYVVFNGHVGAIAGDNALKAKAGETVRMYVGNGGPNLVSSFHVIGEIFDKVYVEGGKLINENVQSTIVPAGGSAIVEFKVDIPGNYTLVDHSIFRAFNKGALGQLKVEGAENPEIMTQKLSDTAYAGSGAASAPAASAPAASAPAASASEKSVY

SEQ ID NO: 1785 - DNA, 483 bp, Neisseria gonorrhoeae
atgcttgcacatcttcaattaaccttccggcaccgggcaggcgttacaccctatacgtccactttcgtgttggcaagagtgctcgtgtttttaataaacaagtcgcagccacctattctctgcgaccctccggggcttacggagcaagtccttaaccttagagggcataccttctcccgaagttacggtatcaatttgccgagttccttctcccgagttctctcaagcgccttagaattctcatcctgcccacctgtgtcggtttgcggtacggttcgattcaaactgaagcttagtggcttttcctggaagcgtggtatcggttgcttcgtgtccgtaaacactcgtcatcacttcttcggtgttaagaaaacccggatttgcctaagtcttccacctaccggcttaaacaagctattccaacagcttgccaacctaaccttctccgtccccacatcgcatttgaatcaagtacaggaatat

SEQ ID NO: 1786 - protein, 161 aa, Neisseria gonorrhoeae
MLAHLQLTFRHRAGVTPYTSTFVLARVLVFLINKSQPPILCDPPGLTEQVLNLRGHTFSRSYGINLPSSFSRVLSSALEFSSCPPVSVCGTVRFKLKLSGFSWKRGIGCFVSVNTRHHFFGVKKTRICLSLPPTGLNKLFQQLANLTFSVPTSHLNQVQEY

SEQ ID NO: 1787 - DNA, 810 bp, Neisseria gonorrhoeae
atgtcgggtttgacgaaactcgaagcccccgcatacggctgcatcgcggtcaaaccgcgccggggcggcggacacgtgttcttcgttgtcggcaaagacgcggaaggcagaatcttgggcttgggcggcaatcagggcaatatggtatccatcatcccgtttgaccctgcggacattgacggctacttctggccgtccaagctgattggcggcaaagccgtgccttcgtcccccgccgaagggcgttaccggttgtcggacgttgccgccacggcgaaacagggcgcgggcgaggcgtaaatgattggggctttgctgaaaaattggaagccgctgcttattttgtccgcaatcgcgttcttcgccgtttcttggcagctggacagggcggcgcaataccgtcgcggatacggtgcggcggtgtcggaggtttcggaacgcctcaaagccgccgcggtcgaacacgccgaacacgcccgcaaatcgtccgccgcgtatcaggcgcaaaaggcggcgcgcgaggaaaaagaaagggtgcgctatgtgcaaacgcttaaaatcattgaaaaacctgtgtaccgcaatgcctgttttgatgctgacggcgtgcgcgaactcaacgccgccgttgacgacggcggttaagccgcccgccgatttggtgcggccctgcccgaaactgccgcaccttgaagggaacacgggcgcggacgtgctgccgtgggccctgaaggcggccggtatgtataacgactgcagggcgcggcacggcgcgctggtacgggcgttgggcgcggattgagttgtcaa

SEQ ID NO: 1788 - protein, 99 aa, Neisseria gonorrhoeae
MSGLTKLEAPAYGCIAVKPRRGGGHVFFVVGKDAEGRILGLGGNQGNMVSIIPFDPADIDGYFWPSKLIGGKAVPSSPAEGRYRLSDVAATAKQGAGEA

SEQ ID NO: 1789 - DNA, 126 bp, Neisseria gonorrhoeae
atgtctaccgttttcatcgaatccatcgaatccgccttttcgaccacccggccctacgcaaccgaaccgtcattcccacggaagtgggaatctaggacgcggggtttgggcaaccgttttatccga

SEQ ID NO: 1790 - protein, 42 aa, Neisseria gonorrhoeae
MSTVFIESIESAFSTTRPYATEPSFPRKWESRTRGLGNRFIR

SEQ ID NO: 1791 - DNA, 789 bp, Neisseria gonorrhoeae
gtgcttcggcccgccatttccatcaatccaacatgtctaccgttttcatcgaatccatcgaatccgccttttcgaccacccggccctacgcaaccgaaccgtcattcccacggaagtgggaatctaggacgcggggtttgggcaaccgttttatccgataagtttccgtgcggacgggtccggattcccgcctgcgcgggaatgacgggtttcaagattacggcatttgccgtttcgggtacaggaaaggggggttttcgggtagaatggcactcttttatccggctgttgaaaaatatgtcttcatctgtttcaagtaaaacgcgctattgggtattggcacttgccgccatcgtgctggaccagtggtcgaagtgggcggtgctgtcgtcgtttcagtatcgggaacgcgtcaacgtcatcccttcgtttttcgatctgacgctggtgtacaatccgggcgcggcattcagcttccttgccgatcagggcggctggcagaaatacttttttttggtgctggcggtggcggtgagcgcgtatttggtacgcgccatcttgcgcgacgagtttgcagccctcggcaaaatcggggcggcaatgattatcggcggtgcgtcgggcaatgtcatcgatcgcctgatacacggtcatgtcgtcgatttcttattgttttattggcaaaattggttttatcccgcctttaatattgccgacagctttatctgcgtcggtgcggtgttggcggtgcttgacaatatcgtccatcgcaaagatagcaaaaaaacg

SEQ ID NO: 1792 - protein, 263 aa, Neisseria gonorrhoeae
VLRPAISINPTCLPFSSNPSNPPFRPPGPTQPNRHSHGSGNLGRGVWATVLSDKFPCGRVRIPACAGMTGFKITAFAVSGTGKGGFRVEWHSFIRLLKNMSSSVSSKTRYWVLALAAIVLDQWSKWAVLSSFQYRERVNVIPSFFDLTLVYNPGAAFSFLADQGGWQKYFFLVLAVAVSAYLVRAILRDEFAALGKIGAAMIIGGASGNVIDRLIHGHVVDFLLFYWQNWFYPAFNIADSFICVGAVLAVLDNIVHRKDSKKT

SEQ ID NO: 1793 - DNA, 966 bp, Neisseria gonorrhoeae
atgaacggaaaaaccatcatccttgccaatccgcgcggcttctgcgccggtgtggatcgggcaatcagtattgtcgaacgtgctttggaagaattcggcgcgccggtttatgtgcgccacgaagtcgtccacaacaaattcgtcgtggacaacctgcgcgaaaaaggcgcggtgtttatcgaagacttggcggaagtgccgccgggcgcgacactggtttattcggcacacggcgtatcgaaggcggtgcagcaggaagcggcggagcgcggtttccgggtatttgatgcgacttgcccgctggtgacgaaagtgcataaggaagtcgcccgactggatgcccaagactgtgaaatcatcatgatcgggcataaggggcacgccgaggtcgaaggcacgatggggcagcttgcaccgggcaaaatgcttttggtcgaaacggtcggagatgtggcaaaactcgaagtcagaaaccccgacaaactcgcctatgtcagccaaaccacgctctcggtcgatgaaaccaaagacatcatcgccgcgctgaacgcgcgtttccccaatatccgcaatccgcacaaggaagacatctgctatgcgacgaccaaccggcaaaccgccgtcaaagagctggcggaacagtgcgacatcgtgattgtggtcggttcgcccaattcgtccaacagcaaccgcctgcgcgaagtggcggcatcgcgcggaatcgatgcgtatatggtggacaacgcgtcctacctgcaacgcacgtggtttgaaggcaaaagcaaagtcggcgtaacggcaggcgcgtccgcgcccgaagtgttggtgcgggaagtattggcaaccatacgcggatgggggcatgaaaccgtgcgcgaaggggggggcgcggaagaaagcatcgtgttcgtcctgcccaaggagctgcgccgcgagggcgaaaccaaacccgatttgtgcaaacgt

SEQ ID NO: 1794 - protein, 322 aa, Neisseria gonorrhoeae
MNGKTIILANPRGFCAGVDRAISIVERALEEFGAPVYVRHEVVHNKFVVDNLREKGAVFIEDLAEVPPGATLVYSAHGVSKAVQQEAAERGFRVFDATCPLVTKVHKEVARLDAQDCEIIMIGHKGHAEVEGTMGQLAPGKMLLVETVGDVAKLEVRNPDKLAYVSQTTLSVDETKDIIAALNARFPNIRNPHKEDICYATTNRQTAVKELAEQCDIVIVVGSPNSSNSNRLREVAASRGIDAYMVDNASYLQRTWFEGKSKVGVTAGASAPEVLVREVLATIRGWGHETVREGGGAEESIVFVLPKELRREGETKPDLCKR

SEQ ID NO: 1795 - DNA, 1134 bp, Neisseria gonorrhoeae
gtgttgcccaaacatccgatgcctgcgttaacgcctgcgtcaacgtttgcacaaatcgggtttggtttcgccctcgcggcgcagctccttgggcaggacgaacacgatgctttcttccgcgccccccccttcgcgcacggtttcatgcccccatccgcgtatggttgccaatacttcccgcaccaacacttcgggcgcggacgcgcctgccgttacgccgactttgcttttgccttcaaaccacgtgcgttgcaggtaggacgcgttgtccaccatatacgcatcgattccgcgcgatgccgccacttcgcgcaggcggttgctgttggacgaattgggcgaaccgaccacaatcacgatgtcgcactgttccgccagctctttgacggcggtttgccggttggtcgtcgcatagcagatgtcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggtgcaagctgccccatcgtgccttcgacctcggcgtgccccttatgcccgatcatgatgatttcacagtcttgggcatccagtcgggcgacttccttatgcactttcgtcaccagcgggcaagtcgcatcaaatacccggaaaccgcgctccgccgcttcctgctgcaccgccttcgatacgccgtgtgccgaataaaccagtgtcgcgcccggcggcacttccgccaagtcttcgataaacaccgcgcctttttcgcgcaggttgtccacgacgaatttgttgtggacgacttcgtggcgcacataaaccggcgcgccgaattcttccaaagcacgttcgacaatactgattgcccgatccacaccggcgcagaagccgcgcggattggcaaggatgatggtttttccgttcataagttttgcattccgtgttcagacggcattcacgtttttttgctatctttgcgatggacgatattgtcaagcaccgccaacaccgcaccgacgcagataaagctgtcggcaatattaaaggcggga

SEQ ID NO: 1796 - protein, 378 aa, Neisseria gonorrhoeae
VLPKHPMPALTPASTFAQIGFGFALAAQLLGQDEHDAFFRAPPFAHGFMPPSAYGCQYFPHQHFGRGRACRYADFAFAFKPRALQVGRVVHHIRIDSARCRHFAQAVAVGRIGRTDHNHDVALFRQLFDGGLPVGRRIADVFLVRIADIGETRVQRGDDVFGFIDRERGLADIGEFVGVSDFEFCHISDRFDQKHFARCKLPHRAFDLGVPLMPDHDDFTVLGIQSGDFLMHFRHQRASRIKYPETALRRFLLHRLRYAVCRINQCRARRHFRQVFDKHRAFFAQVVHDEFVVDDFVAHINRRAEFFQSTFDNTDCPIHTGAEAARIGKDDGFSVHKFCIPCSDGIHVFLLSLRWTILSSTANTAPTQIKLSAILKAG

SEQ ID NO: 1797 - DNA, 447 bp, Neisseria gonorrhoeae
atgagcaccttcttccggcaaaccgcacaagccatgactgccaaacacatcggccgcttcccgctatcggagttggaccaggtgattgattggcagccgatcgaacaatacctgatccgtcaaaaaacccgttacctccgagaccgccgcggccgtcccgcccatcccctgtcgtccatgttcaaagccgtcctgcccggacaatggcacagcctctccgatcccgaactcgaacacagcctcatcacccgcatcggtttcaacctgttttgccgttttgacgaaccgggcatccccggttgcagcaccttatgccgctaccgtaaattccgctatgcgcgggcagcctatttcgggctgctcaaagtgggtgcgcaaagccacctgaaggcgatgtgtttgaacctgttgaaagccgccaacaggctaagtgcgcccgctgccgcc

SEQ ID NO: 1798 - protein, 149 aa, Neisseria gonorrhoeae
MSTFFRQTAQAMTAKHIGRFPLSELDQVIDWQPIEQYLIRQKTRYLRDRRGRPAHPLSSMFKAVLPGQWHSLSDPELEHSLITRIGFNLFCRFDEPGIPGCSTLCRYRKFRYARAAYFGLLKVGAQSHLKAMCLNLLKAANRLSAPAAA

SEQ ID NO: 1799 - DNA, 657 bp, Neisseria gonorrhoeae
atgaccccgcccaaactcatcatcttcgactgggacggcacgcttgccgatacgacccagcccatcatcgacaccatgcgccgcagcttcgccgaatgcggttttccgccgcccgaagcggagcgcgtccgcagcctgatcggatacagcctgcccgaaatcatccgcgccctgctcgaaatgccttctgaagctgccgttgccgacatcgcgcgcacttattccgcgcattacctcaatcccaacaaccgcaatatgacactctttcccgatgccccgccctgtctggacaagctcaaagcgcaaggcttccggcttgccgtcgccacgggcaaagggcgggcgggtttggacaacgccatcagccaaaccgccaccggcggctattggctcgccaccgcctgcgcgggggaatacccctccaaaccctcgcccgaaatggtattcggactctgcggcgaactgggactcgacccgaaagaggcattggttgtcggcgatacggcgcacgacctgcatatggcggcaaacgcaggcgcggcggcagtcggcgttgccaccggcgcacattcgcgcgaacagctccttggcgcaccgcatctcgccgtattggacggtttgtccgaactgcccggttttcttgcacgacattacgcc

SEQ ID NO: 1800 - protein, 219 aa, Neisseria gonorrhoeae
MTPPKLIIFDWDGTLADTTQPIIDTMRRSFAECGFPPPEAERVRSLIGYSLPEIIRALLEMPSEAAVADIARTYSAHYLNPNNRNMTLFPDAPPCLDKLKAQGFRLAVATGKGRAGLDNAISQTATGGYWLATACAGEYPSKPSPEMVFGLCGELGLDPKEALVVGDTAHDLHMAANAGAAAVGVATGAHSREQLLGAPHLAVLDGLSELPGFLARHYA

SEQ ID NO: 1801 - DNA, 429 bp, Neisseria gonorrhoeae
atgaaccgactcgaccaacttggaatccgtatcaacctgatttgcaatgtctttgacaaatggatcgggcagcaggatttgaattacaacctctttaccgtactttataccctggcaaccgaaggcagccgcacgcaaaagcacatcggagaagagtggagtctgcccaaacagaccgtttcaggcgtatgcaaaacccttgccggacaagggttgattgaatggcaggaaggcgaacaggacaggcgcgaacggttgctgtcgctgaccgaaaaaggcaaagtccatgccgcacctttaacagaaaacgcgcaggaattcagcgacaaagtattttccacattcggcgacaagcgcacaacccggctgtttgccgatttggatgcactggcggaagtgatggaaaaaacaatctcggaaaataaaaaa

SEQ ID NO: 1802 - protein, 143 aa, Neisseria gonorrhoeae
MNRLDQLGIRINLICNVFDKWIGQQDLNYNLFTVLYTLATEGSRTQKHIGEEWSLPKQTVSGVCKTLAGQGLIEWQEGEQDRRERLLSLTEKGKVHAAPLTENAQEFSDKVFSTFGDKRTTRLFADLDALAEVMEKTISENKK

SEQ ID NO: 1803 - DNA, 1476 bp, Neisseria gonorrhoeae
atgaaatacaaagacctgcgcgacttcatcgctatgctcgagcagcagggcaagctcaagcgcgtcgcccaccccgtttccccgcatttggaaatgaccgaaattgccgaccgcgtgttgcgcgccgaagggccggcgttgttgtttgaaaacccggttaagcccgacggtacgcgctatgattatcccgtgttggcgaacctgttcggcacccccgaacgtgtggcgatgggcatgggcgcggacagcgtgtccaagctgcgcgaaatcgggcagacgctggcgtatttgaaagaacccgaaccgcccaaaggcatcaaagacgcgttttccaaactgccgctgttgaaagatatttggagcatggcgccgaacgtggtgaaaaacgcgccgtgtcaggaaatcgtgtgggaaggagaagacgttgatttgtatcagcttccgattcaacattgctggccggaagacgttgcgccgctggtaacgtggggcttgaccgtcacgcgcgggccgcacaaaaaacgccaaaatctcggcatttaccgtcaacaactcatcggcaaaaacaagctggttatgcgctggctgtcgcatcgcggcggcgcgttggattatcaggaattccgcaaactcaatcccgatacgccgtatcccgtcgccgtcgtactcggttgcgacccctccaccattttgggcgcggtaacgcccgttcccgatactttgagcgaataccagtttgccggactgctgcgcggttcgcggacggagctggtgaaatgtatcggcagcgatttgcaagtgcctgcccgtgctgaaattgtattggaaggcgtgattcatccaaacgaaaccgcgttggaaggcccatacggcgaccacacgggctattacaacgagcagggccatttccctgtgtttacggtcgaacgcatcaccatgcgcgaaaacccgatttaccactctacctacacaggcaaaccgcccgacgaacctgccgttttgggcgtggcgttgaacgaagtgttcgtaccgcttttgcaaaagcagttctccgaaatcaccgatttctacctgccgcccgaaggctgttcctaccgcatggcggtggtcagcatgaaaaaacagtacgccggacacgccaagcgcgtgatgacgggctgctggtcgttcctgcgccagtttatgtacaccaaattcatcatcgtggtggatgacgatgtaaacgtgcgcgactggaaagaagtcatctgggcggtaaccacgcgcatggaccccgtccgcgacaccgttttggtggaaaacacgcccatcgactacctcgacttcgccagccccgtcagcggactcggcggcaaaatgggtttggatgcgaccagcaaatggccgggagaaaccgaccgcgaatggggacgggtaatcaaaaaagaccctgcggttacggttaaaattgatgggatttgggggaaattggggttg

SEQ ID NO: 1804 - protein, 492 aa, Neisseria gonorrhoeae
MKYKDLRDFIAMLEQQGKLKRVAHPVSPHLEMTEIADRVLRAEGPALLFENPVKPDGTRYDYPVLANLFGTPERVAMGMGADSVSKLREIGQTLAYLKEPEPPKGIKDAFSKLPLLKDIWSMAPNVVKNAPCQEIVWEGEDVDLYQLPIQHCWPEDVAPLVTWGLTVTRGPHKKRQNLGIYRQQLIGKNKLVMRWLSHRGGALDYQEFRKLNPDTPYPVAVVLGCDPSTILGAVTPVPDTLSEYQFAGLLRGSRTELVKCIGSDLQVPARAEIVLEGVIHPNETALEGPYGDHTGYYNEQGHFPVFTVERITMRENPIYHSTYTGKPPDEPAVLGVALNEVFVPLLQKQFSEITDFYLPPEGCSYRMAVVSMKKQYAGHAKRVMTGCWSFLRQFMYTKFIIVVDDDVNVRDWKEVIWAVTTRMDPVRDTVLVENTPIDYLDFASPVSGLGGKMGLDATSKWPGETDREWGRVIKKDPAVTVKIDGIWGKLGL

SEQ ID NO: 1805 - DNA, 840 bp, Neisseria gonorrhoeae
ttgggtttcggatgtcgaaggaagggcttttttgcaaaggcctcatgccgtctgaacaggcttcagacggcatttttgccgcgtgccggatgcggaaaccaatcaggcgtaatgtcgtgcaagaaaaccgggcagttcggacaaaccgtccaatacggcgagatgcggtgcgccaaggagctgttcgcgcgaatgtgcgccggtggcaacgccgactgccgccgcgcctgcgtttgccgccatatgcaggtcgtgcgccgtatcgccgacaaccaatgcctctttcgggtcgagtcccagttcgccgcagagtccgaataccatttcgggcgagggtttggaggggtattcccccgcgcaggcggtggcgagccaatagccgccggtggcggtttggctgatggcgttgtccaaacccgcccgccctttgcccgtggcgacggcaagccggaagccttgcgctttgagcttgtccagacagggcggggcatcgggaaagagtgtcatattgcggttgttgggattgaggtaatgcgcggaataagtgcgcgcgatgtcggcaacggcagcttcagaaggcatttcgagcagggcgcggatgatttcgggcaggctgtatccgatcaggctgcggacgcgctccgcttcgggcggcggaaaaccgcattcggcgaagctgcggcgcatggtgtcgatgatgggctgggtcgtatcggcaagcgtgccgtcccagtcgaagatgatgagtttgggcggggtcatggcaggttggttgcagtaaaaaagcagattttatgcggaaaacgcagacgtgtcgcattttcgacaaaatttgtcggc

SEQ ID NO: 1806 - protein, 280 aa, Neisseria gonorrhoeae
LGFGCRRKGFFAKASCRLNRLQTAFLPRAGCGNQSGVMSCKKTGQFGQTVQYGEMRCAKELFARMCAGGNADCRRACVCRHMQVVRRIADNQCLFRVESQFAAESEYHFGRGFGGVFPRAGGGEPIAAGGGLADGVVQTRPPFARGDGKPEALRFELVQTGRGIGKECHIAVVGIEVMRGISARDVGNGSFRRHFEQGADDFGQAVSDQAADALRFGRRKTAFGEAAAHGVDDGLGRIGKRAVPVEDDEFGRGHGRLVAVKKQILCGKRRRVAFSTKFVG

SEQ ID NO: 1807 - DNA, 264 bp, Neisseria gonorrhoeae
ttgtgctttattaaaatagaaccattatcatttatacagatgggacagtttatgtcagttttccgcatcaatatgaccgccgccacggttttggcagcactctcgtctccggtttttgccgcacaaacggcggatttggaaaccgtccatatcaaagggcagcgttcgtacaacgcgattgccaccgagaaaaacggcgattacagctcgttaaaggcagctatatggatgaccgcctcaatacccgcgtctccccctgccgcc

SEQ ID NO: 1808 - protein, 88 aa, Neisseria gonorrhoeae
LCFIKIEPLSFIQMGQFMSVFRINMTAATVLAALSSPVFAAQTADLETVHIKGQRSYNAIATEKNGDYSSLKAAIWMTASIPASPPAA

SEQ ID NO: 1809 - DNA, 120 bp, Neisseria gonorrhoeae
atggatgaccgcctcaatacccgcgtctccccctgccgcctgaaagacaaaaacgccgccgaacccgaacaaccgcaacacccgttacgccgcattgggcaaacgcgtgatggaaggcgt

SEQ ID NO: 1810 - protein, 40 aa, Neisseria gonorrhoeae
MDDRLNTRVSPCRLKDKNAAEPEQPQHPLRRIGQTRDGRR

SEQ ID NO: 1811 - DNA, 435 bp, Neisseria gonorrhoeae
ttgggcaaacgcgtgatggaaggcgttgagaccgaaatcagcggtgcgattacaccgaaatggcaaatccatgcaggttacagctatctgcacagccaaatcaaaaccgccgccaatccacgcgacgacggcatcttcctgctggtgcccaaacacagcgcaaacctgtggacgacttaccaagttacgcccgggctgaccgtcggcggcggcgtgaacgcgatgagcggcattacttcatctgcagggatgcatgcaggcggttatgccacgttcgatgcgatggcggcataccgcttcacgcccaagctgaagctgcaaatcaatgccgacaacatcttcaaccgccattactacgcccgcgtcggcggcacgaacacctttaacattcccggttcggagcgcagcctgacggcaaacctgcgttacagtttt

SEQ ID NO: 1812 - protein, 145 aa, Neisseria gonorrhoeae
LGKRVMEGVETEISGAITPKWQIHAGYSYLHSQIKTAANPRDDGIFLLVPKHSANLWTTYQVTPGLTVGGGVNAMSGITSSAGMHAGGYATFDAMAAYRFTPKLKLQINADNIFNRHYYARVGGTNTFNIPGSERSLTANLRYSF

SEQ ID NO: 1813 - DNA, 318 bp, Neisseria gonorrhoeae
atgcgctcacaaccggagtatggcattgcgaaggaaaacagaccgaaccggcaggcagaccgctttgccggttcggttttaccgcttgccgccagtctgacccacaagccgaacatcatgaaacccataccgaccgacacattccaacctgccatactgccccaagcctttgaaaccgaaatcaaatccacctgcacggggcgaatctatcggattcagacggcaacactcggcgaaatgcagtctgaaggctatcccgtcctctttgtcctcgacggcgaagcctttttcccgcgctgtacaacatcatgcagtcgc

SEQ ID NO: 1814 - protein, 106 aa, Neisseria gonorrhoeae
MRSQPEYGIAKENRPNRQADRFAGSVLPLAASLTHKPNIMKPIPTDTFQPAILPQAFETEIKSTCTGRIYRIQTATLGEMQSEGYPVLFVLDGEAFFPRCTTSCSR

SEQ ID NO: 1815 - DNA, 621 bp, Neisseria gonorrhoeae
atgcagtcgctgatgaacaaccccgttacccgaagcaacgccccctgcctgattgtcggtatcggctacacgacaggcagtgtgcgcgacctggcgcagcgtgccgccgactacacgccgccgcttggagacaacgccacagcagacgaacggcggcagttcggacaggcagaccgcttcgccgactttatcgacagcgaactgaccgcctttttagaaagccgctacacccttaaccgtaatgaaaccgccgtattcggacactcgttcggcgcactgttcggactctattccctgctttcccaccgctgtttcagacggcattggctcgtatccccctcgatttggtggcacaacaggcggatactcgactttatgccgtctgaaaaccggctggacggcatcgatgcctgcctcaacatcggcgcactcgagcggagcagcggttgcaaacgcagggaagaacgcgacatggcagggcaggccgaacaaatggcggcagagttggacaggcgcgggaccgccgtatttttccgggaatatccgaatgccgaccacggcaatgtcccgttttactcgctgaccgactgcgtcgaatatttgagggaagcgtggcaacgg

SEQ ID NO: 1816 - protein, 207 aa, Neisseria gonorrhoeae
MQSLMNNPVTRSNAPCLIVGIGYTTGSVRDLAQRAADYTPPLGDNATADERRQFGQADRFADFIDSELTAFLESRYTLNRNETAVFGHSFGALFGLYSLLSHRCFRRHWLVSPSIWWHNRRILDFMPSENRLDGIDACLNIGALERSSGCKRREERDMAGQAEQMAAELDRRGTAVFFREYPNADHGNVPFYSLTDCVEYLREAWQR

SEQ ID NO: 1817 - DNA, 816 bp, Neisseria gonorrhoeae
atggcaagcaaacacgtcagtcacttggaaaacaccgtccaagccaaactcctgcaccacaacagccgcaacctcagcctgaccgaagccggggaagaatactaccggcaatgcagttacgcgctcgacacgctcgacgatgccgcgcaaaaagccgccggggggacggaaaaaccgcaggggctgctgcgcgtaacgatgccgctgtggtttgccggcagccagatatgcaactggctggcggaataccgcgaacgttatcccgaagtggcgttggaactgattttggacaaccgccacgtcgatttgattgccgaaggcgtggatttggcgttgcgcgtttcccaaaccctttccccttcgctgattgcgcgcccgctggcggaaatcgaatttgccctgcttgcctcgcccgacttcctgaggcgcaacggcgtgccggaaacaccggaagaagtggcggggctgcctgccgtcctgccgacctacaccaaccagcagaaactcgacctcacccgcaaatcggacggcaagaaataccggcttgaactgacccccgtcatccgtaccgacaacacgctgatgatgcgcgaaatgattaaggcgggcgcgtgcatcggttatcagccgctttgggcggcggaacacgatttgcgctgcggcccgctggtgaggctgctgcccggatacgccgtcccgaccgaccggctgaacgccgtttatgcggacagggcatttttgagtgcgaaagtccgcagtttcatcgattttctgaacgaaaaaatcgccagcaggaaaggctgccgaaatgccgtc

SEQ ID NO: 1818 - protein, 272 aa, Neisseria gonorrhoeae
MASKHVSHLENTVQAKLLHHNSRNLSLTEAGEEYYRQCSYALDTLDDAAQKAAGGTEKPQGLLRVTMPLWFAGSQICNWLAEYRERYPEVALELILDNRHVDLIAEGVDLALRVSQTLSPSLIARPLAEIEFALLASPDFLRRNGVPETPEEVAGLPAVLPTYTNQQKLDLTRKSDGKKYRLELTPVIRTDNTLMMREMIKAGACIGYQPLWAAEHDLRCGPLVRLLPGYAVPTDRLNAVYADRAFLSAKVRSFIDFLNEKIASRKGCRNAV

SEQ ID NO: 1819 - DNA, 3432 bp, Neisseria gonorrhoeae
atgaccgagccgacctacatccccctgcgcctgcataccgaattctccattaccgacggtatggtgcggattaaaaaactgattgccaaagcgcaagaatacggtttgcctgctttgggcatcagcgatttgatgaacgaattcggtttggtgaaattctataaagcctgccgcggcgcagggattaagcccgtcggcgcggcggacgtgtggataggcaatccgaatgcgcccgacaagccgttccgcgccatgctggttatccgcaacgatgcgggttatctgcgcttgagcgagcttttgacggaggcttatgtcggccaagaccgcaatatccatcatgcggaactcaatcccgaatggctggaaaacggcgacaacagcggcttgatttgtttgagcggcgcgcattacggcgaagtgggcgtgaatctgttgaacggcaatgaagacgcggcgcgtgcggcggcgttgaaatatgcggcatggtttcccgatacgttttatttagagctgcaacgcctgcccgaacgccccgaatgggaggcttgcgtttccggcagcgtgaagctggcggaggaactgggtttgccggtggtagcaacgcatccgacacagtttatgaaccgcgacgatttcaacgcgcacgaggcgcgggtgtgcatcgcgggcggctgggtgctgacggacaagaaacgtccgcgcgatttcacgccgagccagtttttcattccgccggaaacgatgctggagcgtttcgccgacttgcccgaagccttggaaaacacggtggaaatcgccaaacgctgcaacttgcacatcacattgggcaaaaacttcctaccccttttccccacgcccgacggtttatcactcgatgactgtctcatcaaactctccaacgagggtttgcaggaacgcatggttcagctttatcccgacgaggcggaacgggcggcaaaaatgccggaatatcaggagcggctggactttgagctgaacatcatcatccaaatgaaattccccggctatttccttatcgtacaagactttatcaactgggcgaaaacgcacggctgtccggtcgggccgggacgcggttcgggcgcgggttcgctggtggcgtattcgctgaagattaccgacctcgacccgctgaaatacgcgctgctgttcgagcgtttcctaaaccccgaacgcgtttccatgcccgactttgacgtggacttctgtcaggcaaaccgcggccgcgtgattgaatacgtgcgcgaaaaatacggcgctcaggcggtcagccagattgtgactttcggcacgatgtcgtccaaagcggtcatccgcgacgtggggcgtgtgctggaactgccgtttatgctgtgcgacaaactgtccaagctgattccgttggaagccaacaaacccctgagtttggacgacgcgatgaaggcgcagccgcagattcaggaattgcttgaagcggaagaagcggacgaactgattacgctggcgaaaaaactggaagacctgacgcgcggtttgggtatgcacgcaggcggcgtgttgattgcgccgggcaagatttccgattacagccccgtgtatcaggcggacgaatccgcctcgcccgtatccatgtacgacaagggcgacgtggaagacgtgggtttggtgaagttcgactttttgggcctgcgcaacctgaccattatcgaaatggcgcagaacaacatcaaaaacaccgccggcgatatcgtcgatgtcggcaagattccgcttgacgaccagactgcctaccaaatcttccgcgatgcgaacaccaccgccgtcttccagttcgagtcgaccggcatgaaaaaaatgctgaaaacggcgcatacgaccaagtttgaagaactcatcgccttcgtatcgctctaccgacccggcccgatggacaacattcccgacttcgtcgcacgcatgaagggacaggaattccaatacatccacccgctgctggaaggcatcctcgcgccgacctacggcattatggtgtatcaggaacaagtgatgcaggcggcgcagattatcggcggctactcgctcggcggcgcggacctgctgcgccgcgccatgggtaagaaaaagcccgaagagatggtgaaacaccgcgaaatcttcgccgaaggtgcggcaaaacaaggcatttcgcgcgaaaaatccgacgaaatcttcaactacatggaaaaattcgccggctacggtttcaacaaatcccacgccgccgcctacgccctgatttcctaccagaccgcatggctcaaagcccactatcccgccgaatttatggcggcgacgatgtcgtccgaattggacaacaccgaccagctcaaacatttctacgacgactgccgcgccaacggcatcgagttcctgccgcccgacattaacgaatccgactaccgcttcacgccgtatccggacatgaaaatccgctacgcactcggcgcgattaaaggcacgggcgaagccgccgtcgaatccatcatcgccgcgcggcaaagcggcggcaaatttaccggcctgttggacttctgcgagcgcgtcggcaaagaacacatgaaccgccgcaccctcgaagccctgatacgcggcggcgcgttcgacagcatcgaacccaaccgcgccatgctcttggcgaacatcgaccttgccatggacaacgccgaccaaaaagccgccaacgccaatcagggcgggctgtttgacatgatggaagacgccatcgaaccggtgcggctcatcgacgcacccatgtggagcgaatcggaaaaactcgccgaagaaaaaaccgtcatcggcttttacctgtccggccacccgttcggcccgtatgcccaagaagtccgccaaatcgccccgaccaaattaggccgtctgaaaccgcaagacagcgtgcgcctcgccggattcgttaccgccgtgcgcaccatgatgggcaaacgcggcaaaatcgccttcgtcagcctcgaagattcgagcgggcaggctgaaatcatggtcggcggacaaacgctggaaaactgcgccgactgcctcaaagccgaccaagtgctgattatcgaatccaaagtcagccgcgacgattacggcggcggcgacgggctgcgcatcatggcaaaccaagtcatgaccctgcaaacggcgcgcgaacgctacgcccgcagcctcagcctcgcccttgccccgcatcacgacatcggcggactggtacggctgctcgccgcccaccaactgcccgacacgccgcgcatcccgcttcaattgtcgtatgccaacgaaaaagcgtcgggcaggcttcaagtgcctccgaaatggacggttacaccgagttccgcattgttcggcgaactggaaacattgctcggcagccggtcggtgcgcgtgaattgg

SEQ ID NO: 1820 - protein, 1144 aa, Neisseria gonorrhoeae
MTEPTYIPLRLHTEFSITDGMVRIKKLIAKAQEYGLPALGISDLMNEFGLVKFYKACRGAGIKPVGAADVWIGNPNAPDKPFRAMLVIRNDAGYLRLSELLTEAYVGQDRNIHHAELNPEWLENGDNSGLICLSGAHYGEVGVNLLNGNEDAARAAALKYAAWFPDTFYLELQRLPERPEWEACVSGSVKLAEELGLPVVATHPTQFMNRDDFNAHEARVCIAGGWVLTDKKRPRDFTPSQFFIPPETMLERFADLPEALENTVEIAKRCNLHITLGKNFLPLFPTPDGLSLDDCLIKLSNEGLQERMVQLYPDEAERAAKMPEYQERLDFELNIIIQMKFPGYFLIVQDFINWAKTHGCPVGPGRGSGAGSLVAYSLKITDLDPLKYALLFERFLNPERVSMPDFDVDFCQANRGRVIEYVREKYGAQAVSQIVTFGTMSSKAVIRDVGRVLELPFMLCDKLSKLIPLEANKPLSLDDAMKAQPQIQELLEAEEADELITLAKKLEDLTRGLGMHAGGVLIAPGKISDYSPVYQADESASPVSMYDKGDVEDVGLVKFDFLGLRNLTIIEMAQNNIKNTAGDIVDVGKIPLDDQTAYQIFRDANTTAVFQFESTGMKKMLKTAHTTKFEELIAFVSLYRPGPMDNIPDFVARMKGQEFQYIHPLLEGILAPTYGIMVYQEQVMQAAQIIGGYSLGGADLLRRAMGKKKPEEMVKHREIFAEGAAKQGISREKSDEIFNYMEKFAGYGFNKSHAAAYALISYQTAWLKAHYPAEFMAATMSSELDNTDQLKHFYDDCRANGIEFLPPDINESDYRFTPYPDMKIRYALGAIKGTGEAAVESIIAARQSGGKFTGLLDFCERVGKEHMNRRTLEALIRGGAFDSIEPNRAMLLANIDLAMDNADQKAANANQGGLFDMMEDAIEPVRLIDAPMWSESEKLAEEKTVIGFYLSGHPFGPYAQEVRQIAPTKLGRLKPQDSVRLAGFVTAVRTMMGKRGKIAFVSLEDSSGQAEIMVGGQTLENCADCLKADQVLIIESKVSRDDYGGGDGLRIMANQVMTLQTARERYARSLSLALAPHHDIGGLVRLLAAHQLPDTPRIPLQLSYANEKASGRLQVPPKWTVTPSSALFGELETLLGSRSVRVNW

SEQ ID NO: 1821 - DNA, 159 bp, Neisseria gonorrhoeae
gtggacaataaaaggcgtattgtagcagggttgtctttagatggcggtgcaggtaatgccgtttcggattcagacggcatgacctgcaaatgttttttgagcttttacgacggcaaaaaaatgcctcctgccgtgtggcggaggcttcccaaggagtat

SEQ ID NO: 1822 - protein, 53 aa, Neisseria gonorrhoeae
VDNKRRIVAGLSLDGGAGNAVSDSDGMTCKCFLSFYDGKKMPPAVWRRLPKEY

SEQ ID NO: 1823 - DNA, 141 bp, Neisseria gonorrhoeae
atgttttttgagcttttacgacggcaaaaaaatgcctcctgccgtgtggcggaggcttcccaaggagtattgatagatataaaggactatcaaactagttataaggaactatataccttattcggacggacggcaagcagt

SEQ ID NO: 1824 - protein, 47 aa, Neisseria gonorrhoeae
MFFELLRRQKNASCRVAEASQGVLIDIKDYQTSYKELYTLFGRTASS

SEQ ID NO: 1825 - DNA, 96 bp, Neisseria gonorrhoeae
ttgacgctgatgcacatcctcaaacgcggactgcccgatacaccggcaatcggcatcaaaacgaaatcaaaaacctgtttgaacgtaaaatctatt

SEQ ID NO: 1826 - protein, 32 aa, Neisseria gonorrhoeae
LTLMHILKRGLPDTPAIGIKTKSKTCLNVKSI

SEQ ID NO: 1827 - DNA, 189 bp, Neisseria gonorrhoeae
atgccgccatccgtccaaagaaatcctgcccaacggcaggctgcaaatcctgttccccgacgaatccgcattgacgctgatgcacatcctcaaacgcggactgcccgatacaccggcaatcggcatcaaaacgaaatcaaaaacctgtttgaacgtaaaatctatttaactgcttgccgtccgtccgaa

SEQ ID NO: 1828 - protein, 63 aa, Neisseria gonorrhoeae
MPPSVQRNPAQRQAANPVPRRIRIDADAHPQTRTARYTGNRHQNEIKNLFERKIYLTACRPSE

SEQ ID NO: 1829 - DNA, 201 bp, Neisseria gonorrhoeae
ttgaggatgtgcatcagcgtcaatgcggattcgtcggggaacaggatttgcagcctgccgttgggcaggatttctttggacggatggcggcatacggggtttcagacggcatttttacggaacaggcagtgcggacacatcgccggttttgcggcaattttgggtgcggcggcggcaggtgctacaataacgccctctttc

SEQ ID NO: 1830 - protein, 67 aa, Neisseria gonorrhoeae
LRMCISVNADSSGNRICSLPLGRISLDGWRHTGFQTAFLRNRQCGHIAGFAAILGAAAAGATITPSF

SEQ ID NO: 1831 - DNA, 231 bp, Neisseria gonorrhoeae
atggaagccaccgtctatctcgaagacaacgaatacatcgccttgtgcgacctcttgaaattggccggacttgccgaaagcggcggacaggcaaaagcatttatcgccgaagggctggtgttgcgcaacggcggaaccgaaatccgcaaaacggccaaaatacgcggcggagaagtcatcgagtttgacggcgcgcgcttggaaatcgccgatggatacgaccctgaagca

SEQ ID NO: 1832 - protein, 77 aa, Neisseria gonorrhoeae
MEATVYLEDNEYIALCDLLKLAGLAESGGQAKAFIAEGLVLRNGGTEIRKTAKIRGGEVIEFDGARLEIADGYDPEA

SEQ ID NO: 1833 - DNA, 201 bp, Neisseria gonorrhoeae
atggatacgaccctgaagcataaagccgaagcccttttgggcgagccgcttttggacgaacccgtccgccccgagtcgtgggaatgctgcggcagcgactgcggcgaggcgtgcattcagacgatttactgggcggacaaggcacgctacgatgcgcaacggaaaaaactgaaggaagcgggttggccggacgatgccgtc

SEQ ID NO: 1834 - protein, 67 aa, Neisseria gonorrhoeae
MDTTLKHKAEALLGEPLLDEPVRPESWECCGSDCGEACIQTIYWADKARYDAQRKKLKEAGWPDDAV

SEQ ID NO: 1835 - DNA, 90 bp, Neisseria gonorrhoeae
aatatatactgcttttattgatacaacttttccacacaagaaaatatggacaccctgttcagcctcaaagttttccgccaagtcgtccaa

SEQ ID NO: 1836 - protein, 6 aa, Neisseria gonorrhoeae
NIYCFY

SEQ ID NO: 1837 - DNA, 513 bp, Neisseria gonorrhoeae
atgcacacttgcacttcctgcggcgaaaaacatgaagatatgcccgcaaccggctttaccgccccctatccctataatcaactcagtgaagaagaacgcattgcttatcaagcggaatgcgattctgatttctgcatcatccgctattccgaccaaaccgaccgctttatccgcgcggcgctgcctattccgattatcgggcatcaggaaacgctggaatacggcgtgtgggtgtccgtcagcgaaaagagttttaacgactatcaaagccgcttttacgacaaccctgaaaacgccgtttatttcggtatgatttgcaatcggctgcccccttatgaaaccgacaccttcggtctgcactgcaatgtcgttacccagtccgacaaccaacgccctttgctgcaacttcatcaaagcggcggacatccgccggtacgcgacttttatcacggcatgggatatgccgaagcgcaggcaaggataggggcggtatccgaatcggattgttcagga

SEQ ID NO: 1838 - protein, 171 aa, Neisseria gonorrhoeae
MHTCTSCGEKHEDMPATGFTAPYPYNQLSEEERIAYQAECDSDFCIIRYSDQTDRFIRAALPIPIIGHQETLEYGVWVSVSEKSFNDYQSRFYDNPENAVYFGMICNRLPPYETDTFGLHCNVVTQSDNQRPLLQLHQSGGHPPVRDFYHGMGYAEAQARIGAVSESDCSG

SEQ ID NO: 1839 - DNA, 423 bp, Neisseria gonorrhoeae
gtggttttatcaagtccaaccgttttcagacggcatcgtccggccaacccgcttccttcagttttttccgttgcgcatcgtagcgtgccttgtccgcccagtaaatcgtctgaatgcacgcctcgccgcagtcgctgccgcagcattcccacgactcggggcggacgggttcgtccaaaagcggctcgcccaaaagggcttcggctttatgcttcagggtcgtatccatcggcgatttccaagcgcgcgccgtcaaactcgatgacttctccgccgcgtattttggccgttttgcggatttcggttccgccgttgcgcaacaccagcccttcggcgataaatgcttttgcctgtccgccgctttcggcaagtccggccaatttcaagaggtcgcacaaggcgatgtattcgttgtcttcgaga

SEQ ID NO: 1840 - protein, 141 aa, Neisseria gonorrhoeae
VVLSSPTVFRRHRPANPLPSVFSVAHRSVPCPPSKSSECTPRRSRCRSIPTTRGGRVRPKAARPKGLRLYASGSYPSAISKRAPSNSMTSPPRILAVLRISVPPLRNTSPSAINAFACPPLSASPANFKRSHKAMYSLSSR

SEQ ID NO: 1841 - DNA, 129 bp, Neisseria gonorrhoeae
atgcaaaggaaaagccgctatgccgtcattcccgcgcaggcgagaatccagactttgatttattggaaatgtttaaggttaaccgctatttcaaacttccggattcctgctttcgagggaatggcgata

SEQ ID NO: 1842 - protein, 43 aa, Neisseria gonorrhoeae
MQRKSRYAVIPAQARIQTLIYWKCLRLTAISNFRIPAFEGMAI

SEQ ID NO: 1843 - DNA, 252 bp, Neisseria gonorrhoeae
atggggtgttatgtggtggtgaatgaaggacgggatgtttcaatgttgtcggacagtgtggcggcggcggtcattttaaaaaacaggtgtatggcaaatgcaaaggaaaagccgctatgccgtcattcccgcgcaggcgagaatccagactttgatttattggaaatgtttaaggttaaccgctatttcaaacttccggattcctgctttcgagggaatggcgatatgaacgttttcaattttaatctacta

SEQ ID NO: 1844 - protein, 84 aa, Neisseria gonorrhoeae
MGCYVVVNEGRDVSMLSDSVAAAVILKNRCMANAKEKPLCRHSRAGENPDFDLLEMFKVNRYFKLPDSCFRGNGDMNVFNFNLL

SEQ ID NO: 1845 - DNA, 765 bp, Neisseria gonorrhoeae
gtggaagtcgctgcccgcgcttgccaacaatccgaagcggtctgccaaaagcgcgtagttgaggcggtcgtttttgcagcagttgccgctgtggacttcgatgcccgcgccgccgaggtttttaaattcttcaaacaggttgcgcttggcggttgccgacaaatcataacgcatcggatgggcaatcaccgccatgccgcccgcgccgttgacggcggagacgcagtctgccagcgtcgcccattcgtggcgtaccgcgcaggatttgccgtcgcccaagtatttggtgaacgcctgctgcttgtttttgacgtgtccgtttttgatgaggaactcggcgacgtgggtgcggctgaccatttctttgtttgccgccagcgccagcgcgccgtcgtatgcgccgccgatgcctttcttttcgagcttggcggcgatggcttcaagacgtttcagacggcctttgcggacatctgccaacaggttttgcaggttttcgtcctgctcgtcgaaatccaaaccgacaacgtgtatggtacgcccgcgccacgttaccgaaatttccacgccgttaatcaggcgcaaaccgagcctgtcggcttcggcacgcgcttcggagatgccgcccgtgtggtcgtggtcggtcaacgccagcagcgtgcagccgttttgatgtgcgaggcggacgacttcggcgggggggagcataccgtcggaaacggtggaatggcagtgcaggtctatcatggggtgttatgtggtggtgaa

SEQ ID NO: 1846 - protein, 255 aa, Neisseria gonorrhoeae
VEVAARACQQSEAVCQKRVVEAVVFAAVAAVDFDARAAEVFKFFKQVALGGCRQIITHRMGNHRHAARAVDGGDAVCQRRPFVAYRAGFAVAQVFGERLLLVFDVSVFDEELGDVGAADHFFVCRQRQRAVVCAADAFLFELGGDGFKTFQTAFADICQQVLQVFVLLVEIQTDNVYGTPAPRYRNFHAVNQAQTEPVGFGTRFGDAARVVVVGQRQQRAAVLMCEADDFGGGEHTVGNGGMAVQVYHGVLCGGE

SEQ ID NO: 1847 - DNA, 834 bp, Neisseria gonorrhoeae
atgatagacctgcactgccattccaccgtttccgacggtatgctcccccccgccgaagtcgtccgcctcgcacatcaaaacggctgcacgctgctggcgttgaccgaccacgaccacacgggcggcatctccgaagcgcgtgccgaagccgacaggctcggtttgcgcctgattaacggcgtggaaatttcggtaacgtggcgcgggcgtaccatacacgttgtcggtttggatttcgacgagcaggacgaaaacctgcaaaacctgttggcagatgtccgcaaaggccgtctgaaacgtcttgaagccatcgccgccaagctcgaaaagaaaggcatcggcggcgcatacgacggcgcgctggcgctggcggcaaacaaagaaatggtcagccgcacccacgtcgccgagttcctcatcaaaaacggacacgtcaaaaacaagcagcaggcgttcaccaaatacttgggcgacggcaaatcctgcgcggtacgccacgaatgggcgacgctggcagactgcgtctccgccgtcaacggcgcgggcggcatggcggtgattgcccatccgatgcgttatgatttgtcggcaaccgccaagcgcaacctgtttgaagaatttaaaaacctcggcggcgcgggcatcgaagtccacagcggcaactgctgcaaaaacgaccgcctcaactacgcgcttttggcagaccgcttcggattgttggcaagcgcgggcagcgacttccaccgtttagacgacttcagcggcggcatcctcggcgcgtgtcccgatcttccggaaaactgcaaaccggtgcgggcgcatttttcccgacat

SEQ ID NO: 1848 - protein, 278 aa, Neisseria gonorrhoeae
MIDLHCHSTVSDGMLPPAEVVRLAHQNGCTLLALTDHDHTGGISEARAEADRLGLRLINGVEISVTWRGRTIHVVGLDFDEQDENLQNLLADVRKGRLKRLEAIAAKLEKKGIGGAYDGALALAANKEMVSRTHVAEFLIKNGHVKNKQQAFTKYLGDGKSCAVRHEWATLADCVSAVNGAGGMAVIAHPMRYDLSATAKRNLFEEFKNLGGAGIEVHSGNCCKNDRLNYALLADRFGLLASAGSDFHRLDDFSGGILGACPDLPENCKPVRAHFSRH

SEQ ID NO: 1849 - DNA, 1356 bp, Neisseria gonorrhoeae
atgccgtctgaaccttcagacggcataccgtacaaaccaatctgccttacacacactgagtttgacatgcagttctcggcattcggcgaaaaattcacgcaacacagcggcatcctgcaactgatggacgacctcggcgacgcgctcaaaagcgacaagcccgtcaatatgctcggcggcggcaacccggcgcgcattcccgaaatcgatcgggcgttcgccgacatattttccaagctggcggcggaacacgccgtcgagaacatcggcaactactccaatccccaaggcgatgccgcgctgattgacgcgctgaccgccttccccaaccgcgaatacggctggaacctgaccgtcggcaatatcgcgctgaccaacggttcgcaaaacgcgtttttctatttattcaacctcttcggcggcaaattcaagctttcagacggcacatccgcagaaaaagccattttgttgccgctcgcgcccgaatacatcggctatgccgacgtgcatgtcgaagggcggcacttcgtttccgtcaaacccaaaatcgaaaacgtcgaacacgaaggcgaagcaggcttcttcaaataccgcgtggactttgacgcactggaaaacctgcccgaactcaaagcgggcaaaatcggcgcgatttgctgttcgcgcccgaccaacccgaccggcaacgtgttgaccgacggcgaaatggcgcgtttggacgctttggcgcgtgaacacggcattccgccgattatcgacaacgcctacggaatgccgttccccaacattattgacagcggcgtaacgctgaattggcacgaaaacatcatcctctgcttcagcctttccaaagtcggcctgccgggcgttcgcaccggcatcatcgtcgccgcgcccgaagccgtcaaagccgtcagcagcctaaacgcgattgtgaaccttgcccccacgcgcttcggcgcggccatcgccgccccgctgctggaaagcggcgagatgaaacggcttgccgaccaagtcatccggccgttttaccgcaatcaggcgcaaaccgccgtttcgctgctcaagcgcgagctgggcgcgtacccgatgaaaatccacaaacccgaaggcgcgattttcctgtggctctggtttgaaaacctgcccgtttcgtcgcaaaccctgtacgaaatgctcaaagccgaaggtacgctgattattccgggcgaacatttcttcgtcggcatcgacacgcaagactacccgcacgcgggcgagtgcatccgtatgagtatcgcacaggacgctcaaacgctggaaaaaggcatcgccgccatcggcaaaaccgtccgaaaaccgtacgacaacgtt

SEQ ID NO: 1850 - protein, 452 aa, Neisseria gonorrhoeae
MPSEPSDGIPYKPICLTHTEFDMQFSAFGEKFTQHSGILQLMDDLGDALKSDKPVNMLGGGNPARIPEIDRAFADIFSKLAAEHAVENIGNYSNPQGDAALIDALTAFPNREYGWNLTVGNIALTNGSQNAFFYLFNLFGGKFKLSDGTSAEKAILLPLAPEYIGYADVHVEGRHFVSVKPKIENVEHEGEAGFFKYRVDFDALENLPELKAGKIGAICCSRPTNPTGNVLTDGEMARLDALAREHGIPPIIDNAYGMPFPNIIDSGVTLNWHENIILCFSLSKVGLPGVRTGIIVAAPEAVKAVSSLNAIVNLAPTRFGAAIAAPLLESGEMKRLADQVIRPFYRNQAQTAVSLLKRELGAYPMKIHKPEGAIFLWLWFENLPVSSQTLYEMLKAEGTLIIPGEHFFVGIDTQDYPHAGECIRMSIAQDAQTLEKGIAAIGKTVRKPYDNV

SEQ ID NO: 1851 - DNA, 357 bp, Neisseria gonorrhoeae
atgtttttcgccgcaggaagtgcaagtgtgcataaggtttcagactttcaacacaagtttgcggtaaagccattcgccggcaaacagcatccccatcaatacataggcaatcacgcctgtataaaccgcccaccaatcatatcgccccaaccgggccaacaaagcggcaagcgtcccgttggcaataaagaatacgcaccaaacctgcgttacccggcgggtatagcgcacggctttttcaggcaggtcgggctgttgcagccgcgcaagtttttcaatcaccgtctgcccggcaaacaggctgctgccgaacaccgccaacatcatcaaattaacgaggacaggataccaatacat

SEQ ID NO: 1852 - protein, 119 aa, Neisseria gonorrhoeae
MFFAAGSASVHKVSDFQHKFAVKPFAGKQHPHQYIGNHACINRPPIISPQPGQQSGKRPVGNKEYAPNLRYPAGIAHGFFRQVGLLQPRKFFNHRLPGKQAAAEHRQHHQINEDRIPIH

SEQ ID NO: 1853 - DNA, 276 bp, Neisseria gonorrhoeae
tgcgccgccgttgccgaaggttcgcccgttatcggcatttggattgacgatgccgaaacagacaacccgcgccgcgccgcgttctaccgccaatccgccgccgaactcgcccaagggctggcaaggcgcggcatcccgctctacacggcggcatcgcctgccgggcttgtccggctcgccgtccgcctcaatatccgcgccgtcatcgccgacgaatcccatacttttgccgacaaactcgccgacaacgccctttggcacgaattggacaaacac

SEQ ID NO: 1854 - protein, 92 aa, Neisseria gonorrhoeae
CAAVAEGSPVIGIWIDDAETDNPRRAAFYRQSAAELAQGLARRGIPLYTAASPAGLVRLAVRLNIRAVIADESHTFADKLADNALWHELDKH

SEQ ID NO: 1855 - DNA, 1908 bp, Neisseria gonorrhoeae
atgaatctggaaaccctgatcgccctgccgcgcaacatcaagaaaatctgtttcctcatacacgattttctgatgattttcaccgccttttggttcacccaaagcctgaaggccgactactcggacgaatggttcgattttgccaactggcagtcttttttgctgactgccttgctgaccatcacattatttatccgaatggggctttaccgcgccgttacacgctttgtcagtttccacgtcctgaccaccgcctttgccggcagcctcgcctccgccgtattgttcttcctcaacacattgatttttgaagaaaggctgcgcctcgccctgccgattgtctatttcttactgctgtttgtttccgtgaccggctcgcgtatggttttgcgcggactcctgtccgaccaccagaaaaaaacacatgaccccgtcatcatttacggcgcggggcgttcgggtcggcagctccttgaagccgtcaaacagatgcgcgaatattccgccgccgcctttgtggacgacaaccccaagctttggcacaccgtcatctacgaccttgccgtttaccagcccgatgccatcgccttcctcatcgaacgctacggcgtggaaaaaatcctgctcgccattcccagcgcgactcaggaacaacgccgccgaatcatcagcaaactgaaagcctatccgtgcgaagtgttgaccattcccggaatgaaagacctgatggacgggaaaatcagcatcggcacgctcaaaaaaatctctgtgtccgacctgctcgggcgcgattccgtcgcacccgacgaccgcctcatgaatgccgacaccgaaggcaaaaccgtcatggtaaccggcgcgggcggctccatcggttcggaactctgccgccagattatccgccgccgccccgaaaggctgctgctgttcgagctgtccgaattcgccctgtacaccgttgaaaaagaattgtgcgaatactgcgcccgaaacggcatcgccgccgaaatccttccctttttgggttcggtgcaaaaccgcacgctgctcacgcacattatgaccgccttttccgttgcgaccgtctatcacgccgccgcctacaaacacgtccctatggtcgagttcaacaccgtcgagggcatacgcaacaacatcttcggcacactcgaatgcgcgcttgccgccacggcttcgggcgtggaaaccttcgtcctcatctccaccgacaaagccgtccgccccgccaacacgatgggtgcgggcaaacgcatggcggaactctgccttcaggcactcgccgccgaacccggacaaaaaacccgcttcagcatggtacgtttcggcaatgttttaggctcgtccggctccgtcgtcccgctgtttgaaaaacagattgccgaaggcggccccatcaccctgacccaccccgacatcacgcgctatttcatgaccatacccgaagcggcgcaactggttatccaagccggcgcgatgggcagaggcggcgacgtgttcgtcctcgatatgggcgaatccgtcaaaatcaccgaccttgcccgccaaatgattaccttaagcggactcaaacccaaaacgcccgaacagcccgacggcgacatcgaaatcctcattaccgggctgcgccccggcgaaaaactctacgaagagttgctcatcggcgacaacgtccgcaaaaccggccatccgcgcatcatgaccgccgacgagaccatgctgccgtggcacgaactctccgccctgctcgaccgcatccgcaccgcctgcgaccgttacgaccagcaggcaatccgcgacctgctcgtcaacgccccgaccggctttaccccgaccggcggcatctgcgacctgctttgggtatgcgaaacacacagaaaaaatgccgtc

SEQ ID NO: 1856 - protein, 636 aa, Neisseria gonorrhoeae
MNLETLIALPRNIKKICFLIHDFLMIFTAFWFTQSLKADYSDEWFDFANWQSFLLTALLTITLFIRMGLYRAVTRFVSFHVLTTAFAGSLASAVLFFLNTLIFEERLRLALPIVYFLLLFVSVTGSRMVLRGLLSDHQKKTHDPVIIYGAGRSGRQLLEAVKQMREYSAAAFVDDNPKLWHTVIYDLAVYQPDAIAFLIERYGVEKILLAIPSATQEQRRRIISKLKAYPCEVLTIPGMKDLMDGKISIGTLKKISVSDLLGRDSVAPDDRLMNADTEGKTVMVTGAGGSIGSELCRQIIRRRPERLLLFELSEFALYTVEKELCEYCARNGIAAEILPFLGSVQNRTLLTHIMTAFSVATVYHAAAYKHVPMVEFNTVEGIRNNIFGTLECALAATASGVETFVLISTDKAVRPANTMGAGKRMAELCLQALAAEPGQKTRFSMVRFGNVLGSSGSVVPLFEKQIAEGGPITLTHPDITRYFMTIPEAAQLVIQAGAMGRGGDVFVLDMGESVKITDLARQMITLSGLKPKTPEQPDGDIEILITGLRPGEKLYEELLIGDNVRKTGHPRIMTADETMLPWHELSALLDRIRTACDRYDQQAIRDLLVNAPTGFTPTGGICDLLWVCETHRKNAV

SEQ ID NO: 1857 - DNA, 1239 bp, Neisseria gonorrhoeae
atgccgtctgaagggttatcgtgcggcttcggtcaggacggcttcgatgtgttttttgcagaacgcgatttcgtcgtcggtcagcgtcgggtgcaccaagaacgtcagggcggtgccgcccagttcgacggcgtttttcagccgctctttgggccgccacggcgtgttgtcgaaggctttttccaaatacacttcggagcagccgccttgatagcaggggacgttgcgcgcgttcagttcgctgacgatgcggtcgcgcgtccagtcgtctttcaggtgttcgggtttgacgaaggcgtagaacttgtattgcgcgtgtccgatgtagccggcgacttcaatcaggcggatgcttttgaatttgcgcaaactttctgccagcttggcggcgttttcttggcggcgcgccgtccattcgggcaggtgtttgagctggatgcggccgatgacagcctgcatttccatcatgcgccagttggtgccgaaactttcgtgcagccagcggaaaccgggcgcgtgttcgcggtggtacacggcatcgtagcttttgccgtggtctttgtacgcccacattttttcccacagggttttgtcgttggtcgtaaccataccgccctcgccgccggtggtgatgattttgtcttgacagaacgaccacgcgccgacgtgcccgatagagccgacggatttgcctttgtaggtcgcgccgtgcgcttgggcgcagtcttcaatcacccacaaatcatgttcttttgccaaagccatgatgccgtccatttcggcaggcataccggcaaggtggacgacaatgacggctttggtattcggggtcagcacggctttgacggtttccgcgctgatgttttggctgttcaaatccacgtcggcaaacacggggtttgcgcccgcgttcacaatgcaggaggcggaggcgaggaaggtgcgcgaggtaacaatcacatcgtcgcccgcgcctatgccgattgctttgagtgcggcatcgagcgcaagcgtgccgttggaaagggcgacggcgtaccgcgtgccggcaaaggcggcaaattctttttcaaattcgcggcattcgctgcccgtccagtagttgactttgttggacagcaggactttggaaacggcatcggcttcttctcgggtgaagctcggccatggggaaagggcggtgttcagcatggtgtttggtccgtcgggttcggacggcatttccgaccctatgccgtc

SEQ ID NO: 1858 - protein, 413 aa, Neisseria gonorrhoeae
MPSEGLSCGFGQDGFDVFFAERDFVVGQRRVHQERQGGAAQFDGVFQPLFGPPRRVVEGFFQIHFGAAALIAGDVARVQFADDAVARPVVFQVFGFDEGVELVLRVSDVAGDFNQADAFEFAQTFCQLGGVFLAARRPFGQVFELDAADDSLHFHHAPVGAETFVQPAETGRVFAVVHGIVAFAVVFVRPHFFPQGFVVGRNHTALAAGGDDFVLTERPRADVPDRADGFAFVGRAVRLGAVFNHPQIMFFCQSHDAVHFGRHTGKVDDNDGFGIRGQHGFDGFRADVLAVQIHVGKHGVCARVHNAGGGGEEGARGNNHIVARAYADCFECGIERKRAVGKGDGVPRAGKGGKFFFKFAAFAARPVVDFVGQQDFGNGIGFFSGEARPWGKGGVQHGVWSVGFGRHFRPYAV

SEQ ID NO: 1859 - DNA, 1203 bp, Neisseria gonorrhoeae
atgccgtccgaacccgacggaccaaacaccatgctgaacaccgccctttccccatggccgagcttcacccgagaagaagccgatgccgtttccaaagtcctgctgtccaacaaagtcaactactggacgggcagcgaatgccgcgaatttgaaaaagaatttgccgcctttgccggcacgcggtacgccgtcgccctttccaacggcacgcttgcgctcgatgccgcactcaaagcaatcggcataggcgcgggcgacgatgtgattgttacctcgcgcaccttcctcgcctccgcctcctgcattgtgaacgcgggcgcaaaccccgtgtttgccgacgtggatttgaacagccaaaacatcagcgcggaaaccgtcaaagccgtgctgaccccgaataccaaagccgtcattgtcgtccaccttgccggtatgcctgccgaaatggacggcatcatggctttggcaaaagaacatgatttgtgggtgattgaagactgcgcccaagcgcacggcgcgacctacaaaggcaaatccgtcggctctatcgggcacgtcggcgcgtggtcgttctgtcaagacaaaatcatcaccaccggcggcgagggcggtatggttacgaccaacgacaaaaccctgtgggaaaaaatgtgggcgtacaaagaccacggcaaaagctacgatgccgtgtaccaccgcgaacacgcgcccggtttccgctggctgcacgaaagtttcggcaccaactggcgcatgatggaaatgcaggctgtcatcggccgcatccagctcaaacacctgcccgaatggacggcgcgccgccaagaaaacgccgccaagctggcagaaagtttgcgcaaattcaaaagcatccgcctgattgaagtcgccggctacatcggacacgcgcaatacaagttctacgccttcgtcaaacccgaacacctgaaagacgactggacgcgcgaccgcatcgtcagcgaactgaacgcgcgcaacgtcccctgctatcaaggcggctgctccgaagtgtatttggaaaaagccttcgacaacacgccgtggcggcccaaagagcggctgaaaaacgccgtcgaactgggcggcaccgccctgacgttcttggtgcacccgacgctgaccgacgacgaaatcgcgttctgcaaaaaacacatcgaagccgtcctgaccgaagccgcacga

SEQ ID NO: 1860 - protein, 401 aa, Neisseria gonorrhoeae
MPSEPDGPNTMLNTALSPWPSFTREEADAVSKVLLSNKVNYWTGSECREFEKEFAAFAGTRYAVALSNGTLALDAALKAIGIGAGDDVIVTSRTFLASASCIVNAGANPVFADVDLNSQNISAETVKAVLTPNTKAVIVVHLAGMPAEMDGIMALAKEHDLWVIEDCAQAHGATYKGKSVGSIGHVGAWSFCQDKIITTGGEGGMVTTNDKTLWEKMWAYKDHGKSYDAVYHREHAPGFRWLHESFGTNWRMMEMQAVIGRIQLKHLPEWTARRQENAAKLAESLRKFKSIRLIEVAGYIGHAQYKFYAFVKPEHLKDDWTRDRIVSELNARNVPCYQGGCSEVYLEKAFDNTPWRPKERLKNAVELGGTALTFLVHPTLTDDEIAFCKKHIEAVLTEAAR

SEQ ID NO: 1861 - DNA, 1254 bp, Neisseria gonorrhoeae
ttgaaagattggcaaatgagtaaagccgtcaaacgcctgttcgacatcatcgcatccgcatcggggctgattgtcctgtcgcccgtgtttttggttttaatatacctcatccgcaaaaacttaggttcgcccgtcttcttcattcgggaacgccccggaaaggacggaaaaccttttaaaatggtcaaattccgttccatgcgcgacgcgcttgattcagacggcattccgctgcccgatagcgaacgcctgaccgatttcggcaaaaaattacgcgccaccagtttggacgaacttcctgaattatggaatgtcctcaaaggcgagatgagcctggtcggcccccgcccgcttttgatgcagtatctgccgctttacaacaaatttcaaaaccgccgccacgaaatgaaaccgggcattaccggctgggcgcaggtcaacgggcgcaacgcgctttcgtgggacgaaaagttctcctgcgatgtttggtacaccgacaatttcagcttttggctggatatgaaaatcctgtttctgacagtcaaaaaagtcttgattaaagaaggcatttcggcgcaaggggaagccaccatgccccctttcgcggggaatcgcaaactcgccgttatcggcgcgggcggacacggcaaagtcgttgccgagcttgccgccgcactcggcacatacggcgaaatcgtttttctggacgaccgcacccaaggcagcgtcaacggcttccccgtcatcggcacgacgctgctgcttgaaaacagtttatcgcccgaacaattcgacatcaccgtcgccgtcggcaacaaccgcatccgccgccaaatcaccgaaaacgccgccgcgctcggcttcaaactgcccgttctgattcatcccgacgcgaccgtctcgccttctgcaataatcggacaaggcagcgtcgtaatggcgaaagccgtcgtacaggccggcagcgtattgaaagacggcgtgattgtgaacactgccgccaccgtcgatcacgactgcctgcttgacgctttcgtccacatcagcccgggcgcgcacctgtcgggcaacacgcgtatcggcgaagaaagccggataggcacgggcgcgtgcagccgccagcagacaaccgtcggcagcggggttaccgccggtgcaggggcggttatcgtatgcgacatcccggacggcatgaccgtcgcgggcaacccggcaaagccccttacgggcaaaaaccccaagaccgggacggca

SEQ ID NO: 1862 - protein, 418 aa, Neisseria gonorrhoeae
LKDWQMSKAVKRLFDIIASASGLIVLSPVFLVLIYLIRKNLGSPVFFIRERPGKDGKPFKMVKFRSMRDALDSDGIPLPDSERLTDFGKKLRATSLDELPELWNVLKGEMSLVGPRPLLMQYLPLYNKFQNRRHEMKPGITGWAQVNGRNALSWDEKFSCDVWYTDNFSFWLDMKILFLTVKKVLIKEGISAQGEATMPPFAGNRKLAVIGAGGHGKVVAELAAALGTYGEIVFLDDRTQGSVNGFPVIGTTLLLENSLSPEQFDITVAVGNNRIRRQITENAAALGFKLPVLIHPDATVSPSAIIGQGSVVMAKAVVQAGSVLKDGVIVNTAATVDHDCLLDAFVHISPGAHLSGNTRIGEESRIGTGACSRQQTTVGSGVTAGAGAVIVCDIPDGMTVAGNPAKPLTGKNPKTGTA

SEQ ID NO: 1863 - DNA, 1164 bp, Neisseria gonorrhoeae; identical to SEQ ID NO: 57

SEQ ID NO: 1864 - protein, 388 aa, Neisseria gonorrhoeae; identical to SEQ ID NO: 58

SEQ ID NO: 1865 - DNA, 1152 bp, Neisseria gonorrhoeae; identical to SEQ ID NO: 59

SEQ ID NO: 1866 - protein, 384 aa, Neisseria gonorrhoeae
MGGISGRLHPAPPEKFAQTVSLFEKTRFPIMKIILTTSMSGLGGTETATVRLGRLLKRHGHDIILASSDGPFVGEAQASGIRWQPVDFYRGGLAGYLKSTFAYARMLRREQPDIIDCQMARVVPACALAAKIVSPKTKIICHSHGLDAATYPKTAKLFDKLGAYIIGNCKHEREKLIRHGFPAGRIAYAYNTPPEFHFRKTEKECAVLGTLSRLDTVRAVHLMLDILKKMVGRNIPVRLNMAGIGEEMDNLKAQAKRLGIEDKVTFLGGVRDLTGYFKEVDILVNTPHCVGDHGAGVGNNILEAGLYDTPVVTYNMAGISEMVITGQTGYCIPFGDDEAFIEAVDTLIKHPELRSQMGKALHKHVETLCSDDEIYRTTMAAYEM

SEQ ID NO: 1867 - DNA, 102 bp, Neisseria gonorrhoeae
ttgctatataataacgccgataaaaaacggcccgttcagaccgccgcccgcccggaaaagcgcaacccggactgccgcaccccgccggcagccgcgacggcc

SEQ ID NO: 1868 - protein, 34 aa, Neisseria gonorrhoeae
LLYNNADKKRPVQTAARPEKRNPDCRTPPAAATA

SEQ ID NO: 1869 - DNA, 864 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaact

SEQ ID NO: 1870 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 1871 - DNA, 339 bp, Neisseria gonorrhoeae
ttggtgttcgggcggcgtgattcaatgtattggtatcctgtcctcgttaatttgatgatgttggcggtgttcggcagcagcctgtttgccgggcagacggtgattgaaaaacttgcgcggctgcaacagcccgacctgcctgaaaaagccgtgcgctatacccgccgggtaacgcaggtttggtgcgtattctttattgccaacgggacgcttgccgctttgttggcccggttggggcgatatgattggtgggcggtttatacaggcgtgattgcctatgtattgatggggatgctgtttgccggcgaatggctttaccgcaaacttgtgttgaaagtc

SEQ ID NO: 1872 - protein, 113 aa, Neisseria gonorrhoeae
LVFGRRDSMYWYPVLVNLMMLAVFGSSLFAGQTVIEKLARLQQPDLPEKAVRYTRRVTQVWCVFFIANGTLAALLARLGRYDWWAVYTGVIAYVLMGMLFAGEWLYRKLVLKV

SEQ ID NO: 1873 - DNA, 1419 bp, Neisseria gonorrhoeae
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcgggactgacggtgtcggtattgtgcctcgggctggatcaggcatacgtccgcgaatactatgccgccgccgacaaagacactttgttcaaaaccctgttcctgccgccgctgctgttttccgccgcgatagccgccctgctgctttcccgcccgtccctgccgtctgaaatcctgttttcgctcgacgatgccgccgccggcatcgggctggtgctgtttgaactgagcttcctgcccatccgctttctcttactggttttgcgtatggaagggcgcgcccttgccttttcgtccgcgcaactcgtgcccaaactcgccattctgctgctgttgccgctgacggtcgggctgctgcactttccggcgaacacctccgtcctgaccgccgtttacgcgctggcaaaccttgccgccgccgcctttttgctgtttcaaaaccgatgccgtctgaaggccgtccggcgcgcgccgttttcgcccgccgtcctgcaccgggggctgcgctacggcataccgctcgcactgagcagccttgcctattgggggctggcatccgccgaccgtttgttcctgaaaaaatatgcgggcctggaacagctcggcgtttattcgatgggtatttcgttcggcggggcggcattattgctccaaagcatcttttcaacggtctggacaccgtatattttccgtgcaatcgaagaaaacgccacgcccgcccgcctctcggcaacggcagaatccgccgccgccctgcttgcctccgccctctgcctgaccggaattttctcgcccctcgcctccctcctgctgccggaaaactacgccgccgtccggtttaccgtcgtatcgtgtatgctgccgccgctgttttacacgctgaccgaaatcagcggcatcggtttgaacgtcgtccgcaaaacgcgtccgatcgcgcttgccaccttgggcgcgctggcggcaaacctgctgctgctggggcttgccgtaccgtccggcggcacgcgcggcgcggcggttgcctgtgccgcctcattctggttgttttttgttttcaagacagaaagctcctgccgcctgtggcagccgctcaaacgcctgccgctttatatgcacacattgttctgcctggcctcctcggcggcctacacctgcttcggcacaccggcaaactaccccctgtttgccggcgtatgggcggcatatctggcaggctgcatcctgcgccaccggaaaaatttgcacaaactgtttcattatttgaaaaaacaaggtttcccatta

SEQ ID NO: 1874 - protein, 473 aa, Neisseria gonorrhoeae
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 1875 - DNA, 1107 bp, Neisseria gonorrhoeae
atgttttcggacacaaatatatccatgatggaaaacgccctccgacttgccgctttggggcgtttttccacttcacccaacccgcgcgtcggctgcgttatcgcacacggcagccaaattgtcggacagggcttccacgtcaaagcgggcgaaccccatgccgaagtccacgccctgcgtcaggcgggggaaatggcaaaaggcgcgaccgcctttgttaccctcgaaccgtgcagccattacggacgcacaccgccctgcgccgaagccctgctccgttccggcgtaacacgcgtcgtcgccgccatgcgcgaccccaacccgccggttgcaggcaaagggcttgtcctgctcaaagcagcgggcatcaagacggaatgcggactacttgaaaacaaagcacgcgaactcaaccggggatttttatcgcgcatcgaacgccgccgcccctttgtccgcctcaaatgcgccgtttcgctggacggcaaaaccgccctttcagacggcagcagcttttggattaccggcgaggaagctcgtgccgacgtacaggttttgcgtgccgaaagctgcgcggtgctgaccggcatcggcacggtgttggcagacaatccccggctcaacgtccgcgcttttccaactttgcgccaacccgcacgcatcgttttagacagccgcctgcgcctgcccccgaacagccatttggttaccgacgggcaatctccgacctacatcgccaccttggaacgcgatgaagacaaactccgcccctatcgggaacacgcacacatccgcatcctgatgccgtctgaaacggcagacggcaaaatcgacctgcaccatctgatgcgcctccttgccgacgaaggtttcggcgaaatcatggtcgaagcaggctccgaactcacatccgcatttttggcggaaaatttggcggacgaaatcgtgctgtaccgttcgcccaaaatcctcggcggcggcaaagacctgttttccctgcccgaaaaccgtgccgccctttccgcaccgcccttgtggacacccgtttcaagcgaaatcctcggacacgacatcaaaaccgtgttccggaaaaacggcaacgccttt

SEQ ID NO: 1876 - protein, 369 aa, Neisseria gonorrhoeae
MFSDTNISMMENALRLAALGRFSTSPNPRVGCVIAHGSQIVGQGFHVKAGEPHAEVHALRQAGEMAKGATAFVTLEPCSHYGRTPPCAEALLRSGVTRVVAAMRDPNPPVAGKGLVLLKAAGIKTECGLLENKARELNRGFLSRIERRRPFVRLKCAVSLDGKTALSDGSSFWITGEEARADVQVLRAESCAVLTGIGTVLADNPRLNVRAFPTLRQPARIVLDSRLRLPPNSHLVTDGQSPTYIATLERDEDKLRPYREHAHIRILMPSETADGKIDLHHLMRLLADEGFGEIMVEAGSELTSAFLAENLADEIVLYRSPKILGGGKDLFSLPENRAALSAPPLWTPVSSEILGHDIKTVFRKNGNAF

SEQ ID NO: 1877 - DNA, 504 bp, Neisseria gonorrhoeae
atgcccgttttgcgcccaccccgacacccgcgttgtcgattcgcgcctgatggaagaacgcaacgccgtgcgccgccgccgccaatgccccggctgcggcaaacgcttcggcacgctcgaaaccgccgaactcaaaatgcccgccgtcatcggtccggacaagaaacgttcgcccttcaatgcacaacgcctccgcaacgacctgaccgccgccgcccgaaaatccgccctgacacccgaacagatcgacgaaaccgtccgcctgacggaacacaggctctacacttcgggtcagcgcgacatatcctcatccgaacttgtcgaaatcgtgctggaggagctgttcgggcaaaacacggaagccgccgtccgtttcgccgccctgcacaaacgcttcgacagcccggaacatttcgcctcgtggctggcgcaaggcggcaaaacctgattcccccaacccatactgatacggtatccctatgttttcggacacaaatatatcca

SEQ ID NO: 1878 - protein, 168 aa, Neisseria gonorrhoeae
MPVLRPPRHPRCRFAPDGRTQRRAPPPPMPRLRQTLRHARNRRTQNARRHRSGQETFALQCTTPPQRPDRRRPKIRPDTRTDRRNRPPDGTQALHFGSARHILIRTCRNRAGGAVRAKHGSRRPFRRPAQTLRQPGTFRLVAGARRQNLIPPTHTDTVSLCFRTQIYP

SEQ ID NO: 1879 - DNA, 528 bp, Neisseria gonorrhoeae
gtgccgaagaaggcctggaaatcgcccgcgccgccggcgtatcggtttgacgttcagacggcatcaggaagaaacaccatgaaatgcccgttttgcgcccaccccgacacccgcgttgtcgattcgcgcctgatggaagaacgcaacgccgtgcgccgccgccgccaatgccccggctgcggcaaacgcttcggcacgctcgaaaccgccgaactcaaaatgcccgccgtcatcggtccggacaagaaacgttcgcccttcaatgcacaacgcctccgcaacgacctgaccgccgccgcccgaaaatccgccctgacacccgaacagatcgacgaaaccgtccgcctgacggaacacaggctctacacttcgggtcagcgcgacatatcctcatccgaacttgtcgaaatcgtgctggaggagctgttcgggcaaaacacggaagccgccgtccgtttcgccgccctgcacaaacgcttcgacagcccggaacatttcgcctcgtggctggcgcaaggcggcaaaacc

SEQ ID NO: 1880 - protein, 176 aa, Neisseria gonorrhoeae
VPKKAWKSPAPPAYRFDVQTASGRNTMKCPFCAHPDTRVVDSRLMEERNAVRRRRQCPGCGKRFGTLETAELKMPAVIGPDKKRSPFNAQRLRNDLTAAARKSALTPEQIDETVRLTEHRLYTSGQRDISSSELVEIVLEELFGQNTEAAVRFAALHKRFDSPEHFASWLAQGGKT

SEQ ID NO: 1881 - DNA, 870 bp, Neisseria gonorrhoeae
ttgcgaccatctgaatcatttggacaaactatgtgtcaactgctgggcatgaactgcaatacgccgaccgatattatgttttcctttgaaggcttccgccgcaggggcggcattaccgaccatcacgccgacggtttcggcatcggctttttcgaaggcaaaggcgtgcgcctgttccatgacgacaagccgagtgcaaattcccccgtcgccgacctcgtgcgcgcctaccagattaaatcggaaaacgtcgtcgcccacatccgcaaagcctcgcaaggtcaaacctcgctggcgaacacccatccctttatgcgcgaaatgtggggcggctactggctgtttgcccacaacgggcatttggtcgattttttccccgaacaaggagaatttttccaccccgtcggcacaaccgattccgaacgcgcgttctgccacatcctcaaccgcctgcgcacccgctttgccgcccgtcccgacgacgacacgctgtttgacgcgattgcggggctgacgcacgaaatccgcaagttcgggctgtttaacttcatgctttcagacggcatttccctgtttgcccacgccagcacgctgctgcactacatcgtccgccaagccccgttcggcaaagcgcgcctgctcgacgacgatgtaatggtcgattttgccgaagtaaccacgccggacgaccgcgtcgccgttatctccaccctgccgctgactcgcgatgaatcgtggtcccaacttgccgtgaacgaactggtcatgttccgcgaaggcaacatcgtccggcacgaccgtcccgaaaatcccgtctatatgagtgccgaagaaggcctggaaatcgcccgcgccgccggcgtatcggtt

SEQ ID NO: 1882 - protein, 290 aa, Neisseria gonorrhoeae
LRPSESFGQTMCQLLGMNCNTPTDIMFSFEGFRRRGGITDHHADGFGIGFFEGKGVRLFHDDKPSANSPVADLVRAYQIKSENVVAHIRKASQGQTSLANTHPFMREMWGGYWLFAHNGHLVDFFPEQGEFFHPVGTTDSERAFCHILNRLRTRFAARPDDDTLFDAIAGLTHEIRKFGLFNFMLSDGISLFAHASTLLHYIVRQAPFGKARLLDDDVMVDFAEVTTPDDRVAVISTLPLTRDESWSQLAVNELVMFREGNIVRHDRPENPVYMSAEEGLEIARAAGVSV

SEQ ID NO: 1883 - DNA, 147 bp, Neisseria gonorrhoeae
ttgaaattccagattcccgcctgcgcgggaatgacggctcaaaagttacggaacgaaaaacaaccgaaaccggacaagtcggattcccgcctgcgcgggaatgacggaatcttaagtttccgtctttgttttctgttttcgcgggaa

SEQ ID NO: 1884 - protein, 49 aa, Neisseria gonorrhoeae
LKFQIPACAGMTAQKLRNEKQPKPDKSDSRLRGNDGILSFRLCFLFSRE

SEQ ID NO: 1885 - DNA, 225 bp, Neisseria gonorrhoeae
ttgttccccattattcccgcgaaaacagaaaacaaagacggaaacttaagattccgtcattcccgcgcaggcgggaatccgacttgtccggtttcggttgtttttcgttccgtaacttttgagccgtcattcccgcgcaggcgggaatctggaatttcaatgcctcaagaatttatcggaaaaaaccaaaacccttccgccgtaattcccgcgaaagtgggaatc

SEQ ID NO: 1886 - protein, 75 aa, Neisseria gonorrhoeae
LFPIIPAKTENKDGNLRFRHSRAGGNPTCPVSVVFRSVTFEPSFPRRRESGISMPQEFIGKNQNPSAVIPAKVGI

SEQ ID NO: 1887 - DNA, 237 bp, Neisseria gonorrhoeae
gtgcttcagcaccttagggaatcgttccctttgagccggggcggggcaacgccgtaccggtttttgttaatccgcaacagcaaccctgtcgccgtcattaccgcgaaagcgggaatccagtccgttcagtttcggtcatttccgataaattcctgctgcttttcatttctagattcccactttcgcgggaattacggcggaagggttttggttttttccgataaattcttgaggcat

SEQ ID NO: 1888 - protein, 79 aa, Neisseria gonorrhoeae
VLQHLRESFPLSRGGATPYRFLLIRNSNPVAVITAKAGIQSVQFRSFPINSCCFSFLDSHFRGNYGGRVLVFSDKFLRH

SEQ ID NO: 1889 - DNA, 1296 bp, Neisseria gonorrhoeae
atgccgtctgaaaccgccctccccctttatgcggacacgcgcgccgcgcacacgctcgtctggttccgccaaaacctccgcatccgcgacaacgccgccttatgcgccgccgttgccgaaggttcgcccgttatcggcatttggattgacgatgccgaaacagacaacccgcgccgcgccgcgttctaccgccaatccgccgccgaactcgcccaagggctggcaaggcgcggcatcccgctctacacggcggcatcgcctgccgggcttgtccggctcgccgtccgcctcaatatccgcgccgtcatcgccgacgaatcccatacttttgccgacaaactcgccgacaacgccctttggcacgaattggacaaacacggcatcgcgttaaccttcgtcaacgaccgttccgttttcggcaaaaccgacctgacaccagacaacggtacggcacacaccgatttcaaccgctaccgcgaagtatggctcgaccgcttttccaagcagccccccgccggttcggacctattcgcggcataccgccaacccttccccgaaaacctgcccgccccgccgcctgccgcgctttcagacggcatcttcctgccgcaaaacggcggcgaaacggcggcttggcggcagtggcggcggtttctcgaacaggcggcttcctactccgttttaaaggatttcccttcgcgcaaaaacacttcgctgatgggcgcgtatttgagtgtcggctgcatctcgccgcgcctgctcgcgcgggaaagcctcgaacgccgtctgaacgcgtgggcggacaacatcatccgccgcgattttttccttcaacttgccttgcagcacgcggatgacgacccttcagacggcaatccggaacacaccctgcgcctgacgctttggcagcagggccggaccggcattccgattatcgatgccgcgatgcgctgtttgcacaaaaccggcagcctccaccccgccctgagacgcttgagcgcggattttttctgccacgttttaaacctcccccgccgcgaaggcgagatatggtttgcccggcagctgaccgatttcgatgcggcaatcaaccaaggcaactggcggcttgccgcctcacggcacacctgccccgacattgccgccgcctcataccgtaccgacccggacggtacttttatcaaacggcacattcccgaactcgcccacctgtccgccgacaccgtccacacgccttggcggtttgcctgttcggtcgatacccacggctatcccgcccgccccgtcgccggcgta

SEQ ID NO: 1890 - protein, 432 aa, Neisseria gonorrhoeae
MPSETALPLYADTRAAHTLVWFRQNLRIRDNAALCAAVAEGSPVIGIWIDDAETDNPRRAAFYRQSAAELAQGLARRGIPLYTAASPAGLVRLAVRLNIRAVIADESHTFADKLADNALWHELDKHGIALTFVNDRSVFGKTDLTPDNGTAHTDFNRYREVWLDRFSKQPPAGSDLFAAYRQPFPENLPAPPPAALSDGIFLPQNGGETAAWRQWRRFLEQAASYSVLKDFPSRKNTSLMGAYLSVGCISPRLLARESLERRLNAWADNIIRRDFFLQLALQHADDDPSDGNPEHTLRLTLWQQGRTGIPIIDAAMRCLHKTGSLHPALRRLSADFFCHVLNLPRREGEIWFARQLTDFDAAINQGNWRLAASRHTCPDIAAASYRTDPDGTFIKRHIPELAHLSADTVHTPWRFACSVDTHGYPARPVAGV

SEQ ID NO: 1891 - DNA, 150 bp, Neisseria gonorrhoeae
atgaaacccggttttttcggacatatttttttgaccgtattaagcattgcctatcccgctttgtggtatagtggattaaatttaaaccggtacggcgttgcctcgccttgccgtactatttgtactgtctgcggcttcgccgccttgtcc

SEQ ID NO: 1892 - protein, 50 aa, Neisseria gonorrhoeae
MKPGFFGHIFLTVLSIAYPALWYSGLNLNRYGVASPCRTICTVCGFAALS

SEQ ID NO: 1893 - DNA, 186 bp, Neisseria gonorrhoeae
ttgcagggatttatccggaataacgacaacctgtccgccgtcatttccgcgcagatggaaatttggaaattcaaaatcacaggaatttatccggaatatagcggattaacaaaaatcaggacaaggcggcgaagccgcaggcagtacaaatggtacggaaccggttcgcctggtgcttcagcacct

SEQ ID NO: 1894 - protein, 62 aa, Neisseria gonorrhoeae
LQGFIRNNDNLSAVISAQMEIWKFKITGIYPEYSGLTKIRTRRRSRRQYKWYGTGSPGASAP

SEQ ID NO: 1895 - DNA, 102 bp, Neisseria gonorrhoeae
atgtgttgccgcgcgggtttgacgcacgatgatgactttccatcatcattctccgcgaaagcgggcatccggttattccatattgcagggatttatccggaa

SEQ ID NO: 1896 - protein, 34 aa, Neisseria gonorrhoeae
MCCRAGLTHDDDFPSSFSAKAGIRLFHIAGIYPE

SEQ ID NO: 1897 - DNA, 1077 bp, Neisseria gonorrhoeae
atgaaaacactgaccgtacacacgccttcgcacagctaccccatctttatcggcaacgggctgctgccgcaggcgggaagcctgctcaaaccgcatttgggcaaacgcgccgccatcatcaccaacgaaaccgtcgccccgctctacctcggcacgcttcagacggcattggatgcggcaggcgtatcccatttcagcatcatcctgcccgacggcgaggcgcacaaaaactggcagacgctcaacctcatctttgacgggctgatgcaaaaccgcgccgaacgtaaaaccacgctgattgcgctgggcggcggcgtgatcggcgacatggtcggctttgccgccgccacctaccagcgcggcgcgccgttcatccaaataccgaccacgctgttgagtcaggtcgactcatcggtgggcggaaaaaccgccatcaaccacccgctcggcaaaaatatgatcggcgcgttttaccagccgcaggcggtgcttgcagatttggacacgctgcacaccctgcccgcccgcgaactgtccgccggtatggcggaagtcatcaaatacggcgcgctcggcgacatcggcttttttgaatggctggaacagcatatgcccgaactgatggcactcgaacgcgcgcccctcacccaagccgtgtaccgctgctgccaaatgaaggcagacatcgtcgcccaagacgaaaccgaacagggcatacgcgcatggctcaacctcggacacaccttcggacacgccgtcgaagcggaaatgggttacggcgtatggctgcacggcgaggccgttgccgccggctgcgtgttggcggcgcgtttgtccgaacaactgggcaaaacctccgccgcagataccgcgcggctcgccgccctgctcgaagccgccggactgccgtccgcaccgcccgtgtttgcctttgaaaaatggctggcacatatgagccacgacaaaaaagtcagcggcggcatcatgcgctttatcggtctgaaccggctgggcgaagccgtcatcaccgaaattaccgacacggacatcctccggcgcaccctgcaaccgtatctc

SEQ ID NO: 1898 - protein, 359 aa, Neisseria gonorrhoeae
MKTLTVHTPSHSYPIFIGNGLLPQAGSLLKPHLGKRAAIITNETVAPLYLGTLQTALDAAGVSHFSIILPDGEAHKNWQTLNLIFDGLMQNRAERKTTLIALGGGVIGDMVGFAAATYQRGAPFIQIPTTLLSQVDSSVGGKTAINHPLGKNMIGAFYQPQAVLADLDTLHTLPARELSAGMAEVIKYGALGDIGFFEWLEQHMPELMALERAPLTQAVYRCCQMKADIVAQDETEQGIRAWLNLGHTFGHAVEAEMGYGVWLHGEAVAAGCVLAARLSEQLGKTSAADTARLAALLEAAGLPSAPPVFAFEKWLAHMSHDKKVSGGIMRFIGLNRLGEAVITEITDTDILRRTLQPYL

SEQ ID NO: 1899 - DNA, 513 bp, Neisseria gonorrhoeae
gtgatgaaaaactttaacggcaaactcatcctcatcggactgatgggcgcgggcaaaactacgctgggccggcaaatggcgcagcggctggattaccgtttttacgacagcgatcacgaaatcgccgcagcggcgggcgttcccatccccaccatatttgaaatggaaggcgaacagggattccgttcgcgcgaaaccgccatactcaaaaaactgattgtcctgccgcatatcgtcctgtccaccggcggcggcgcggtgttaaaagaagaaaaccgcgcccttatccgcaaaagcggcacggtcgtttatctgcacgccccgcccgaaaccctgctcgaacgcacgcgctgcgacaacagccgccctttgctgcaagttgccgatcctttggcgaaattgcgcgaactctacgccgcacgcgaccccgtttaccgccaaaccgccgactttaccgtagaatcggcaaactgccgggaaaccgtgcaaaccctgctcaaacgcttatcccga

SEQ ID NO: 1900 - protein, 171 aa, Neisseria gonorrhoeae
VMKNFNGKLILIGLMGAGKTTLGRQMAQRLDYRFYDSDHEIAAAAGVPIPTIFEMEGEQGFRSRETAILKKLIVLPHIVLSTGGGAVLKEENRALIRKSGTVVYLHAPPETLLERTRCDNSRPLLQVADPLAKLRELYAARDPVYRQTADFTVESANCRETVQTLLKRLSR

SEQ ID NO: 1901 - DNA, 141 bp, Neisseria gonorrhoeae
atgtttgacccccccgcctttcggggcggcagggttcgggcttgtcgggttacggcgggattttatacgaaatcggcagggcggcggtacgtttggaaaaataacccgaccatcccgaacttttctgattttaaggaaaaa

SEQ ID NO: 1902 - protein, 47 aa, Neisseria gonorrhoeae
MFDPPAFRGGRVRACRVTAGFYTKSAGRRYVWKNNPTIPNFSDFKEK

SEQ ID NO: 1903 - DNA, 99 bp, Neisseria gonorrhoeae
ttgttaatccgctatagtattgataaacatattatcttcaatatattcaattggataattgtttacctaagcaaagataattgccttttcctgacaaat

SEQ ID NO: 1904 - protein, 33 aa, Neisseria gonorrhoeae
LLIRYSIDKHIIFNIFNWIIVYLSKDNCLFLTN

SEQ ID NO: 1905 - DNA, 207 bp, Neisseria gonorrhoeae
atgaggcaagaatttatcggaaaaaaaccgaagtttaaagacctagattcccgcctgctcgggaatgacggggtgtttcgggttgctgttttttgtggaaatgacgaggctttggattgcgaggatttatcccttccgccgtcattcccacaaaagtgggaatctagaaatgaaaagcaacaggaatttatcggaaatgaccgaaac

SEQ ID NO: 1906 - protein, 69 aa, Neisseria gonorrhoeae
MRQEFIGKKPKFKDLDSRLLGNDGVFRVAVFCGNDEALDCEDLSLPPSFPQKWESRNEKQQEFIGNDRN

SEQ ID NO: 1907 - DNA, 279 bp, Neisseria gonorrhoeae
gtgcggacgtgttcggatttccgcctgcgcgggaatgacgattcgggtattactgacgattcatcgggccgtagggtgggcttcagcccactaatttcaccgcatcaagggttttggggaataggcgtaactcggcggtttcggtttttggcgaagttggttggaatcggcgggctgaagcacaccctacagtccaccctacaacccatcttacgcatccgccttacgcatttatccttcgcctgccgatatgccgtcattcccgcacaggcgggaatc

SEQ ID NO: 1908 - protein, 93 aa, Neisseria gonorrhoeae
VRTCSDFRLRGNDDSGITDDSSGRRVGFSPLISPHQGFWGIGVTRRFRFLAKLVGIGGLKHTLQSTLQPILRIRLTHLSFACRYAVIPAQAGI

SEQ ID NO: 1909 - DNA, 105 bp, Neisseria gonorrhoeae
ttgagccgtcattcccgcgaaatcggaaatccagtccgttcagtttcggtcatttccgataaattcctgttgcttttcatttctagattcccacttttgtgggaa

SEQ ID NO: 1910 - protein, 35 aa, Neisseria gonorrhoeae
LSRHSREIGNPVRSVSVISDKFLLLFISRFPLLWE

SEQ ID NO: 1911 - DNA, 120 bp, Neisseria gonorrhoeae
atgacggctcaaaagttacgagacgaaaaacaaccgaaaccggacaagttggattcccgcctgcgcgggaatgacggcatttcggtcgcggcaaaaagcataaagaaagggcatatgctg

SEQ ID NO: 1912 - protein, 40 aa, Neisseria gonorrhoeae
MTAQKLRDEKQPKPDKLDSRLRGNDGISVAAKSIKKGHML

SEQ ID NO: 1913 - DNA, 117 bp, Neisseria gonorrhoeae
atgttttacagcatatgccctttctttatgctttttgccgcgaccgaaatgccgtcattcccgcgcaggcgggaatccaacttgtccggtttcggttgtttttcgtctcgtaacttt

SEQ ID NO: 1914 - protein, 39 aa, Neisseria gonorrhoeae
MFYSICPFFMLFAATEMPSFPRRRESNLSGFGCFSSRNF

SEQ ID NO: 1915 - DNA, 2169 bp, Neisseria gonorrhoeae
atgaataccaaactgacaaaaatcatttccggtctctttgtcgcaaccgccgcctttcagacggcatcggcaggaaacattacagacatcaaagtttcctccctgcccaacaaacagaaaatcgtcaaagtcagctttgacaaagagattgtcaacccgaccggcttcgtaacctcctcaccggcccgcatcgccttggactttgaacaaaccggcatttccatggatcaacaggtactcgaatatgccgatcctctgttgagcaaaatcagtgccgcacaaaacagcagccgtgcgcgtctggttctgaatttgaacaaaccgggccaatacaataccgaagtacgcgggaacaaagtttggatattcattaacgaatcggacgataccgtgtccgcccccgcccgcccagccgtaaaagccgcgcctgccgcaccggcaaaacaacaggctgccgcaccgtttaccgagtccgtagtatccgtatccgcaccgttcagcccggcaaaacaacaggcagcggcatcggcaaaacaaaccaatatcgatttccgcaaagacggcaaaaatgccggcattatcgaattggcggcattgggctttgccgggcagcccgacatcagccaacagcacgaccacatcatcgttacgctgaaaaaccataccctgccgaccgcgctccaacgcagtttggatgtggcagacttcaaaacaccggttcaaaaggttacgctgaaacgcctcaataacgacacccagctgattatcacaacaaccggcaactgggaactcgtcaacaaatccgccgcgcccggatactttaccttccaagtcctgccgaaaaaacaaaacctcgagtcaggcggcgtgaacaatgcgcccaaaaccttcacaggccggaaaatctcccttgacttccaagatgtcgaaatccgcaccatcctgcagattttggcaaaagaatccgggatgaacattgttgccagcgactccgtcagcggcaaaatgaccctctccctcaaagacgtaccttgggatcaggctttggatttggttatgcaggcgcgcaacctcgatatgcgccagcaagggaacatcgtcaacatcgcgccccgcgacgagctgcttgccaaagacaaagccttcttacaagcggaaaaagacattgccgatctgggcgcgctgtattcccaaaacttccaattgaaatacaaaaatgtggaagaattccgcagcatcctgcgtttggacaatgccgacacgaccggaaaccgcaacacgcttgtcagcggcaggggcagcgtgctgatcgatcccgccaccaacaccctgattgttaccgatacccgcagcgtcatcgaaaaattccgcaaactgattgacgaattggacgtacccgcgcaacaagtgatgattgaggcgcgtatcgtcgaagcggcagacggcttctcgcgcgatttgggcgttaagttcggcgcgacaggcaggaaaaaactgaaaaatgagacgagcgcattcggctggggcgtgaactccggcttcgggggcggcgataaatgggaggcccaaaccaaaatcaacctgccggttgccgctgccgcaaacagcatttcgctggtgcgcgcgatttcctccggcgcgttgaatttggaattgtccgcatccgagtcgctttcaaaaaccaaaacgcttgccaatccgcgcgtgctgacccaaaaccgcaaagaggccaaaatcgaatccggttacgaaattccttttaccgtaactacagcctcgggcggcggcaactctaccaacacggaactcaaaaaagccgtcttggggctgaccgttacgccgaacatcacgcccgacggacaaatcatcatgaccgtcaaaatcaacaaagactcgcctgcacaatgtgcttcaggcaacaacacaatcctatgtatttcgaccaaaagcctgaatacgcaggctatggttgaaaacggcggcactttgattgtcggcggtatttatgaagaaaacaacggcaatacgctgaccaaagtccccctgttgggcgacatccccgttatcggcaacctctttaaaacacgcgggaaaaaaaccgaccgccgcgaactgctgattttcattaccccgaggattatagatacggccggcaacagcctgcgctat

SEQ ID NO: 1916 - protein, 723 aa, Neisseria gonorrhoeae
MNTKLTKIISGLFVATAAFQTASAGNITDIKVSSLPNKQKIVKVSFDKEIVNPTGFVTSSPARIALDFEQTGISMDQQVLEYADPLLSKISAAQNSSRARLVLNLNKPGQYNTEVRGNKVWIFINESDDTVSAPARPAVKAAPAAPAKQQAAAPFTESVVSVSAPFSPAKQQAAASAKQTNIDFRKDGKNAGIIELAALGFAGQPDISQQHDHIIVTLKNHTLPTALQRSLDVADFKTPVQKVTLKRLNNDTQLIITTTGNWELVNKSAAPGYFTFQVLPKKQNLESGGVNNAPKTFTGRKISLDFQDVEIRTILQILAKESGMNIVASDSVSGKMTLSLKDVPWDQALDLVMQARNLDMRQQGNIVNIAPRDELLAKDKAFLQAEKDIADLGALYSQNFQLKYKNVEEFRSILRLDNADTTGNRNTLVSGRGSVLIDPATNTLIVTDTRSVIEKFRKLIDELDVPAQQVMIEARIVEAADGFSRDLGVKFGATGRKKLKNETSAFGWGVNSGFGGGDKWEAQTKINLPVAAAANSISLVRAISSGALNLELSASESLSKTKTLANPRVLTQNRKEAKIESGYEIPFTVTTASGGGNSTNTELKKAVLGLTVTPNITPDGQIIMTVKINKDSPAQCASGNNTILCISTKSLNTQAMVENGGTLIVGGIYEENNGNTLTKVPLLGDIPVIGNLFKTRGKKTDRRELLIFITPRIIDTAGNSLRY

SEQ ID NO: 1917 - DNA, 543 bp, Neisseria gonorrhoeae
atgaaacactatgccttactcatcagctttctggctctctccgcgtgttcccaaaattctgaagacctaaacgaatggatggcacaaacgcgacgcgaagccaaagcagaaatcatacctttccaagcacctaccctgccggttgcgccggtatacagcccgccgcagcttacagggccgaacgcattcgacttccgccgcatggaaacggccaaaaaaggggaaaatgcccccgacaccaagcgtattaaagaaacgctggaaaaattcagtttggaaaatatgcgttatgtcggcattttgaagtccggacagaaagtctccggcttcatcgaggctgaaggttatgtctacactgtcggtgtcggcaactatttgggacaaaactacggtagaatcgaaagcattaccgacgacagcatcatcctgaacgagctgatagaagacagcacgggcaactgggtttcccgtaaagcagaactgctgttgaattcttccgacaaaaacaccgaacaagcggcagcacctgccgcagaacaaaat

SEQ ID NO: 1918 - protein, 181 aa, Neisseria gonorrhoeae
MKHYALLISFLALSACSQNSEDLNEWMAQTRREAKAEIIPFQAPTLPVAPVYSPPQLTGPNAFDFRRMETAKKGENAPDTKRIKETLEKFSLENMRYVGILKSGQKVSGFIEAEGYVYTVGVGNYLGQNYGRIESITDDSIILNELIEDSTGNWVSRKAELLLNSSDKNTEQAAAPAAEQN

SEQ ID NO: 1919 - DNA, 645 bp, Neisseria gonorrhoeae
atggcttctaaatcatctaaaaccaacttggatctcaacaaccttcacctgctcaaccttcctgccaggctttttatcgccctgctggtcgttgccgccgtgctggggctcggttatgccggattgttcaaaagccagatggaatcccttgaggaatatgaagcaaaagaaaccgaactgaaaaacacctacaaacagaaaagtatcgacgcggccagcctgaacaaccttagggacgaacttgcctcaatccgctctaccttcgatatcatgttgaaacagctgccgacagatgcagaaattcccaatttggttcaagagcttcatcaggcgggttcgagcaacggtctgcgcttggacagcgttatgccccaacctcccgtagatgacggtcccatcaaaaaattaccctattccatttccattaccggaaattacgaacagatcagccaatttacccgcgatgtcggcagtctctcccgaatcattacccttgagtcgctgaaaatcgcccaatctccggaaaacggcggcaatcctgacggcaagagcagtatcctgaacctcagcgccattgccaccacctaccaagcaaaatccgtagaagagcttgccgcagaagcggcacaaaatgccgagcaaaaa

SEQ ID NO: 1920 - protein, 215 aa, Neisseria gonorrhoeae
MASKSSKTNLDLNNLHLLNLPARLFIALLVVAAVLGLGYAGLFKSQMESLEEYEAKETELKNTYKQKSIDAASLNNLRDELASIRSTFDIMLKQLPTDAEIPNLVQELHQAGSSNGLRLDSVMPQPPVDDGPIKKLPYSISITGNYEQISQFTRDVGSLSRIITLESLKIAQSPENGGNPDGKSSILNLSAIATTYQAKSVEELAAEAAQNAEQK

SEQ ID NO: 1921 - DNA, 96 bp, Neisseria gonorrhoeae
atggttgtggcagcccgcaagctgcaggctgaagatttccgcaatgtccgcaccgtcaacgacgtggtacaggcggtattgaagattcaggccggc

SEQ ID NO: 1922 - protein, 32 aa, Neisseria gonorrhoeae
MVVAARKLQAEDFRNVRTVNDVVQAVLKIQAG

SEQ ID NO: 1923 - DNA, 597 bp, Neisseria gonorrhoeae
atgaacaatttaatcaaaatcaacctcctcccctacagggaagagatgaacaaacgcaaacagcagcagtttaaaacgctgatgtacggcgccgtgctgacgggcgttgccgccgttgcggcaacctacctgtttatcgacaatatgatcaataaacagtcggaaaaaaacacgctgctggaaatctccatcgcacacttggataccgagctgtcggaaatacaaaagctcaaacaggaaaaagatgccttcctgattaagaaaaacaaaatcgaggagctccagatcaaacgcctccaagccgcaaaaatcctcgacagcctgaatgaggccgtccccggaagcacctacctaacctcgctggatgccgttaccgccgactcttatcggctcagcggcaggacatccagcgacaaccgcgttgccgccatgatgagggcgatgcccaataccggcatattcaagcaacccgaattgttaagcatcaagaaaaacaattcgcatcaagaatttacccttcaggcaacattacaacctatcgtaaaggcggccgaatccaaagagaatccggcttcgggaaacgcacaggaggcaaac

SEQ ID NO: 1924 - protein, 199 aa, Neisseria gonorrhoeae
MNNLIKINLLPYREEMNKRKQQQFKTLMYGAVLTGVAAVAATYLFIDNMINKQSEKNTLLEISIAHLDTELSEIQKLKQEKDAFLIKKNKIEELQIKRLQAAKILDSLNEAVPGSTYLTSLDAVTADSYRLSGRTSSDNRVAAMMRAMPNTGIFKQPELLSIKKNNSHQEFTLQATLQPIVKAAESKENPASGNAQEAN

SEQ ID NO: 1925 - DNA, 1113 bp, Neisseria gonorrhoeae
atgcgcttgtttaaaagcttgaaaaaccctaaaaaaacagatgccaagctccctaaaaaatcttcgggactcaataaccgcgcggcaatcggcatcgatatcgaccagcattccatcaaaatggtacaattgtcaggacgtagtttaaaccaaattcaattggaaaaatacgtcattgccaaattaccaaagaatatcattcaaggcaataaagtccaaaattacgatcaacttgttacatatttgcaacaagcctatgccaaactgggtacttcgtgcaaaaacatcgtcgcgtccgtcccgcaaaatctggcaaccatcgaacaattgacctacacggccaaagatgcagaattggacctgcaggggttcgtggagtcctccatctccgaagccagctcgatatcgctcgaagaagccaattacgactatcaggtcttgtcccaatcggccgtcggcgaagctgttttgtccgtcgcatcgagaaaggatgaaatcgaacccctgattgacgcattcaacgcagccggtatgaaattatccgcgcttgatgtggacattttcggacaatacaacgcctacgcgctgtggataaaccattttgcccccgagcttgcggacgaaaaagtggccattttcggcgtatatgccgcacagacctacgccctggtcatccaagacggaaaaatcctatacaaacaggaaacctccgtcagcgaagaacagctcaaccaactcatccagcgcacctatcaggtaacagcagaaaaagcggaagagatcatcaactccccgcaaaaaccttccgattaccaagaaagcgtggcaaactatttcaaccagcagattacccaagaaatacaaagggtcttgcagttttattacaccacgcagaccgcagacgatatgaccgacatcaagcatatcctgctgacgggggaagcggtgcgccagaaaggcatcgcccaaaccgtcgcctcgcaaaccaatgcggatgtacaatgcgtccatcccgcgcgttattttgcgaacgacctcaaaacagacgaacaacaattcgaacttgatgcgccgacactgaccaaggcgttcggtttggcggtacggggatta

SEQ ID NO: 1926 - protein, 371 aa, Neisseria gonorrhoeae
MRLFKSLKNPKKTDAKLPKKSSGLNNRAAIGIDIDQHSIKMVQLSGRSLNQIQLEKYVIAKLPKNIIQGNKVQNYDQLVTYLQQAYAKLGTSCKNIVASVPQNLATIEQLTYTAKDAELDLQGFVESSISEASSISLEEANYDYQVLSQSAVGEAVLSVASRKDEIEPLIDAFNAAGMKLSALDVDIFGQYNAYALWINHFAPELADEKVAIFGVYAAQTYALVIQDGKILYKQETSVSEEQLNQLIQRTYQVTAEKAEEIINSPQKPSDYQESVANYFNQQITQEIQRVLQFYYTTQTADDMTDIKHILLTGEAVRQKGIAQTVASQTNADVQCVHPARYFANDLKTDEQQFELDAPTLTKAFGLAVRGL

SEQ ID NO: 1927 - DNA, 129 bp, Neisseria gonorrhoeae
gtgagtaaccgtttcggtatccgtaatggattccttgttctttgcacattgaaaccgtgctttgtagaaatcggttgctattttactttatttaataccaataatggtaaattattattcagctatgat

SEQ ID NO: 1928 - protein, 43 aa, Neisseria gonorrhoeae
VSNRFGIRNGFLVLCTLKPCFVEIGCYFTLFNTNNGKLLFSYD

SEQ ID NO: 1929 - DNA, 2415 bp, Neisseria gonorrhoeae
atggtaaattattattcagctatgattaaaaagattttaactacttgttttggtttgttttttggtttttgtgtatttggagtgggtctggttgccattgctattttggtaacgtatccgaaactgccgtctttggattctttgcagcattaccagcctaaaatgccgttgactatttattcggcggatggagaagtcatcggtatgtatggggagcagcggcgcgaatttacaaaaatcggcgatttccccgaggtgttgcggaatgcggttattgccgccgaggataaacgcttttaccggcattggggggtggatgtttggggtgttgcccgcgctgccgtcggcaatgtcgtgtccggcagcgtgcagtcgggtgcgagtacgattacacagcaggtggcgaaaaatttttatttgagcagtgaaaaaacgttcacacgcaaattcaatgaggtgttgcttgcctataaaatcgagcagtctttaagcaaagacaaaatccttgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccggagcgtgccaagttgcgccagaagtatattttgaacaatatgctcgaggagaagatgattaccgtgcaacagcgcgatcaggcattgaatgaggaactgcattatgagcggtttgttcggaaaatcgatcagagtgctttatatgtggcggaaatggtgcgtcgggaactgtatgagaaatatggtgaagatgcctatacgcagggttttaaggtttataccacggtccgcaccgatcatcagaaggcggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgttactaaaaagaaaaatgtcgtcatacagctgcccggcggcaggcgggttgcgcttgacaggcgcgccttgggttttgcggcccgagcggtcgataatgagaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggccgtccgagctgccggcaagcctgtctatggctttaggtacgggcgagacgacgccgttgaaagtggcggaggcatatagtgtatttgcgaacggcggatatagggtttcttcgcacgtgatcgataagatttatgacagagacggcaggttgcgcgcccaaatgcaacctttggtggcagggcaaaatgcgcctcaggcaatcgatccgcgcaatgcctatattatgtataagattatgcaggatgtggtccgtgtcggtacggcaaggggggcagctgcgttgggaagaacggatattgccggtaaaacgggtacgaccaacgacaataaagatgcgtggtttgtcggttttaaccctgatgtggttactgccgtatatatcggcttcgacaaacctaagagtatggggcgtgccggctacggcggtacgattgcggtgccggtttgggtggactatatgcgttttgcgttgaaaggaaagcagggcaaagggatgaaaatgcctgaaggtgtggtcagcagcaatggcgaatactatatgaaggaacgtatggtaaccgatccgggcttgatgctggacaacagcggtattgcgccgcaaccttcccgacgggcaaaagaagatgatgaagcggcagtagaaaacgaacagcagggaaggtctgacgaaacgcgtcaggacgtacaggaaacgccggtgcttccgagcaatacggattccaaacagcagcagttggattccctgttt

SEQ ID NO: 1930 - protein, 805 aa, Neisseria gonorrhoeae
MVNYYSAMIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQLDSLF

SEQ ID NO: 1931 - DNA, 627 bp, Neisseria gonorrhoeae
atgaacctttttcaaaacgccaaattcttcacgacggtaaaccatctcaaagacctgccggacacaccgctcgaaattgccttcgtcggcaggagcaatgccggaaaatccagtgccatcaataccctgaccaaccatgtccgtcttgcctacgtttcaaaaacaccgggacggacacagcatatcaacttcttcgagctgcagaacggcaattttatggtcgatttgcccggctacggttatgcccaagtccccgaagcggtacgcgcacattgggtcaatctgctcggcgactacctccgccatcggaaacagcttatcgggctggttttgattatggatgcccgccatcctttaaaagaactcgacatccgtatgctggactttttccacacgaccggcagaccggttcacatcctgctgtcaaaagccgacaaattatccaaaaacgaacagataaaaaccctgtcccaagtcaaaaaactgctcaaaccttattccgacaggcaaaacatcagcgtacagctgttttccagcctgaaaaaacaaggtattgacgaggccaaccgaactgtcggaagctggtttgacgcagcagatgccgccgcttcctctccagaggaaaac

SEQ ID NO: 1932 - protein, 209 aa, Neisseria gonorrhoeae
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 1933 - DNA, 90 bp, Neisseria gonorrhoeae
ttgaaaaaggttcatgggcatatccttgttttccgccgccgtttgtccgacagcaaaaatatgcggttggttttatgtgaaacacagtgg

SEQ ID NO: 1934 - protein, 30 aa, Neisseria gonorrhoeae
LKKVHGHILVFRRRLSDSKNMRLVLCETQW

SEQ ID NO: 1935 - DNA, 2232 bp, Neisseria gonorrhoeae
atgcccgaaccaccgtccgacaacgataccgtaccgcatccgcgcaatgttaaaatgaccccaaatcatccgcccaccgatactatgctcaccgatttagaaaaaaacgccatccgcgaccattaccaaaatatcggcaaaaacctgcccggtttccgtccgcgtgcttcgcagcgggaaatgattgcggcggttgccaacgctttttcgcggacgttgacgcgcgaagaaggcggcgagccgcccaagcgcgagggcgaaagcattgccgtaatcgaagggccgaccggcgtgggcaaatcgcttgcctacctgcttgcgggcggcatcatggcgcaaacacgcggcaagcggctgattgtgagcagcgcgacggttgccttgcaggagcagttggtagaccgcgacctgccgtttctggtcgaaaaaagcggtttggaactgaccttcgcacttgccaaagggcgcggccgctatctctgcccctacaaactctatcaactgacgcaaagcaacgcccagcaaaacctgctcggctttgaagcccccgccgtcttgtgggacagcaaacccaagccggaagaattgaagctgctgcgcgacatcgccgacgaattttccgcccgacggttcaacggcgaccgcgacgcttggccggaaaaaatcgatgacgcgatttggctcaaagtgaccaacgaccgccacggctgcctgaaagccgcctgtcccaaccgtccggaatgccctttttacctggcacgcgatatgttggaaaccgtcgatgtcgttgttgccaaccacgatcttctgcttgccgacatcagcatgggcggcggcgtgattctgcctgcgcccgaaaacagtttctattgcatagacgaagcgcaccacctgcccaaaaaagccctcagccgttttgccgccgaacattcatggaatattgccgtttggacgctggaaaaactgccgcagcttaccggcaaaattgccgcgcttaccgataaagccgaacttgccaaccttgccgacgaagccgccgcatccttgctcgacagcctgcacgaatggcaattccatttggcggaagagccgtctttaagtatggggctgtctgaaaacgacagacgaaccaacagcgaaccgacttggctgtgggaagacggcaaaatccccgaaggcctcgaaaccaccgtttccaatacggccattgctgcacgcagcctgctcaaacacgttgtcgggctgaacgatgcgctttccgccgcacgccgcgaaaaagaacaggacggtgcgctcatcgaccgcctgaccggcgagttcggcctttttatcgcccgtatcgaacaaatcagtgcggtttgggatttgctctccactgtttccattgagggcgaggagccgttggcgaaatggatagcccgccgtgccgacgacaaaaacgactatattttcaatgccagccccatcagcagcgcgtcccaccttgccaacagcctgtggcggcgcgcggcaggcgcggtgctgacttcggccaccctgcaatcgctcggcagcttcaacttgattttgcgccaaaccggcctgctgtggctgcccgaaaccaccaccctcgccctcaaaagcccctttgactttgaaaaacagggcgaactctacatcccctccatatacgccagccccaaagaccccgaagcccacaccgccgccgtcatcgaatggctgcccaagctgatttcgcccaccgaagccatcggcacactcgtcctgttttcctcgcgcaaacaaatgcaggatgtcgccctgcacctgcccggagactacctgccgctcttgctcgtacaaggcgaattacccaaagccgtcctcctgcaaaaacaccaccaagccatagaagaaggcaaagccagcatcatcttcggactcgacagcttcgccgaagggctcgacctgcccggcaccgcctgcgtgcaagtcatcatcgccaaactccccttcgccatgcccgacaaccccatcgaaaaaacccaaaaccgttggatagaacaacgcggcggcaaccccttcatcgaaatcaccgtccccgaagccggcatcaaactcatccaggccgtcggccgcctcatccgcaccgaacaagactacggccgcgtaaccatcctcgacaaccgcatcaaaacgcagcggtacggccaacaattattggccggcctgccaccgtttaaaaggataggg

SEQ ID NO: 1936 - protein, 744 aa, Neisseria gonorrhoeae
MPEPPSDNDTVPHPRNVKMTPNHPPTDTMLTDLEKNAIRDHYQNIGKNLPGFRPRASQREMIAAVANAFSRTLTREEGGEPPKREGESIAVIEGPTGVGKSLAYLLAGGIMAQTRGKRLIVSSATVALQEQLVDRDLPFLVEKSGLELTFALAKGRGRYLCPYKLYQLTQSNAQQNLLGFEAPAVLWDSKPKPEELKLLRDIADEFSARRFNGDRDAWPEKIDDAIWLKVTNDRHGCLKAACPNRPECPFYLARDMLETVDVVVANHDLLLADISMGGGVILPAPENSFYCIDEAHHLPKKALSRFAAEHSWNIAVWTLEKLPQLTGKIAALTDKAELANLADEAAASLLDSLHEWQFHLAEEPSLSMGLSENDRRTNSEPTWLWEDGKIPEGLETTVSNTAIAARSLLKHVVGLNDALSAARREKEQDGALIDRLTGEFGLFIARIEQISAVWDLLSTVSIEGEEPLAKWIARRADDKNDYIFNASPISSASHLANSLWRRAAGAVLTSATLQSLGSFNLILRQTGLLWLPETTTLALKSPFDFEKQGELYIPSIYASPKDPEAHTAAVIEWLPKLISPTEAIGTLVLFSSRKQMQDVALHLPGDYLPLLLVQGELPKAVLLQKHHQAIEEGKASIIFGLDSFAEGLDLPGTACVQVIIAKLPFAMPDNPIEKTQNRWIEQRGGNPFIEITVPEAGIKLIQAVGRLIRTEQDYGRVTILDNRIKTQRYGQQLLAGLPPFKRIG

SEQ ID NO: 1937 - DNA, 747 bp, Neisseria gonorrhoeae
atgcgcgatatggcccagtggaggcagtgggcggaatgtccggattttgccgacggtttgcccgatgtcaggcgggaattgccgttcctgcccgctatgcggcgccgccgtttgagtaaggcggcgcgtttggtatgcgacgcggcttgggacattgcctccgcccatcccggcagtccggtagtttatgcctcgcacgacggggaaatggcgcgtagtttcgatttgtggttggaactgttgaaatcgcataccgtgtcgccgacttcgttcggtttgtcggtgcacaatgcgacggcggggcaatggtcgatattgaggcgggatatgagcgagcagacggcattggccgtgtgtgccgacggtgtggaaacggcattggcggaagcggcgtccctgttggaagagggatgcgggtcggttttggttttggcggcggacgatccgctgccggaaggatatgccgtatcggcaacgcgcgcgccgtttgcttatgctttggcgatggttctgaccaaagggacgcgttacagcctgactttgtctgcttcggacgatatgccgtctgaagccggtatgctgcccgaggcatattggagcggtttggaatgggtgcgttttctgctgaacggcagtcgggaatgccgccgggtatatcgcaatcgtgaatggttgtggcagcccgcaagctgcaggctgaagatttccgcaatgtccgcaccgtcaacgacgtggtacaggcggtat

SEQ ID NO: 1938 - protein, 249 aa, Neisseria gonorrhoeae
MRDMAQWRQWAECPDFADGLPDVRRELPFLPAMRRRRLSKAARLVCDAAWDIASAHPGSPVVYASHDGEMARSFDLWLELLKSHTVSPTSFGLSVHNATAGQWSILRRDMSEQTALAVCADGVETALAEAASLLEEGCGSVLVLAADDPLPEGYAVSATRAPFAYALAMVLTKGTRYSLTLSASDDMPSEAGMLPEAYWSGLEWVRFLLNGSRECRRVYRNREWLWQPASCRLKISAMSAPSTTWYRRY

SEQ ID NO: 1939 - DNA, 624 bp, Neisseria gonorrhoeae
gtgtttcacataaaaccaaccgcatatttttgctgtcggacaaacggcggcggaaaacaaggatatgcccatgaacctttttcaaaacgccaaattcttcacgacggtaaaccatctcaaagacctgccggacacaccgctcgaaattgccttcgtcggcaggagcaatgccggaaaatccagtgccatcaataccctgaccaaccatgtccgtcttgcctacgtttcaaaaacaccgggacggacacagcatatcaacttcttcgagctgcagaacggcaattttatggtcgatttgcccggctacggttatgcccaagtccccgaagcggtacgcgcacattgggtcaatctgctcggcgactacctccgccatcggaaacagcttatcgggctggttttgattatggatgcccgccatcctttaaaagaactcgacatccgtatgctggactttttccacacgaccggcagaccggttcacatcctgctgtcaaaagccgacaaattatccaaaaacgaacagataaaaaccctgtcccaagtcaaaaaactgctcaaaccttattccgacaggcaaaacatcagcgtacagctgttttccagcctgaaaaaacaaggtat

SEQ ID NO: 1940 - protein, 208 aa, Neisseria gonorrhoeae
VFHIKPTAYFCCRTNGGGKQGYAHEPFSKRQILHDGKPSQRPAGHTARNCLRRQEQCRKIQCHQYPDQPCPSCLRFKNTGTDTAYQLLRAAERQFYGRFARLRLCPSPRSGTRTLGQSARRLPPPSETAYRAGFDYGCPPSFKRTRHPYAGLFPHDRQTGSHPAVKSRQIIQKRTDKNPVPSQKTAQTLFRQAKHQRTAVFQPEKTRY

SEQ ID NO: 1941 - DNA, 171 bp, Neisseria gonorrhoeae
atgctcttttttatattcaaatatgggatttttgacccgattaaaaccgatgattctgtaaacgtgttattctatactaaatttacattaaattaccactgtgtttcacataaaaccaaccgcatatttttgctgtcggacaaacggcggcggaaaacaaggatatgccca

SEQ ID NO: 1942 - protein, 57 aa, Neisseria gonorrhoeae
MLFFIFKYGIFDPIKTDDSVNVLFYTKFTLNYHCVSHKTNRIFLLSDKRRRKTRICP

SEQ ID NO: 1943 - DNA, 621 bp, Neisseria gonorrhoeae
atgagacgattgactttattggcctttgttttggctgccggtgcggtttccgcatctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacggcaaacgcacccacggttcggcagctgtgatgaaaccggtggtaatgaatttgagcgatcaggatattttgaatgtatccgcattctatgccaaacagcagcccaaatccggcgaagccaatcctaaggaaaatcccgaattgggcgcgaaaatctatcgcggcggtttgagcgataaaaaagtgccggcgtgtatgtcctgccacggtccgagcggtgcgggtatgccgggaggcggaagcgaaattcaggcttatccgcgtttgggcggccagcaccaggcatatattgttgaacagatgaatgcctacaagtccggtcagcgtaaaaataccatcatggaagatattgcaaaccgtatgtccgaagaagatttaaaagcagttgctaactttatccagggtttgcgt

SEQ ID NO: 1944 - protein, 207 aa, Neisseria gonorrhoeae
MRRLTLLAFVLAAGAVSASPKADVEKGKQVAATVCAACHAADGNSGIAMYPRLAAQHTAYIYHQTIGIRDGKRTHGSAAVMKPVVMNLSDQDILNVSAFYAKQQPKSGEANPKENPELGAKIYRGGLSDKKVPACMSCHGPSGAGMPGGGSEIQAYPRLGGQHQAYIVEQMNAYKSGQRKNTIMEDIANRMSEEDLKAVANFIQGLR

SEQ ID NO: 1945 - DNA, 201 bp, Neisseria gonorrhoeae
atggagctgaaaaaagcgaaccacggacgggaaagaagtgtgggagatatacgggatttactcattgtgtgtttattccgccatcaggaatatgggaaagcagaattgggcagacagaaaacaacgtcccgattctactgtcttgatgctttttatttcaagacaatgaagacagcctgcatcgattccaacggttgcgat

SEQ ID NO: 1946 - protein, 67 aa, Neisseria gonorrhoeae
MELKKANHGRERSVGDIRDLLIVCLFRHQEYGKAELGRQKTTSRFYCLDAFYFKTMKTACIDSNGCD

SEQ ID NO: 1947 - DNA, 1950 bp, Neisseria gonorrhoeae
atgcgctttgcggtcgctttgctcagtctgctgggtattgcatcggttatcggcacggtgttacagcaaaaccagccgcagacggattatttggtcaaattcggaccgttttggactcggatttttgattttttgggtttgtatgatgtctatgcttcggcatggtttgtcgttatcatgatgtttctggtggtttctaccagtttgtgtttaatccgtaacgttccgccgttttggcgcgaaatgaagtctttccgggaaaaggttaaagaaaaatctctggcggcgatgcgccattcttcgctgttggatgtaaaaattgcccccgaagttgccaaacgttatctggaggtgcggggttttcagggaaaaaccgtcagccgtgaggacgggtcggttctgattgccgccaaaaaaggcacgatgaacaaatggggctatatctttgcccatgttgctttgattgtcatttgcctgggcgggttgatagacagtaacctgctgctgaagctgggtatgctggccggtcggattgttccggacaatcaggcggtttatgccaaggatttcaagcccgaaagtattttgggtgcgtccaatctctcatttaggggcaacgtcaatatttccgaggggcaaagtgcggatgtggttttcctgaatgccgacaacgggatgttggttcaggacttgccttttgaagtcaaactgaaaaaattccatatcgatttttacaatacgggtatgccgcgcgattttgccagcgatattgaagtaacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgagggatgcttcgcgcgaacctgtcgtgttgaaggcaacctccatacaccagtttccgttggaaatcggcaaacacaaatatcgtcttgagttcgatcagttcacttctatgaatgtggaggacatgagcgagggtgcggaacgggaaaaaagcctgaaatccactctgaacgatgtccgcgccgttactcaggaaggtaaaaaatacaccaatatcggcccttccatcgtgtaccgcatccgtgatgcggcagggcaggcggtcgaatataaaaactatatgctgccgattttgcaggacaaagattatttttggctgaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaagacgcacctgccgaaatccgcgaacaattcatgctggctgcggaaaacacgctgaatatctttgcgcaaaaaggctatttgggattggacgaatttattacgtccaatatcccgaaagggcagcaggataagatgcagggctatttctacgaaatgctttacggcgtgatgaacgctgctttggatgaaaccatacgccggtacggcttgcccgaatggcagcaggatgaagcgcggaaccgtttcctgctgcacagtatggatgcctatacggggctgacggaatatcccgcgcctatgctgctccagcttgacgggttttccgaggtgcgttcctcaggtttgcagatgacccgttcgccgggtgcgcttttggtctatctcggctcggtattgttggttttgggtacggtatttatgttttatgtgcgcgaaaaacgggcgtgggtattgttttcagacggcaaaatccgttttgctatgtcttcggcccgcagcgaacgggatttgcagaaggaatttccaaaacacgtcgagagcctgcaacggctcggcaaggacttgaatcatgac

SEQ ID NO: 1948 - protein, 650 aa, Neisseria gonorrhoeae
MRFAVALLSLLGIASVIGTVLQQNQPQTDYLVKFGPFWTRIFDFLGLYDVYASAWFVVIMMFLVVSTSLCLIRNVPPFWREMKSFREKVKEKSLAAMRHSSLLDVKIAPEVAKRYLEVRGFQGKTVSREDGSVLIAAKKGTMNKWGYIFAHVALIVICLGGLIDSNLLLKLGMLAGRIVPDNQAVYAKDFKPESILGASNLSFRGNVNISEGQSADVVFLNADNGMLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVREKRAWVLFSDGKIRFAMSSARSERDLQKEFPKHVESLQRLGKDLNHD

SEQ ID NO: 1949 - DNA, 1185 bp, Neisseria gonorrhoeae
atgactgaacactataaaacccttccggaacacgagctgctgattcagaaatctttgatccgcaatctgaatctttgggattgggtatttgccgtgctggtttttgcggctacggttttcgtgcagacccgttccggtatgcatatggacatttacgaaacggtcatgttgtgggcgagtgccggtattgccgtgtttttgggttggtttttcaaaccgatgcgctggtttgttcctttaagcgtattgcttgcctatgccgccgtcggtctgtatggcggcaacattaaatcggcagagattttcctgttgcggtatttcctcagcagccaatcggcgatcatgtggcagtgtgcttttgtcttcttcgccctgttcgcctatatttcgggcgcggttttggcaagcgtgaaaaatgtgccgaccaacacgctgttgggtatgggaaccgtgtttgcatgggtgtctgccgtagcaggctttaccggtctgctggtacgttggcacgaaagctatctgctccgtcccgatgcagggcatatccccgtgtccaacctttatgaagtgttcattctgtttttggtcattaccgcgctgatgtatttgtattacgagggtaaatttgccgtgcagaaattgggcggcttcgtgttcggctttatggcggtcgtggtcggctttgtgttgtggtacagcgtgtcgcgtgaggcgcataccatccagccgctgattcccgcgctccagtcctggtggatgaaaatccacgttccggcaaactttatcggttacggcgcgttctgcatttccgcgatgctcggtattgccgaactggtttccctgcgtgcggaagaaaaaggcggaaaactgtggctgccgccgtcggcattgatcgacgaggtgatgtataaggcgattgccgtcggctttttgttctttaccattgccaccattttgggcgcgttgtgggcggcggacgcttggggacgctattggagctgggatccgaaagagacttgggcgttcatcgtttggttgaattacgccgtgtggctgcatttgcggctggtggcgggctggcgcggcaaagtgctggcgtggtgggcgattatcggtttgttcgtaaccgcattcgcctttatcggcgtgaatatgtttttgagcgggctgcattcttacggaacgctt

SEQ ID NO: 1950 - protein, 395 aa, Neisseria gonorrhoeae
MTEHYKTLPEHELLIQKSLIRNLNLWDWVFAVLVFAATVFVQTRSGMHMDIYETVMLWASAGIAVFLGWFFKPMRWFVPLSVLLAYAAVGLYGGNIKSAEIFLLRYFLSSQSAIMWQCAFVFFALFAYISGAVLASVKNVPTNTLLGMGTVFAWVSAVAGFTGLLVRWHESYLLRPDAGHIPVSNLYEVFILFLVITALMYLYYEGKFAVQKLGGFVFGFMAVVVGFVLWYSVSREAHTIQPLIPALQSWWMKIHVPANFIGYGAFCISAMLGIAELVSLRAEEKGGKLWLPPSALIDEVMYKAIAVGFLFFTIATILGALWAADAWGRYWSWDPKETWAFIVWLNYAVWLHLRLVAGWRGKVLAWWAIIGLFVTAFAFIGVNMFLSGLHSYGTL

SEQ ID NO: 1951 - DNA, 1062 bp, Neisseria gonorrhoeae
atgttggtattaggaatcgaatcttcttgcgacgaaaccggcgttgcgctgtacgacaccgaacgaggattgcggtcgcactgcctgcacactcaaatggcaatgcacgcggaatacggcggggtcgtgccggaattggcgagccgcgaccatatccgccgccttgttccgttgactgaaggctgtttggcgcaggcaggcgcatcgtatggcgatattgacgcggttgcctttacgcaggggcccggtttgggcggtgcgctgctggcgggttcgagctacgccaacgcgctggctttagcgttggataagcccgtcatccccgtccatcatttggaaggacatctgctgtcgccgctgttggcggaggaaaaacccgactttccttttgtcgcgctgttggtttcgggcgggcatacgcagattatggcggtcaggggcataggcgattacgagcttttgggcgagagcgtcgatgatgcggcgggcgaggcattcgacaaaacggcgaaactgctgggtttgccgtatccgggcggtgcgaaactgtcggaacttgcggaatcgggcaggcccgaagcgtttgtttttccgcgcccgatgattcattccgacgatttgcagatgagtttttcgggattgaaaaccgctgttttgactgccgttgaaaaagtgcgtgaggcaaacggttcggaaaccatacccgagcaaacccgcaacaatatttgccgtgcgtttcaagatgcggtagtagaagtgttggaggcaaaagtgaaaaaagccctgttgcagacagggttcagaaccgtagtggtcgccggcggggtcggtgcaaaccgcaaactccgtgaaactttcggcaacatgacggtacaaatcccgacccccaaaggcaagccgaaacatccgtccgaaaaagtcagcgtgtttttcccgccgatggcatactgcacggacaacggtgccatgattgcctttgccggtgcgatgcacctgggcaagggcagggaggtcggtgcgttcaacgtccgtccgcgttggtcgttgtccgaaatcgtcaaa

SEQ ID NO: 1952 - protein, 354 aa, Neisseria gonorrhoeae
MLVLGIESSCDETGVALYDTERGLRSHCLHTQMAMHAEYGGVVPELASRDHIRRLVPLTEGCLAQAGASYGDIDAVAFTQGPGLGGALLAGSSYANALALALDKPVIPVHHLEGHLLSPLLAEEKPDFPFVALLVSGGHTQIMAVRGIGDYELLGESVDDAAGEAFDKTAKLLGLPYPGGAKLSELAESGRPEAFVFPRPMIHSDDLQMSFSGLKTAVLTAVEKVREANGSETIPEQTRNNICRAFQDAVVEVLEAKVKKALLQTGFRTVVVAGGVGANRKLRETFGNMTVQIPTPKGKPKHPSEKVSVFFPPMAYCTDNGAMIAFAGAMHLGKGREVGAFNVRPRWSLSEIVK

SEQ ID NO: 1953 - DNA, 612 bp, Neisseria gonorrhoeae
atgaacttcacccggttgctcaaccaagtcttaagcacggttcaaaaaaaaggcaacacattctccggcagcccgctcaattcattcggcggaggcgcgctggttgccggtgtcgcctccatgctgctgaacggtaaaaaccgcaaaaccatcaccaaaatcggttcgaccgccgctttgggctacctcgcctaccggggctatcagatgtggcagcaaaacaaagggcgggcaaccgtaacacaaagcgatttccaacctgccggaaaaactgaagaaacatacagccgcaccgtattgcgtaccatgatagccgccgccgcttcagacggcatgatagacgaagccgaacgccggactatcgaacaggaaagcggcacagaccccgaaactgccgcatggctcgccgccgaataccgcctgcccgcaagcatcggggacatcgccgccgccgtcggcaacgatgaggcgttggcggcggagacctatctggcggcaaggttggtctgtgccgatttgtcgcggaaagaaaccgtcttcctcgcccgcctgtcgcaggctttgaaactggatgacaatctggtggagagtttggaaaggcaactagggatt

SEQ ID NO: 1954 - protein, 204 aa, Neisseria gonorrhoeae
MNFTRLLNQVLSTVQKKGNTFSGSPLNSFGGGALVAGVASMLLNGKNRKTITKIGSTAALGYLAYRGYQMWQQNKGRATVTQSDFQPAGKTEETYSRTVLRTMIAAAASDGMIDEAERRTIEQESGTDPETAAWLAAEYRLPASIGDIAAAVGNDEALAAETYLAARLVCADLSRKETVFLARLSQALKLDDNLVESLERQLGI

SEQ ID NO: 1955 - DNA, 96 bp, Neisseria gonorrhoeae
ttgccgcccgaaacccgtcagtcggcgatgtcgaagtggaaccggcaaataatcggcggcatagtttctttcaaaaatttacactgtgccgcattc

SEQ ID NO: 1956 - protein, 32 aa, Neisseria gonorrhoeae
LPPETRQSAMSKWNRQIIGGIVSFKNLHCAAF

SEQ ID NO: 1957 - DNA, 138 bp, Neisseria gonorrhoeae
ttggatttcctcttgttcaggcatgaacatatcaatattgtccatccccatccgacagataaaaaaataaccgcttggagcggcattgtcattttcagcttggtgcccggagccggaatcgaaccggcatgggatgtt

SEQ ID NO: 1958 - protein, 46 aa, Neisseria gonorrhoeae
LDFLLFRHEHINIVHPHPTDKKITAWSGIVIFSLVPGAGIEPAWDV

SEQ ID NO: 1959 - DNA, 921 bp, Neisseria gonorrhoeae
ttgccgcaatacttccctttttcagacggcatgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccg

SEQ ID NO: 1960 - protein, 307 aa, Neisseria gonorrhoeae
LPQYFPFSDGMFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 1961 - DNA, 198 bp, Neisseria gonorrhoeae
ttgcggcaatatgccttttctgctacgatgcgcgctgcattaagagttgggaattccatgccaacctgcttttcaaacggaaaggtaaggtggacggttgaaaaaccgatgtggctcgccggagcaatccaaacccgcttgatgcgggaatttttttgcctgtacgaaacgtacggacagagattccaaagcgccgtt

SEQ ID NO: 1962 - protein, 66 aa, Neisseria gonorrhoeae
LRQYAFSATMRAALRVGNSMPTCFSNGKVRWTVEKPMWLAGAIQTRLMREFFCLYETYGQRFQSAV

SEQ ID NO: 1963 - DNA, 192 bp, Neisseria gonorrhoeae
atgtcgacagcgggaaatatagcaaaatttccctattcgtgccattcagttgagaaatattcctatttaaacggcgctttggaatctctgtccgtacgtttcgtacaggcaaaaaaattcccgcatcaagcgggtttggattgctccggcgagccacatcggtttttcaaccgtccaccttacctttccgtt

SEQ ID NO: 1964 - protein, 64 aa, Neisseria gonorrhoeae
MSTAGNIAKFPYSCHSVEKYSYLNGALESLSVRFVQAKKFPHQAGLDCSGEPHRFFNRPPYLSV

SEQ ID NO: 1965 - DNA, 1194 bp, Neisseria gonorrhoeae
atggtttgtttttcaaggaaaatttcaatgagcgaatatctgtttacttccgaatcggtttccgaaggccatccggacaaagtagccgaccaagtatccgatgcgattttggatgccatcttggcgcaagaccccaaagcgcgtgtcgcggcggaaactttggtcaacacaggcttgtgcgtattggcgggcgaaatcaccaccaccgcccaagtggactacatcaaagtcgcacgcgaaaccatcaaacgcatcggctacaactcctccgagctgggctttgacgccaacggctgcgcggtcggcgtgtactacgaccaacaatcccccgacatcgcccaaggcgtgaacgaaggcgaaggcatcgacctgaaccaaggcgcgggcgaccaaggcttgatgttcggctatgcctgcgacgaaaccccgaccctgatgccgtttgccatctattacagccaccgcctgatgcagcgtcaaagcgaattgcgcaaagacggccgcctgccttggctgcgccctgacgcaaaagcccaactgaccgtggtttacgacagcgaaaccggcaaggtgaaacgcattgataccgtcgtcctgtccacccagcacgatcctgccatcagccaggaagaactgagtaaagccgtgattgagcagattatcaagcccgttttgccgcccgaactgctgaccgacgaaacaaaatacctgatcaacccgaccggccgcttcgtcatcggcggcccgcaaggcgactgcggtttgaccggccgcaaaatcattgtcgatacctacggcggcgcggctccgcacggcggcggcgcattctccggcaaagacccgtccaaagtggaccgttccgccgcttacgcctgccgttatgtggcgaaaaacatcgtcgccgcaggcttggcaacccaatgccaaatccaagtttcctacgccatcggcgttgccgaaccgacttcgatttccatcgatactttcggtacgggtaaaatcagcgaggaaaaactgattgcgctggtttgcgaacatttcgacctgcgtcccaaaggcatcgtccaaatgctcgacctcttgcgcccgatttacggaaaatctgccgcctacgggcatttcggccgcgaagaacccgagtttacttgggaacgcaccgacaaagcggcctcattgaaagcggcagcggggctg

SEQ ID NO: 1966 - protein, 398 aa, Neisseria gonorrhoeae
MVCFSRKISMSEYLFTSESVSEGHPDKVADQVSDAILDAILAQDPKARVAAETLVNTGLCVLAGEITTTAQVDYIKVARETIKRIGYNSSELGFDANGCAVGVYYDQQSPDIAQGVNEGEGIDLNQGAGDQGLMFGYACDETPTLMPFAIYYSHRLMQRQSELRKDGRLPWLRPDAKAQLTVVYDSETGKVKRIDTVVLSTQHDPAISQEELSKAVIEQIIKPVLPPELLTDETKYLINPTGRFVIGGPQGDCGLTGRKIIVDTYGGAAPHGGGAFSGKDPSKVDRSAAYACRYVAKNIVAAGLATQCQIQVSYAIGVAEPTSISIDTFGTGKISEEKLIALVCEHFDLRPKGIVQMLDLLRPIYGKSAAYGHFGREEPEFTWERTDKAASLKAAAGL

SEQ ID NO: 1967 - DNA, 1545 bp, Neisseria gonorrhoeae
gtgcgtttcaatcatttcataatggtaacgattattatatatgtgatttcccctgcaaacaagccggtccgccgccccggcgttcccacttatccggctttgccttataattgctttttttatgtaacagattcacctatgaatttccccaaaacagcggcctccctgctgctgcttctcgcctccctcgccgcacacgcgctcgataccggccgcattccgcaaaacgaaatcgctgtatatgtccaagagcttgacagcggaaaagtcatcattgaccaccgtgccggcatacccgtcaatcccgcgtccacgatgaagctcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgacaaaggcatccgcaatatcacggggcgcctgatgctcgaccacagcctgtggggcgaagtcggcagtcccgaccattttgaagccgacagcggttcgccgtttatgacgcccccaaatccgactatgctgtctgccggtatggttatggtgcgcgccgaacgcaatgccgccggcagtaccgacatcctcaccgatccgcctttgccgcatatttttgcccaaaacaacttgaaaattaccgcctcccaagctgcctgcccttcggtcaaaaaactgatgcgcgcatctttttcgggcaatacgctgaaattgcgcggcaatattcccgaaagctgtttgggcaagcctgtcggtgtccggatgttcgcgcttgacgaactgatccgccaaagttttaccaaccgctggctgctcggcggcggacggatttcagacggcatcggcatagccgacacaccggaaggcgcgcagacgcttgccgttgcacactccaaaccgatgaaggaaattttgacggacatgaacaagcgttcggacaatctgattgcgcgttccgtcttcctcaaactcggcggcgacggcaaactgcccgccgtttccgaacaggcggcgtctgccgtccggcgagaacttgccgtatcgggcatcgatgttgcggatttggttttggaaaacggttcgggtctgtccagaaaagaaagggtaacggcgagaatgatggcgcaaatgttggaaacggcttatttcagcccgtttgcacaagatttcatcgacacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaaaaacatcatctccggcggcgacggctggctggatgcgaaactgatgtgcaaagaacgccgcgcc

SEQ ID NO: 1968 - protein, 515 aa, Neisseria gonorrhoeae
VRFNHFIMVTIIIYVISPANKPVRRPGVPTYPALPYNCFFYVTDSPMNFPKTAASLLLLLASLAAHALDTGRIPQNEIAVYVQELDSGKVIIDHRAGIPVNPASTMKLVTAFAAFKTFGSNYRWATEFKSNGTVNDGTLDGNLYWAGSGDPVFNQENLLAVQRQLRDKGIRNITGRLMLDHSLWGEVGSPDHFEADSGSPFMTPPNPTMLSAGMVMVRAERNAAGSTDILTDPPLPHIFAQNNLKITASQAACPSVKKLMRASFSGNTLKLRGNIPESCLGKPVGVRMFALDELIRQSFTNRWLLGGGRISDGIGIADTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVAKNIISGGDGWLDAKLMCKERRA

SEQ ID NO: 1969 - DNA, 153 bp, Neisseria gonorrhoeae
gtggaaccggcaaataatcggcggcatagtttctttcaaaaatttacactgtgccgcattctaaccaaagcccatccccctgacaatgccgaaattcaaacgcatccacgccattttttccgacaacgccgcccctcggcaaaccgcccgaat

SEQ ID NO: 1970 - protein, 51 aa, Neisseria gonorrhoeae
VEPANNRRHSFFQKFTLCRILTKAHPPDNAEIQTHPRHFFRQRRPSANRPN

SEQ ID NO: 1971 - DNA, 1050 bp, Neisseria gonorrhoeae
atgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatg

SEQ ID NO: 1972 - protein, 350 aa, Neisseria gonorrhoeae
MWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 1973 - DNA, 504 bp, Neisseria gonorrhoeae
gtggcattgaatgcggcggagatgttccccgaaggctggcaggcggaaatcgtcgaaatcggacatctgccgctttacaatttcgattatgacgaccctgaggtggaagatgtgccgctgcccgaaagctacacggctttccgcgaaacgattaaggcttcggacggcattttgttcgttacgtccgaaaacaaccgcaccattcccgcctgtttgaaaaatgcggtggacatcggctcgaaaccgaatgccgacgtggcttggaaaaacaaaccggccggcatcatcagccattccgtcggcaagatgggcggttacagttcccaaaaaaacctgcgccttgccctgtcgtattttgatatgcccgtaaccggacagccggaagtatttttgggcaattcgccgacgctgtttgatgaaaacggtaagttgattgactcggcaagggattttgttcagtcatatatcaatcagtttgtcggtttgattgaaagaaatgccaaa

SEQ ID NO: 1974 - protein, 168 aa, Neisseria gonorrhoeae
VALNAAEMFPEGWQAEIVEIGHLPLYNFDYDDPEVEDVPLPESYTAFRETIKASDGILFVTSENNRTIPACLKNAVDIGSKPNADVAWKNKPAGIISHSVGKMGGYSSQKNLRLALSYFDMPVTGQPEVFLGNSPTLFDENGKLIDSARDFVQSYINQFVGLIERNAK

SEQ ID NO: 1975 - DNA, 222 bp, Neisseria gonorrhoeae
atgtcggcaggcgtgaatggaatgcaaggcttatcccgcatatgttggcggttttgcctgcacgggcggttttatgttcaaaataaaataaagagaaataatgctgacgtttatcggattgctgattatcggggtcatcgtatggctgttgctgacggaaaaagtgtcgcccatcatcgcattaatcttggtgccgctgattggggcgttgctggcggggtt

SEQ ID NO: 1976 - protein, 74 aa, Neisseria gonorrhoeae
MSAGVNGMQGLSRICWRFCLHGRFYVQNKIKRNNADVYRIADYRGHRMAVADGKSVAHHRINLGAADWGVAGGV

SEQ ID NO: 1977 - DNA, 1203 bp, Neisseria gonorrhoeae
ttgctggcggggtttgatgtatcccaattaaaagaattttattcgggcggcacgaaatcggtgacgcagattgtgattatgtttatgttttccattttgttttttggaatcatgaacgatgtggggctgttccgtccgatgataggcggtttgattaagctgactcggggtaatatcgtggcagtgagtgtggggacggtcttggtgtcggtggtggcacagttggacggggcgggcgcgacgacgtttttatcggtcgtccccgcccttttgccgctttacaagcgtctgcatatgaatccttacctgctgtttttgctgctgacttccagcgcggggctaatcaaccttttgccgcggggcgggccgatcgggcgggttgcaagcgtgttgggcgcagatgtgggcgaattgtataaacctttgttgacggtgcaaattatcggtgtggtgtttatccttgtgctgtccctgtttttgggtgtgcgtgaaaaaaggcggattgtccgggagttgggcgcgttgcccgccgtggcggatttgataaagccggcgcctttgtcggaagaagaacaaaaattggcgcgtccgaaactgttttggtggaatgtcctgctgtttttggcggcgatgagcctgcttttttcgggcatcttcccgccgggttatgtatttatgctggctgcaacggcggcgttgcttttgaattaccgcagcccgcaggaacagatggagcggatttatgcccacgccggcggcgcggtgatgatggcgtccattattttggcggcaggtacgtttttggggattttgaagggcgcggggatgttggacgcgatttccaaagaccttgtgcatatcctgccggacgcgttgctgccttatctgcatattgccatcggtgtgttgggtattccgcttgagttggttttgagtacggacgcttattatttcggactgtttccgattgtggaacagattacctcgcaggcgggcgttgcacccgaagcggcaggctatgcgatgttgatcggcagtatcgtcggtacttttgttacgccgctttcgccggctttgtggatgggtttgggtttggcgaaattgtcgatgggcaaacacatccgttattcgtttttctgggcgtggggtttgtcgctggcgatattggtcagttcgatagcggcaggaatcgtgcctctgccg

SEQ ID NO: 1978 - protein, 401 aa, Neisseria gonorrhoeae
LLAGFDVSQLKEFYSGGTKSVTQIVIMFMFSILFFGIMNDVGLFRPMIGGLIKLTRGNIVAVSVGTVLVSVVAQLDGAGATTFLSVVPALLPLYKRLHMNPYLLFLLLTSSAGLINLLPRGGPIGRVASVLGADVGELYKPLLTVQIIGVVFILVLSLFLGVREKRRIVRELGALPAVADLIKPAPLSEEEQKLARPKLFWWNVLLFLAAMSLLFSGIFPPGYVFMLAATAALLLNYRSPQEQMERIYAHAGGAVMMASIILAAGTFLGILKGAGMLDAISKDLVHILPDALLPYLHIAIGVLGIPLELVLSTDAYYFGLFPIVEQITSQAGVAPEAAGYAMLIGSIVGTFVTPLSPALWMGLGLAKLSMGKHIRYSFFWAWGLSLAILVSSIAAGIVPLP

SEQ ID NO: 1979 - DNA, 165 bp, Neisseria gonorrhoeae
ttggggcgcgattgcaacacacggacaggcaggcaaagcctgcgacagatcacaggaacgattcgggcttcaggcggcttcgccgtttacggcagaggcacgattcctgccgctatcgaactgaccaatatcgccagcgacaaaccccacgcccagaaaaacgaa

SEQ ID NO: 1980 - protein, 55 aa, Neisseria gonorrhoeae
LGRDCNTRTGRQSLRQITGTIRASGGFAVYGRGTIPAAIELTNIASDKPHAQKNE

SEQ ID NO: 1981 - DNA, 564 bp, Neisseria gonorrhoeae
gtgtcggcaagtttgaaagacggcggctatgcggtggattgggtcaaaaacggcgcgcaggttgcggcggctgccgctgcccagccttatgacttgatgctgctggatttgggtttgcctgggcgggacggtttggatgttttgtcggaaatacgcgcggcaggctgtaccgtccccgtgctgatcgttacggcgcgggatgatttgtacagccggctgaacggtttggacggcggtgcggatgactatatcgtcaagccgttcgatatggcggagtttaaggcgcggatgcgggcggtgttgcggcgcgggagcggacaggcgcaggcgtgtctgtcaaatggtgcgttatccctcaatcctgcaacgtatcaggtagaaattattgccgaggggaggggtggcattgagcaaccaggagttttcggtattgcaggctttgctggcgaggccgggtgtgattttgtcgcgctcggattcggaggacaaggtttacggttggggcggggaagtcgaaagcaatgcggtggattttctgattcacgggctgtgcaagaaattggg

SEQ ID NO: 1982 - protein, 188 aa, Neisseria gonorrhoeae
VSASLKDGGYAVDWVKNGAQVAAAAAAQPYDLMLLDLGLPGRDGLDVLSEIRAAGCTVPVLIVTARDDLYSRLNGLDGGADDYIVKPFDMAEFKARMRAVLRRGSGQAQACLSNGALSLNPATYQVEIIAEGRGGIEQPGVFGIAGFAGEAGCDFVALGFGGQGLRLGRGSRKQCGGFSDSRAVQEIG

SEQ ID NO: 1983 - DNA, 177 bp, Neisseria gonorrhoeae
atgccgaaattcaaacgcatccacgccattttttccgacaacgccgcccctcggcaaaccgcccgaattagcctgaatttacatttatcattgataatgcccgattaccgacaccgcctccctgctgccgcacagcgggcgtatggttctgatagaccgcattacccgatacggcga

SEQ ID NO: 1984 - protein, 59 aa, Neisseria gonorrhoeae
MPKFKRIHAIFSDNAAPRQTARISLNLHLSLIMPDYRHRLPAAAQRAYGSDRPHYPIRR

SEQ ID NO: 1985 - DNA, 1869 bp, Neisseria gonorrhoeae
ctgcaatgcgccgcctcgggaatgcttgagcaggcgttcgtgtttgtgaaattcccgccccatataataagaaccgaaataggtcaggtggtcttggtcgccgtaaagatagcgtccgtgtatttcgaccgtgtttttgggcaggtatttttgtgcgtccacccaatgcacattgggaatatctttaaccaaatcaaagaccgcctgattgctcttgccgatgtcgcccatagcccgaataggccggaggtattggtttatagcaaatcttttcaatttttcctccctcaagggagaacggctgattgatgtattgtttgcaaaaacatatacaggtttgacggcggctatcctcttgacggtttccctgaatcgggctttgaacccgggtatcaggaaggattgcgcttcaaatctcggcacgggctggccgcccatcctcaaatcatagaattgggcaatgaaaacagcttcggctttttcaacttcatcccggtattttcggcacaacgggttgtctgccagcttctcatccacccaaaccaaacactccgaatcgagggacaggattttagctttccacccttccctgccgccgacataatccagaaacccccgcaggtgtccggcgtgcgagtcgccgagggtcaagacggtttccggaaaattattttccgcagcaacgggcgtgccgggcagcgggcggaggtgttcctgtttcaatatccctcttgaatacaggttgtaaccgacaagcatcagggacggggcgagataaaggcagaaaaatgcctttttgaaggtcatcttccgttttctaagcggctgttcaatcaaataatagctcaacagggaaaatccggccgtcaacgcggcaaccgccgatacggcaggcagtccgagctgtttgtcgcctgtaatgtaatgggcgaaggcaataaaaatccaatggtacaggtatagggaataagagattttgccgacaaatacgatggggcttgccgacaggatgcgggtcggaagtgtcccgtattgcatactccggataagcagcgccgtcagcaggcagggaaggagcagggttattcccgggataaacggatcgtgtttgtcgatcacgaacaggcagacaagcaatgcgccgaaacagagtaatgaaagcaactgccgttttccattttctgtttgccgtctgccgttttgcgtttgcccgtaaaccgccaacagcgaacccaccaacagctcgggaaacctcagtgtcgaaaggtaataagtattgggttggttgaggatgtcggtataaaacccggccggcaaaaacgatgatgcggtcaaaatcagaaacaggatgatgctgatattacgcagcacccgtagtgatttggtttttttgtaacagaatatcagcaaaagaggatacaggaggtaatactgttcctctaccgccaaagaccagatatgcagtacggggttctcgtcggcactcaaatcgaaataccccaatcggaaccccaaataaatattggacaaaaaaaccgtagaaagctctatggttttcctcatttggttgaaatcttcgtaaaggaagatttgagaagcaatcaccgaagccagggacacggccgcaataaaagcaggataaatccgcttaatcctgcgggtataaaaatcccggaaagaaaaagaaccgttctgtatttcagaaagaatgatgttggtaatgaggaatcccgagatgacaaagaaaatgtccacccccaggaatcctccgggcagccagcggttattcaggtggaaaataatgacggatagcacggcgacggcccgcaatccgtcaatttcaggcctgtatcggacagcttgcatcaa

SEQ ID NO: 1986 - protein, 102 aa, Neisseria gonorrhoeae
LQCAASGMLEQAFVFVKFPPHIIRTEIGQVVLVAVKIASVYFDRVFGQVFLCVHPMHIGNIFNQIKDRLIALADVAHSPNRPEVLVYSKSFQFFLPQGRTAD

SEQ ID NO: 1987 - DNA, 240 bp, Neisseria gonorrhoeae
ttgccgaggggaggggtggcattgagcaaccaggagttttcggtattgcaggctttgctggcgaggccgggtgtgattttgtcgcgctcggattcggaggacaaggtttacggttggggcggggaagtcgaaagcaatgcggtggattttctgattcacgggctgtgcaagaaattgggtaaggaaagcatacaaaatgtgcgcggtgtcggctggctgatgccgcgtcaagatgccgtc

SEQ ID NO: 1988 - protein, 80 aa, Neisseria gonorrhoeae
LPRGGVALSNQEFSVLQALLARPGVILSRSDSEDKVYGWGGEVESNAVDFLIHGLCKKLGKESIQNVRGVGWLMPRQDAV

SEQ ID NO: 1989 - DNA, 1317 bp, Neisseria gonorrhoeae
atgccggaccgtttttttaaaattttaaaacattcgcttcaggtcagaatcagccttgccctgatttggatgtttgttccgctggcaatgcttgcaggtatgttttcctactacgaaaccttccacgaaacggaagcgttgcaggacgacctgctccgtcaggcggcattgtatgtcggccctgattccaaacccgaaactttgcccgaaggcgacggcgatacgcgtattttggtacagatgccgcagcaggaagaccctgttgtcagcctgcccgcgcatctggcggacggtctgcacacgcttcaggcggacggggacgacgattattaccgcgtctatatccgcacgaccgaacagggacggattgccgtcatgcaggaaaacgaataccgtgaagatttggcggaggatgcggcacggcaaagcgtgttgcccctgttggcggcactgccgctgatgatactgctgactgtgtggattacgcacaaagccatgcgccccgtccgcaaattgtcgcaaagtctcgaacaacgccgaatcaacggcctgtctgctttgagtgtgtacaatattcccagtaaaatcagagggttcgtaaccgccatcaatctgcttttgaaacgtgttgatgaagatatacgccgccgtcagcggtttgtcgccgacgcggcacacgaattgcgtacgccgatgactgccctttcccttcaggcggaacggctcaacaatatgccgctcccacccgatgcggggcggcagtccgccgttttgcagcagagcatcaggcgcaacaaacacctgctcgaacagcttttggcactggcgcgttcgcagtcggacgaaacccctttgacgaaaacgacattcgggctgcaaagccgtttccgccaagtgttgcaggaactgatgccgctggctttggaaaaacgtcaggacatcggtgtggcggtcggaggcgatgtcgaagtgtctgccgacgaaacggaaatctatacgctggttaaaacctttgccgacaacgcggtacgttacacgccgaacgggggcaggatagatttgggtttcacggacgaagggaaatatctcgccgtgtgggtggaggataacgggaacggcattcccgaatccgaatgcccccgcgtcctcgatccgttttaccgtattttgggaacggagcagcagggggcggggctggggctgtcgattgccgacacgctggccaaaaaatacggcggatatttggaactgaccgacagccgacgtttcggacacgggctgttgatacgcgcgctgttggacaaggaaaccctgaaa

SEQ ID NO: 1990 - protein, 439 aa, Neisseria gonorrhoeae
MPDRFFKILKHSLQVRISLALIWMFVPLAMLAGMFSYYETFHETEALQDDLLRQAALYVGPDSKPETLPEGDGDTRILVQMPQQEDPVVSLPAHLADGLHTLQADGDDDYYRVYIRTTEQGRIAVMQENEYREDLAEDAARQSVLPLLAALPLMILLTVWITHKAMRPVRKLSQSLEQRRINGLSALSVYNIPSKIRGFVTAINLLLKRVDEDIRRRQRFVADAAHELRTPMTALSLQAERLNNMPLPPDAGRQSAVLQQSIRRNKHLLEQLLALARSQSDETPLTKTTFGLQSRFRQVLQELMPLALEKRQDIGVAVGGDVEVSADETEIYTLVKTFADNAVRYTPNGGRIDLGFTDEGKYLAVWVEDNGNGIPESECPRVLDPFYRILGTEQQGAGLGLSIADTLAKKYGGYLELTDSRRFGHGLLIRALLDKETLK

SEQ ID NO: 1991 - DNA, 1560 bp, Neisseria gonorrhoeae
ttgcacccgctctgcgcggcggggcggaacggatgcaaaaatatttttattacattttcaggaaaaaccatgttgtcaggactccccatccccaaagacatcgcgcgcccgcccgaaacgatattggtcaacatcacgccgcaggaaacgcgcgtggcggtgttggaggaaaacaatatctgcgagctgcacatcgagcgcaacagcgggcacagcctggtcggcaatatctatctgggcgtggtgcgccgcgtactgcccgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtcggttttggtgcaggtcatcaaagacccgatcaacaccaaaggcgcgcggctttccacccaaatctcgctggcggggcgtttcctcgtccaccttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgccggaaaccctgctttatcaggatttgcctttaagcctgcgcgtgttgcgcgatatggtcggctgcgacacgcagaaaatcctcgtcgattccaccgtaaaccacgggcgcatgacgcgttttgccgaacaatacgtccacggcgcattgggcaggatagaattgttcaaaggcgaacgcccgctgtttgaaacccacaacatcgaacaggaaatcagccgcgccctgcaaccgcgcgtcaacctcaacttcggcagctacctgattatcgagtccaccgaagccatgaccaccatcgatgtcaacaccggcggcttcgtcggcgcgcgcaatttcgacgaaaccatcttccgcaccaacctcgaagcctgccacaccatcgcccgcgaattaaggctgcgcaaccttggcggcatcatcatcatcgacttcatcgatatggcgcaggaaagccaccgcgaagccgtgttgcaggagcttgccaaagccctcgccttcgaccgtacccgcgttaccctgcacgattttaccagcctggggctggtcgagctgacgcgcaaacgctcgcgcgaaaacttaaaccaagtcctctgcgaaccctgcccttcctgccaaggcaggggccgcctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctttggcggtcgaaaccgcttacacgcaggaacaatacgatattgtgctgatg

SEQ ID NO: 1992 - protein, 520 aa, Neisseria gonorrhoeae
LHPLCAAGRNGCKNIFITFSGKTMLSGLPIPKDIARPPETILVNITPQETRVAVLEENNICELHIERNSGHSLVGNIYLGVVRRVLPGMQSAFIDIGLERAAFLHIVDVLEQRRNPEETQRIEHMLFEGQSVLVQVIKDPINTKGARLSTQISLAGRFLVHLPQEDHIGVSQRIEDDAERSSLRERLDKLLPENACRGYIIRTNAENATDEQLQSDIDYLTKVWEHIQEQAKIRPPETLLYQDLPLSLRVLRDMVGCDTQKILVDSTVNHGRMTRFAEQYVHGALGRIELFKGERPLFETHNIEQEISRALQPRVNLNFGSYLIIESTEAMTTIDVNTGGFVGARNFDETIFRTNLEACHTIARELRLRNLGGIIIIDFIDMAQESHREAVLQELAKALAFDRTRVTLHDFTSLGLVELTRKRSRENLNQVLCEPCPSCQGRGRLKTPQTVCYEIQREIVREARRYDAESFRILAAPNVIDLFLDEESQSLAMLIDFIGKPISLAVETAYTQEQYDIVLM

SEQ ID NO: 1993 - DNA, 348 bp, Neisseria gonorrhoeae
atgcaaaaatatttttattacattttcaggaaaaaccatgttgtcaggactccccatccccaaagacatcgcgcgcccgcccgaaacgatattggtcaacatcacgccgcaggaaacgcgcgtggcggtgttggaggaaaacaatatctgcgagctgcacatcgagcgcaacagcgggcacagcctggtcggcaatatctatctgggcgtggtgcgccgcgtactgcccgggatgcagagcgcgtttatcgacatcggcttggaacgcgcggcgtttttacacatcgtcgatgtcctcgaacaacgccgcaaccccgaagaaacccagcgcatcgaacatatgctgtt

SEQ ID NO: 1994 - protein, 116 aa, Neisseria gonorrhoeae
MQKYFYYIFRKNHVVRTPHPQRHRAPARNDIGQHHAAGNARGGVGGKQYLRAAHRAQQRAQPGRQYLSGRGAPRTARDAERVYRHRLGTRGVFTHRRCPRTTPQPRRNPAHRTYAV

SEQ ID NO: 1995 - DNA, 102 bp, Neisseria gonorrhoeae
atgataatcaatataggggcaatcgctccgtttggcaagtgcggaacagatgcacgttcagacggcatgtgcggagtgtgtcaaagtttcttttttaaagta

SEQ ID NO: 1996 - protein, 34 aa, Neisseria gonorrhoeae
MIINIGAIAPFGKCGTDARSDGMCGVCQSFFFKV

SEQ ID NO: 1997 - DNA, 279 bp, Neisseria gonorrhoeae
ttgcaaaactttcggaaacccaatatgcagaccgttaccatgtacacaggtccgttttgcccctactgcgcgatggcgaaaaggctgctgcacgcggcaggtgtcggacatatcgacgaaatccgtgtcgatgcaagccccgaagcctttgccgaaatgcagcggctttcgggacagcgcagcgtgccgcagattttcatcggcgaaacgcacgtcggaggatttaccgacctctaccgccttcagcaggaaggcgggctggacggactgctgaaccct

SEQ ID NO: 1998 - protein, 93 aa, Neisseria gonorrhoeae
LQNFRKPNMQTVTMYTGPFCPYCAMAKRLLHAAGVGHIDEIRVDASPEAFAEMQRLSGQRSVPQIFIGETHVGGFTDLYRLQQEGGLDGLLNP

SEQ ID NO: 1999 - DNA, 441 bp, Neisseria gonorrhoeae
atgagcgaagaactgcaacccgtattcagcatcgagcgactgtatgtcaaagacttgtctttggaagtgccgcacgcgccgcaaatctttttggaacagggcgatcccgaagtggatatgcgcgtttccaccggcagccaaaagctggaagacggctactacgacgtggacgttaccgtaaccgttaccgccaaattggataacgagcgcacgatgtttttgaacgaagtaacccaaagcggtattttccgtctggaaaacatccccgaagaagatgtgcagctgctgttgggcgtggcgtgtccgaacatcctcttcccttacgcgcgcgaagcggtttccggtacggtaacgcgcgccggcttcccgcccgtcctgcttgcgccgattaattttgaagcgatttaccaacaacagcaggaagccgaagccgccggggct

SEQ ID NO: 2000 - protein, 147 aa, Neisseria gonorrhoeae
MSEELQPVFSIERLYVKDLSLEVPHAPQIFLEQGDPEVDMRVSTGSQKLEDGYYDVDVTVTVTAKLDNERTMFLNEVTQSGIFRLENIPEEDVQLLLGVACPNILFPYAREAVSGTVTRAGFPPVLLAPINFEAIYQQQQEAEAAGA

SEQ ID NO: 2001 - DNA, 1407 bp, Neisseria gonorrhoeae
aatccgtttcgccaacgcttcagccttgcccacatacagcgcgggggtcagctcaagcaatttggctttggcttcggcgggaatttccagcgatccgataaagcctttcagcacttcgggtgtgatgccgcctttaccgcgcgtcaggtctttcagtttttcgtaaggattggcgacaccgtaacggcgcattacggtttgaatcggctcggcgagcagctcccaagtgacatccaaatcggcggcaagcgcggcagggttcggctcgagcttgttcagaccgcgcaagtgggcggcgaaacccaacacggcatagcccacgcccacgcccatattgcgcaatacggtgctgtcggtcaaatcgcgctgccagcgtgagacgggcagtttttccgccaaaaagcccaatacggcgtttgccatgccgaggttgccctcggagttttcaaagtcgatggggttgactttgtgcggcatggtggaagagccgacttcgcccgctttgactttttgtttgaaataacccaatgaaatataaccccaaacgtcgcggctgaagtcgatgagaatcgtgttgatgcggctgagggtttggaaaaactccgccatatagtcgtgcggctcgatttggatggtgtaggggttgaaggtcagaccgaggctgatttcgacgaagttgcggcagtgtgtttcccaatccacatcgggataggcggccatgtgggcgttgtagttgccgaccgcgccgttgattttgccgaggaattcttgcgcctgaaggattttgaactggcgttgcaggcggtacacgacattggcggtttctttgcccaaagtggtcggtgtggcgggctggccgtgggtgcggctcatcatcgggacggcggcaaggtcgtgcgccatagcggtgagtttgccgatgatttcggcaagtttgggcaggatgacggtttcgcgcgcctcttgcagcatcagggcgtgggacaggttgttgatgtcttcgctggtgcaggcgaagtggatgaactcgctcacggcggcgacttccggcacttcggcaaaacgttttttcagccaatattcgatggctttgacatcatgattggtcgtggcttcgatggctttgacggcggccgcgtcttctaatgaaaagttttcgatgactttgtcgatttcggcaagcgtttcggcactgaagggcggcacttcggcaatctccggctcggcggccagggctttgagccagtttaattcgactttgacgcgcgccttcatcagtccgtactctgaaaaaatcgggcgcaatgcttcaacggattgggcataacggccgtctaggggggaaagcgaggcgatggggttgatcatatcggcatcctgttcggaaaagacatcaaaaattgacaa

SEQ ID NO: 2002 - protein, 125 aa, Neisseria gonorrhoeae
NPFRQRFSLAHIQRGGQLKQFGFGFGGNFQRSDKAFQHFGCDAAFTARQVFQFFVRIGDTVTAHYGLNRLGEQLPSDIQIGGKRGRVRLELVQTAQVGGETQHGIAHAHAHIAQYGAVGQIALPA

SEQ ID NO: 2003 - DNA, 612 bp, Neisseria gonorrhoeae
atgaggataaccgttataatcataattttacagtccgcacagagaaaaccgatgccttggaacatccccatcttcctcacatggttgagggtcttgctcattcccgtactgattgtccttttctacctgccgttctcatggttttcagaagaagcagtcaatgttgccgccgccgtcatttttgccgttgccgccttgaccgactggtttgacggatttttggcaaggttgtggaaacagacttccgatttcggcgcattcctcgaccccgtcgccgacaagctgatggttgccgtatcgctgctgctgctggtcaaactcgaccggacctatgttttgttcgcgatgattatcatcggcagggaaattaccatttccgcattgcgcgaatggatggcgcaaatgggaaaaaggagcagcgttgccgtcgccaccgtcggcaagttcaaaaccgccgcgcaaatgctggcgattttctttttgctgctgaattttcccgatttttacggatttaatcttgttgttatcggcaacatattgatgtttatcgcatctttgctgacagtctggtcgatgctgtattatctgaaaatggcgtggaaagaaattgcc

SEQ ID NO: 2004 - protein, 204 aa, Neisseria gonorrhoeae
MRITVIIIILQSAQRKPMPWNIPIFLTWLRVLLIPVLIVLFYLPFSWFSEEAVNVAAAVIFAVAALTDWFDGFLARLWKQTSDFGAFLDPVADKLMVAVSLLLLVKLDRTYVLFAMIIIGREITISALREWMAQMGKRSSVAVATVGKFKTAAQMLAIFFLLLNFPDFYGFNLVVIGNILMFIASLLTVWSMLYYLKMAWKEIA

SEQ ID NO: 2005 - DNA, 603 bp, Neisseria gonorrhoeae
ttggcggaaacatcggtgattttgagctgtttctgggtttcgggcgacatcataggcagattcctttggacgcgcctattttatccgaaaacaaaaatgccgtctgaaacggattcagacggcatcggcaggcaggaatcaagccccggcggcttcggcttcctgctgttgttggtaaatcgcttcaaaattaatcggcgcaagcaggacgggcgggaagccggcgcgcgttaccgtaccggaaaccgcttcgcgcgcgtaagggaagaggatgttcggacacgccacgcccaacagcagctgcacatcttcttcggggatgttttccagacggaaaataccgctttgggttacttcgttcaaaaacatcgtgcgctcgttatccaatttggcggtaacggttacggtaacgtccacgtcgtagtagccgtcttccagcttttggctgccggtggaaacgcgcatatccacttcgggatcgccctgttccaaaaagatttgcggcgcgtgcggcacttccaaagacaagtctttgacatacagtcgctcgatgctgaatacgggttgcagttcttcgctcattttgttttcctagttgtgggt

SEQ ID NO: 2006 - protein, 201 aa, Neisseria gonorrhoeae
LAETSVILSCFWVSGDIIGRFLWTRLFYPKTKMPSETDSDGIGRQESSPGGFGFLLLLVNRFKINRRKQDGREAGARYRTGNRFARVREEDVRTRHAQQQLHIFFGDVFQTENTALGYFVQKHRALVIQFGGNGYGNVHVVVAVFQLLAAGGNAHIHFGIALFQKDLRRVRHFQRQVFDIQSLDAEYGLQFFAHFVFLVVG

SEQ ID NO: 2007 - DNA, 2040 bp, Neisseria gonorrhoeae
atgatgtcgcccgaaacccagaaacagctcaaaatcaccgatgtttccgccaagaagctcgacaaactcaacctccataccgcgtgggatttggtgttgcacctgccgctgcgttacgaggacgagacgcacattatgccgattaaggacgcgccgattggcgtgccgtgtcaggtcgagggcgaggttatccatcaggaagtaacgttcaaaccgcgcaagcagctgattgtccaaattgccgacggttccggcagcgtcctttttctgcgcttcatccacttttacgccagccatcagaagcagacggcggtcggcaaacgcatccgcgccgtgggcgaaatcaaacacggattttacggcgacgagatgattcatcccaaaatccgcgatgccgagggcggcggtttggcggaaagcctcacgccggtttacccgaccgtaaacggtttgaaccagcccactttgcgccgcatcattcagacggcgttggacgttacgccgctgcacgacaccttgcctgatgctttattaggccgtctgaagctgccgcgccttgccgaaagcctgcgccttttgcattcgccgccgccgagtttcactattcatcaactttcagacggcacgctgccggcgtggcagcggctcaaattcgacgaacttttggcgcaacagttgtccatgcgtttggcgcggcagaagcgcgtcagcggcacggcggcggcattgcgcggcgacggcacattgacccaagccctgcgccaagccctgccgtttgccctgaccgatgcacaagaaaaagttgtttccgaaatctgccgcgatatggcgcaaacccaccccatgcaccgcctgctgcaaggcgatgtcggcagcggcaaaaccatcgtcgccgccttatccgcgctgaccgccatcgaatcaggcgcgcaagtggctgtaatggcgcccactgaaatccttgccgaacagcacttcatcaagttcaaacaatggctcgaacctttgggcattgaagttgtctgcctttttggcagtttgcgcaaaaaagccaaagacgaagccaaagccaaactcgccgacggcagcgtcaaaatcgccgtcggcacgcacgccctgttttcagacggcgtggcgtttcacaatttgggcttgagcattgtggacgaacagcaccgtttcggcgttgcacaacgcctcgcactcaaaaacaaagggcgcgaagtccatcagctgatgatgtccgccacacccatcccgcgcacgctcgccatgagtttcttcgctgacttggacgtatccgtcatcgacgaattgccgcccgggcgcacgccgattaaaacgcgcctcgtcaacaacgtccgccgcgccgaagtcgaaggcttcgtcctcggcacttgccgaaaagggcggcaggcatattgggtctgcccattgattgaagaaagcgaaaccctgcaactgcaaaccgccgccgaaaccctcgcccggcttcagacggcattgcccgaacccaatatcggactggtacacgggcgcatgaaggccgccgaaaaggccgaagtcatggcggaatttgccgcaggccgtctgaacgtcttggttgccaccaccgtcatcgaagtcggcgtagatgtgcccaacgccgccctgatggtgatcgaacacgccgagcgcatgggcttggcgcagcttcaccaattacgcggacgggtagggcgcggcgcgggggaaagcgtgtgcgtcctcctgtttgccgaacccttgggcgaactcgccaaagcgcggctgaaagtcatctacgaacacaccgacggcttcgaaatcgcccgccaagacctcaatatccgcggccccggcgaatttctcggcgcgcgccaaagcggcgtgcctatgctgcgcttcgccaagctcgaagaagacttacaccttttggaacaagcgcgcgaaaccgccccgatgctgattgaacaaaaccctgaaatcgtcgaagcgcatttggcaaggtggctttccggcagggaaggttatttgggtgtg

SEQ ID NO: 2008 - protein, 680 aa, Neisseria gonorrhoeae
MMSPETQKQLKITDVSAKKLDKLNLHTAWDLVLHLPLRYEDETHIMPIKDAPIGVPCQVEGEVIHQEVTFKPRKQLIVQIADGSGSVLFLRFIHFYASHQKQTAVGKRIRAVGEIKHGFYGDEMIHPKIRDAEGGGLAESLTPVYPTVNGLNQPTLRRIIQTALDVTPLHDTLPDALLGRLKLPRLAESLRLLHSPPPSFTIHQLSDGTLPAWQRLKFDELLAQQLSMRLARQKRVSGTAAALRGDGTLTQALRQALPFALTDAQEKVVSEICRDMAQTHPMHRLLQGDVGSGKTIVAALSALTAIESGAQVAVMAPTEILAEQHFIKFKQWLEPLGIEVVCLFGSLRKKAKDEAKAKLADGSVKIAVGTHALFSDGVAFHNLGLSIVDEQHRFGVAQRLALKNKGREVHQLMMSATPIPRTLAMSFFADLDVSVIDELPPGRTPIKTRLVNNVRRAEVEGFVLGTCRKGRQAYWVCPLIEESETLQLQTAAETLARLQTALPEPNIGLVHGRMKAAEKAEVMAEFAAGRLNVLVATTVIEVGVDVPNAALMVIEHAERMGLAQLHQLRGRVGRGAGESVCVLLFAEPLGELAKARLKVIYEHTDGFEIARQDLNIRGPGEFLGARQSGVPMLRFAKLEEDLHLLEQARETAPMLIEQNPEIVEAHLARWLSGREGYLGV

SEQ ID NO: 2009 - DNA, 162 bp, Neisseria gonorrhoeae
ttgacacattttcatgattttaaatcccgttattcccaagtgggcggaaatccggcaatgagaatccgcagaggcttatcgggaaaacggcaagccccccgccgtcattcccgcgcaggcgggaatctagaaatgaaaaaccacggtgttatcggaaacgat

SEQ ID NO: 2010 - protein, 54 aa, Neisseria gonorrhoeae
LTHFHDFKSRYSQVGGNPAMRIRRGLSGKRQAPRRHSRAGGNLEMKNHGVIGND

SEQ ID NO: 2011 - DNA, 183 bp, Neisseria gonorrhoeae
ttgggttcggacggcttttggctcatcattcagcgaaaacaaaaatctaaaataccgtcattcccgcaaaagcgggaatctagtttatccggcttcagcaatttccgacacatttccacacgcttcgattccgtcatttctccggtttcaatcgtttccgataacaccgtggtttttcatttc

SEQ ID NO: 2012 - protein, 61 aa, Neisseria gonorrhoeae
LGSDGFWLIIQRKQKSKIPSFPQKRESSLSGFSNFRHISTRFDSVISPVSIVSDNTVVFHF

SEQ ID NO: 2013 - DNA, 1041 bp, Neisseria gonorrhoeae
atgagcaaaaaaatcaaagccggcattgtcggcgcgacgggctacacgggcgtggaactgctgcgcctgcttgccgcccatccagatgtcgaagttgccgccgtaaccagccgcagcgaagcgggaaccgcagttgccgattactttccaagtctgcgcggcgtgtacggcctcgccttccaaacacccgacgaggcaggtttggaacaatgcgacatcgtcttcttcgccacgcccaacggcatcgccatgaaagacgcgccacgccttttggaacagggcgtgcgcgtcatcgacctttccgccgacttccgcatacgggacattccgacctgggaacactggtacggcatgactcacgccgcccccggcctcgtttcccaagccgtgtacggattgagcgaactcaaccgcgaagccgtcgcacaggcgcgcctcgtcgccaaccccggctgctacccgacctgcgtatccctgccgctcgtgccgctgttgcggcaatgccgtctgaagcccggtatgccgctgattgccgactgcaaatccggcgtgtccggcgcgggcaggaaaggcaatgtcggttcgctgttgtgcgaagccggcgacaacttcaaagcctacggcacagccggacaccgccacctgcccgaaatcaggcagaccatcgccgggcttcaggacggcatcgccgaaggattcgtgttcacgccgcacctcgcgccgatgatacgcggtatgcacgccaccgtttacctccacctttcagacggcagcgaccccgaaaccgtcctgcgcgactactaccgcgacagcccgttcatggacatcctgcccgccggttcgacacccgaaacccgcagcgtgcgcggcgcaaacctctgccgcatcagcatccgtcaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccc

SEQ ID NO: 2014 - protein, 347 aa, Neisseria gonorrhoeae
MSKKIKAGIVGATGYTGVELLRLLAAHPDVEVAAVTSRSEAGTAVADYFPSLRGVYGLAFQTPDEAGLEQCDIVFFATPNGIAMKDAPRLLEQGVRVIDLSADFRIRDIPTWEHWYGMTHAAPGLVSQAVYGLSELNREAVAQARLVANPGCYPTCVSLPLVPLLRQCRLKPGMPLIADCKSGVSGAGRKGNVGSLLCEAGDNFKAYGTAGHRHLPEIRQTIAGLQDGIAEGFVFTPHLAPMIRGMHATVYLHLSDGSDPETVLRDYYRDSPFMDILPAGSTPETRSVRGANLCRISIRQAAQSDVWVVLSVIDNLVKGAAGQAVQNMNIMFGLEETHGLDAIPLLP

SEQ ID NO: 2015 - DNA, 291 bp, Neisseria gonorrhoeae
atgaaaaccctcgtcctcctcctgctttccttctccacgaccaccgctttcgccgcatacggtttgggtttggggcaggcaccgaaatatcctgtcggctttcgcgcctacggttatgtttattccggacggcagggctgggttttaaaaacagaggcggatgccattaaattagacacgcttttcaaacgctttgtgtaccgtccttccgccgccaatcaaaaccccgtcggacaagccgtcggacagcgttcggacggcatacccgccaaccacacaaaggaaaaacca

SEQ ID NO: 2016 - protein, 97 aa, Neisseria gonorrhoeae
MKTLVLLLLSFSTTTAFAAYGLGLGQAPKYPVGFRAYGYVYSGRQGWVLKTEADAIKLDTLFKRFVYRPSAANQNPVGQAVGQRSDGIPANHTKEKP

SEQ ID NO: 2017 - DNA, 141 bp, Neisseria gonorrhoeae
atgggcgtgtccgactgcgaactgcgttggacggatgcgccggaaacttcgtccggaacactcctttcagacggcattttggcacgcgcctcactcaacgtgtacagccccgaacaccatgacggaacaactgacgccgtc

SEQ ID NO: 2018 - protein, 47 aa, Neisseria gonorrhoeae
MGVSDCELRWTDAPETSSGTLLSDGILARASLNVYSPEHHDGTTDAV

SEQ ID NO: 2019 - DNA, 630 bp, Neisseria gonorrhoeae
tgccgtctgaagcccgtgttccgacagatacgcaatgatttcgtcttcgtcgtccgatatggagaacaaagaagcggccccttcggaaatcataccgcgcgccaaaagctgcgcgtttatccactccgccaagcccgaccaaaacgcctttccaaccaaaacgaccggacgcggcggcactttgcccgtctgcaccaaggtcaggatttcaaacaattcgtccagcgtcccgaagccgcccggcatcacgacatatgcttgggaatagcggaaaaacactgccttgcgttcggcaaaacgggaaaaccgcaaggcgatgtcctgatacggattcggtttctgctcgtgcggcagggcaatgttcagccctaccgaaaccgacttcccggcaaacgcgcccttgtttgccgcctccataatccccggcccgccgcccgaaatgacggcaatacccgaatccgacagccgccgcgccagacggcaggcaaacgcataatccgcatgatcctgcggcgtgcgcgcgctgccgaaaatactgactgccggaaacacgtccgccaatgcttcgtctgcctgcctgcattcggcatcataacgtgcctgctccggcacgcggtttacattctccat

SEQ ID NO: 2020 - protein, 210 aa, Neisseria gonorrhoeae
CRLKPVFRQIRNDFVFVVRYGEQRSGPFGNHTARQKLRVYPLRQARPKRLSNQNDRTRRHFARLHQGQDFKQFVQRPEAARHHDICLGIAEKHCLAFGKTGKPQGDVLIRIRFLLVRQGNVQPYRNRLPGKRALVCRLHNPRPAARNDGNTRIRQPPRQTAGKRIIRMILRRARAAENTDCRKHVRQCFVCLPAFGIITCLLRHAVYILH

SEQ ID NO: 2021 - DNA, 126 bp, Neisseria gonorrhoeae
atgaagcccgattatagcaaaaggtcgtctgaaaaccgttttcagacgaccttttatttaattacaataaaaatgttaacaacaaaaaacaaaccgcttttttccgtttggagacaaatttttaac

SEQ ID NO: 2022 - protein, 42 aa, Neisseria gonorrhoeae
MKPDYSKRSSENRFQTTFYLITIKMLTTKNKPLFSVWRQIFN

SEQ ID NO: 2023 - DNA, 1152 bp, Neisseria gonorrhoeae
atgggcatccatctcgacttcggcattagtcctaaaacgttccgacagacttatctgtatcaaaagcccaagctctttaaaggagcggttcggaatctcgaagccgcatcttgtaaatatatcaacgagatataccaacgagcagacccaaccgcaccgctgtttcatctgcgtaaaaaaggcgcaatcgttcctaaagaagaatacgtcgaaagtttcgacgatttgggcaaaactcgctaccgttttattaaatccgttatctacgaacatatgaagaatggtgcgtcgttagtctataaccatattaacaacgagccgttttcagaccatatcgcccgtcaagtcgcccgctttgccggcgcacatactattgttagtggatatcttgcttttggcagcgacgaatcttataaaaaccattgggatacccgcgatgtgtatgccatccagcttttcggcaagaaacgttggcaacttactgcccctgatttccctatgccattgtatatgcaacagactaaagatactgatatttccattcctgaacatatcgatatggatattatccttgaagcaggtgatgtcctctacatcccacgcggttggtggcacagacctatcccgctcggctgtgaaaccttccacttcgctgtcggtaccttcccaccaaacggctataattacctcgagtggctaatgaagaaatttcccaccatagaaagtctgcgccacagtttctcagactgggagcaagataggacgcgtatcaacgatactgccgcacaaattgctgccatgattgccgaccccgtcaattatgaagccttcagtgaagactttctcggcaaagaacgtaccgataccgcttttcatctcgaacagttcgcgaatcccaacgctactccgctttcagacgacgtcaggttgagattaaatgccaataatttggatacgttggaaaagggatatttgattgggaatgggatgaagataagcgtagatgagttggggaaaaaagtgttagaacacatcggtaagaatgaaccgttattgttgaaaaatctactggttaacttcaatcaggcaaaacatgaagaagttaggaagttgatctatcagttgatagagttagattttctggaaattttg

SEQ ID NO: 2024 - protein, 384 aa, Neisseria gonorrhoeae
MGIHLDFGISPKTFRQTYLYQKPKLFKGAVRNLEAASCKYINEIYQRADPTAPLFHLRKKGAIVPKEEYVESFDDLGKTRYRFIKSVIYEHMKNGASLVYNHINNEPFSDHIARQVARFAGAHTIVSGYLAFGSDESYKNHWDTRDVYAIQLFGKKRWQLTAPDFPMPLYMQQTKDTDISIPEHIDMDIILEAGDVLYIPRGWWHRPIPLGCETFHFAVGTFPPNGYNYLEWLMKKFPTIESLRHSFSDWEQDRTRINDTAAQIAAMIADPVNYEAFSEDFLGKERTDTAFHLEQFANPNATPLSDDVRLRLNANNLDTLEKGYLIGNGMKISVDELGKKVLEHIGKNEPLLLKNLLVNFNQAKHEEVRKLIYQLIELDFLEIL

SEQ ID NO: 2025 - DNA, 237 bp, Neisseria gonorrhoeae
gtgagggattctatgaaaaactggaagcagtttatatttttcgtaatattagtaatagcttgttatcaagtgctatattttttatcagatatgtttcttctcgactacattaacaaatatagttggaatttgaattttattcagggtactttgaattttttttcaatatatctgccatatgtttttgttagccgaatttttaggaataccaaccaagaaaaggagtataaaaatgat

SEQ ID NO: 2026 - protein, 79 aa, Neisseria gonorrhoeae
VRDSMKNWKQFIFFVILVIACYQVLYFLSDMFLLDYINKYSWNLNFIQGTLNFFSIYLPYVFVSRIFRNTNQEKEYKND

SEQ ID NO: 2027 - DNA, 405 bp, Neisseria gonorrhoeae
atgtttttgttagccgaatttttaggaataccaaccaagaaaaggagtataaaaatgattgaacttcaacttcatgaattgaagctggtttcagggggaggtcctgtaacagacaatatagctggaaatgtagctaatgctgccacaaccaaaggaggtcccacatggggggattttgttgcaatacctgctgctgcagcgacagttcatttcctgccgaaaaattttttcggtgctattggtgcaaatggtgtatacaatctgactcgtgattgggtaaatgatgccgttaatgcacctccttataacggaagaccaatctttgagattgaacatggattaactgctcccgcaacaaaagcagataaatcaggaaacggctacactgacggcacagattactgc

SEQ ID NO: 2028 - protein, 135 aa, Neisseria gonorrhoeae
MFLLAEFLGIPTKKRSIKMIELQLHELKLVSGGGPVTDNIAGNVANAATTKGGPTWGDFVAIPAAAATVHFLPKNFFGAIGANGVYNLTRDWVNDAVNAPPYNGRPIFEIEHGLTAPATKADKSGNGYTDGTDYC

SEQ ID NO: 2029 - DNA, 1272 bp, Neisseria gonorrhoeae
atgaatagacccaagcaacctttcttccgccctgaagtcgccattgcccgccaaaccagcctgacgggtaaagtgattctgacacgcccgttgtcattttccctgtggacgacatttgcatcgatatctgcgttactgattatcctgtttttgatattcggtaactatacgcgaaagacaacaatggagggacaaattttacctgcatcgggcgtaatcagggtgtatgcaccggatacggggacaattacagcgaaattcgtggaagatggagaaaaggtcaaggctggcgacaagctatttgcgctttcgacctcacgtttcggcgcaggaggtagcgtgcagcagcagttgaaaacggaagcggttttgaagaaaacgttggcagaacaggaactgggtcgtctgaagctgatacacgagaatgaaacgcgcagccttaaagcaactgtcgaacgtttggaaaaccagaaactccatatttcgcaacagatagacggtcagaaaaggcgcattagacttgcggaagaaatgttgcggaaatatcgtttcctatccgccaatgatgcagtgtcaaaacaagaaatgatgaatgtcgaggcagagcttttagagcagaaagccaaacttgatgcctaccgccgagaagaagccgggctgcttcaggaaatccgcacgcagaatctgacattggccagcctccccaaacggcatgagacagaacaaagccagcttgaacgcaccattgccgatatttctcaagaagttttggattttgaaatgcgctctgaacaaatcatccgtgcaggacggtcgggttatatagcaataccgaacgtcgaagtcggacggcaggttgatccttccaaactgctcttgagcattgttcccgaacgtaccgagttatatgcccatctatatatccccagcagtgcagcaggctttatcaagccgaaagacaaggttgtcctacgttatcaggcatatccctatcagaaattcgggcttgcttccggcagtgtcgtatcagtggcaaaaacggcactgggcagacaggaattgtcgggattgggcatggtatcctccgatttggcgaagagcaacgaacctgtttatctcgtgaaaataaaacccgacaaaccaaccatcactgcatacggtgaggaaaaaccgctgcaaatcggcatgacgctggaagcagacatcctacacgagaaacggcggctgtacgaatgggtattggagccgatttacagtatgtcgggcaggttg

SEQ ID NO: 2030 - protein, 424 aa, Neisseria gonorrhoeae
MNRPKQPFFRPEVAIARQTSLTGKVILTRPLSFSLWTTFASISALLIILFLIFGNYTRKTTMEGQILPASGVIRVYAPDTGTITAKFVEDGEKVKAGDKLFALSTSRFGAGGSVQQQLKTEAVLKKTLAEQELGRLKLIHENETRSLKATVERLENQKLHISQQIDGQKRRIRLAEEMLRKYRFLSANDAVSKQEMMNVEAELLEQKAKLDAYRREEAGLLQEIRTQNLTLASLPKRHETEQSQLERTIADISQEVLDFEMRSEQIIRAGRSGYIAIPNVEVGRQVDPSKLLLSIVPERTELYAHLYIPSSAAGFIKPKDKVVLRYQAYPYQKFGLASGSVVSVAKTALGRQELSGLGMVSSDLAKSNEPVYLVKIKPDKPTITAYGEEKPLQIGMTLEADILHEKRRLYEWVLEPIYSMSGRL

SEQ ID NO: 2031 - DNA, 345 bp, Neisseria gonorrhoeae
atgagagaattgaccatgaacgaaatgaccgctgttttcggcggcacagaaggtacttgggggcacaggggcagagtctccggagaatgggtcggaagcaaggtcggcggcgctttagggtcgtttgccggagcattcacgggaatggcgggcggcgcattggtaacaggcggaaatcctgccggaattgccatcggcggcgcaggcggcggatgggtaggagctgagggcggttctgcattgggtgggcatatcggcggttttgccggtgcaaaatggggaaaaatgatcgacaggcgcaactgccaatgcggagaagactgccattgcgacccgtgcaactgt

SEQ ID NO: 2032 - protein, 115 aa, Neisseria gonorrhoeae
MRELTMNEMTAVFGGTEGTWGHRGRVSGEWVGSKVGGALGSFAGAFTGMAGGALVTGGNPAGIAIGGAGGGWVGAEGGSALGGHIGGFAGAKWGKMIDRRNCQCGEDCHCDPCNC

SEQ ID NO: 2033 - DNA, 462 bp, Neisseria gonorrhoeae
gtgcgaaatccatttcaaactcccgatcaacagttgcacgggtcgcaatggcagtcttctccgcattggcagttgcgcctgtcgatcatttttccccattttgcaccggcaaaaccgccgatatgcccacccaatgcagaaccgccctcagctcctacccatccgccgcctgcgccgccgatggcaattccggcaggatttccgcctgttaccaatgcgccgcccgccattcccgtgaatgctccggcaaacgaccctaaagcgccgccgaccttgcttccgacccattctccggagactctgcccctgtgcccccaagtaccttctgtgccgccgaaaacagcggtcatttcgttcatggtcaattctctcatttcaaaactccttttatcgtcaatcgaaaaattgaaagggcagataccctatccttgcttttacagacagagtatctgtaaaaggggg

SEQ ID NO: 2034 - protein, 154 aa, Neisseria gonorrhoeae
VRNPFQTPDQQLHGSQWQSSPHWQLRLSIIFPHFAPAKPPICPPNAEPPSAPTHPPPAPPMAIPAGFPPVTNAPPAIPVNAPANDPKAPPTLLPTHSPETLPLCPQVPSVPPKTAVISFMVNSLISKLLLSSIEKLKGQIPYPCFYRQSICKRG

SEQ ID NO: 2035 - DNA, 213 bp, Neisseria gonorrhoeae
atggatttcgcacattacctgaaacactggaaagccgctgtgctgatttatcttgccatcagcatcctgaccgacatcctttgctattttttaaacttcgacggtgtgttttacaaaggcaggtttttttcggttaccgtcgcaggacctgtaggggctttgtcttttcttgcgtatctgctgtatttgaaacgcgaggaaaaccggtcgcat

SEQ ID NO: 2036 - protein, 71 aa, Neisseria gonorrhoeae
MDFAHYLKHWKAAVLIYLAISILTDILCYFLNFDGVFYKGRFFSVTVAGPVGALSFLAYLLYLKREENRSH

SEQ ID NO: 2037 - DNA, 801 bp, Neisseria gonorrhoeae
ttgacaaattgtttgcaattatacatcactctcaggacgctatgccgtctgaagcccgtgttccgacagatacgcaatgatttcgtcttcgtcgtccgatatggagaacaaagaagcggccccttcggaaatcataccgcgcgccaaaagctgcgcgtttatccactccgccaagcccgaccaaaacgcctttccaaccaaaacgaccggacgcggcggcactttgcccgtctgcaccaaggtcaggatttcaaacaattcgtccagcgtcccgaagccgcccggcatcacgacatatgcttgggaatagcggaaaaacactgccttgcgttcggcaaaacgggaaaaccgcaaggcgatgtcctgatacggattcggtttctgctcgtgcggcagggcaatgttcagccctaccgaaaccgacttcccggcaaacgcgcccttgtttgccgcctccataatccccggcccgccgcccgaaatgacggcaatacccgaatccgacagccgccgcgccagacggcaggcaaacgcataatccgcatgatcctgcggcgtgcgcgcgctgccgaaaatactgactgccggaaacacgtccgccaatgcttcgtctgcctgcctgcattcggcatcataacgtgcctgctccggcacgcggtttacattctccattccgtcctccgttcaaaaacggcgattgtaccccgtcaaaaacgcaacgcaagcaccgcaaagccgcacccgccttcccccaaccttttttcagacggcattttcggtaatctgctaaaatcgcccgct

SEQ ID NO: 2038 - protein, 267 aa, Neisseria gonorrhoeae
LTNCLQLYITLRTLCRLKPVFRQIRNDFVFVVRYGEQRSGPFGNHTARQKLRVYPLRQARPKRLSNQNDRTRRHFARLHQGQDFKQFVQRPEAARHHDICLGIAEKHCLAFGKTGKPQGDVLIRIRFLLVRQGNVQPYRNRLPGKRALVCRLHNPRPAARNDGNTRIRQPPRQTAGKRIIRMILRRARAAENTDCRKHVRQCFVCLPAFGIITCLLRHAVYILHSVLRSKTAIVPRQKRNASTAKPHPPSPNLFSDGIFGNLLKSPA

SEQ ID NO: 2039 - DNA, 450 bp, Neisseria gonorrhoeae
atgctgccctatacggcatttatcgaactgatggcgcaggctgtcggcgcatatgccggcatccaagcccgaaaaaacgcacggccggtccggctcggcttcctgcccggcacgcgcaaacttgaaatcttcgcccaatccgtccctgtcggaacacatttgccggcaacggcgcatatgtctatccaagatgccggggtatgggcgtgtccgactgcgaactgcgttggacggatgcgccggaaacttcgtccggaacactcctttcagacggcattttggcacgcgcctcactcaacgtgtacagccccgaacaccatgacggaacaactgacgccgtctgaacaggcacacatacggagaacaaccatgactgaaaccgtcctgattaccggctcaaacagaggcataggcaaagccgccgcactcggttttggcggacgacggctt

SEQ ID NO: 2040 - protein, 150 aa, Neisseria gonorrhoeae
MLPYTAFIELMAQAVGAYAGIQARKNARPVRLGFLPGTRKLEIFAQSVPVGTHLPATAHMSIQDAGVWACPTANCVGRMRRKLRPEHSFQTAFWHAPHSTCTAPNTMTEQLTPSEQAHIRRTTMTETVLITGSNRGIGKAAALGFGGRRL

SEQ ID NO: 2041 - DNA, 468 bp, Neisseria gonorrhoeae
atgaaatatcaccgcttggcattgtttgccgccataagctgcctgttgttgtccgccgtttttattgcaccttacctgacggcatttcacgaacaagaaaaaatatttgaatatgcggatttgaccgttaccgcccccaaccgcagcggacgggcaatcaaattggaggcggacgggcggcagtaccggctttcctgctacgggttcgacagtttgtgcacaggcggcaatatcggcagagccatcagggcgcggcaggttaagattgttttaagcgaaaccgtcggcaaaggttttttaaacggcgttctgttggaataccgcaacagtggcagtgtctatagcaataaagatttttcccgcacggaagaccgccttgtcgaagtgttggcacaacctgccgttttcagcctgaaaccgggtattttgcttttattgcccgccattttcctgcgtttgaaaaaaatg

SEQ ID NO: 2042 - protein, 156 aa, Neisseria gonorrhoeae
MKYHRLALFAAISCLLLSAVFIAPYLTAFHEQEKIFEYADLTVTAPNRSGRAIKLEADGRQYRLSCYGFDSLCTGGNIGRAIRARQVKIVLSETVGKGFLNGVLLEYRNSGSVYSNKDFSRTEDRLVEVLAQPAVFSLKPGILLLLPAIFLRLKKM

SEQ ID NO: 2043 - DNA, 765 bp, Neisseria gonorrhoeae
atggattatctgcaaaacctgtctttgggcttgacaaaaaagctgcccgttatactgcaaacagaagtagcggagtgtggcttggcatgtctagcggctgtggccggattttatggtttctatacggatttgcgcgcactgcgttcaaaatactgtctgtcacttaagggtgagaatttggcagatattgttcgttttgctgatgatatggggctgacgggacgggcgttgaggctggatttagacgaattgggcagtttgcgcctgccctgtattctacattgggatttgaatcattttgtggtgctggaatcggtatcttcggacggggctgccgtcatggatccggcttcgggacgacgcaaagtcaagacggaggaaatatcgcgcaagtttacgggaattgctttggaactgtggccaaacacgcgtttcgaggcaggggaagaaaagcaggaaatccgcatcctacccatgttgcgcgggatttctgggctggggcggacattgtttcagcttttggctttggcagcagcaatggaagtgtttgcttttttacaaaacgtcagcttcaagatcggacgtggtgaatcgcttgcgttaatcggacgatcgggctgcggtaaatcgacacttttggatattttaagcggcaatctacctcccgaatcaggcaaagtcatgataaatgggcacgacatttacagcttaccgccacgttttatccgcaatttgagtgcgatggtcaggcaggacgatgtttta

SEQ ID NO: 2044 - protein, 255 aa, Neisseria gonorrhoeae
MDYLQNLSLGLTKKLPVILQTEVAECGLACLAAVAGFYGFYTDLRALRSKYCLSLKGENLADIVRFADDMGLTGRALRLDLDELGSLRLPCILHWDLNHFVVLESVSSDGAAVMDPASGRRKVKTEEISRKFTGIALELWPNTRFEAGEEKQEIRILPMLRGISGLGRTLFQLLALAAAMEVFAFLQNVSFKIGRGESLALIGRSGCGKSTLLDILSGNLPPESGKVMINGHDIYSLPPRFIRNLSAMVRQDDVL

SEQ ID NO: 2045 - DNA, 279 bp, Neisseria gonorrhoeae
atgattcgcgaagaaatctccgccatgcctatgggctatgaaaccttgatcggcgatatgggcagcgcactgtcaggcggacaaaaacaacgtatcgtattggcgcgggccttatattgcgaaccgaaaatcctatttttagatgaagcggccagtcatttggatattgccaatgaaaaagcagtcaatgcaaacttgaatggcttgtctattataaaaattatggcggcacacagaaaggaaacggtggaatcagcagataggaaaatgtctttagga

SEQ ID NO: 2046 - protein, 93 aa, Neisseria gonorrhoeae
MIREEISAMPMGYETLIGDMGSALSGGQKQRIVLARALYCEPKILFLDEAASHLDIANEKAVNANLNGLSIIKIMAAHRKETVESADRKMSLG

SEQ ID NO: 2047 - DNA, 1224 bp, Neisseria gonorrhoeae
atgacctttttacaacgttggcaaggtttggcggacaataaaatctgtgcatttgcatggttcgtcatccgccgtttcagtgaagagcgcgtaccgcaggcagcggcgagcatgacgtttacgacactgctggcactcgtccccgtactgaccgtaatggtcgcggtcgcttcgattttccccgtgttcgaccgctggtcggattcgttcgtctccttcgtcaaccaaaccattgtgccgcagggcgcggatatggtgttcgactatatcgacgcattccgcgatcaggcaaaccggctgaccgccatcggcagcgtgatgctggtcgtaacctcgctgatgctgattcggacgatagacaatgcgttcaaccgcatctggcgggttaacacgcaacgcccctggatgatgcagttcctcgtttattgggcgttgctgactttcgggcctttgtctttgggtgtgggcatttcctttatggtcgggtcggttcaagactccgtactctcctccggagcgcaacaatgggcggacgcgttgaagacggcggcaaggctggctttcatgacgcttttgctgtgggggctgtaccgcttcgtgcccaaccgcttcgtgcccgcccggcaggcgtttgtcggagctttgattacggcattctgcctggagacggcacgtttcctgttcacctggtatatgggcaatttcgacggctaccgctcgatttacggcgcatttgccgccgtgccgtttttcctgctgtggttaaacctgctgtggacgctggtcttgggcggggcggtgctgacttcgtcgctgtcttattggcagggcgaggccttccgcaggggattcgactcgcgcggacggtttgacgacgtgttgaaaatcctgctgcttctggatgcggcgcaaaaagaaggccgaaccctgtccgttcaggagttcagacggcatatcaatatgggttacgatgaattgggcgagcttttggaaaagctggcgcggtacggctatatctattccggcagacagggctgggttttgaaaacgggggcggattcgattgagttgagcgaactcttcaagctcttcgtgtaccgcccgttgcctgtggaaagggatcatgtgaaccaagctgtcgatgcggtaatgacgccgtgtttgcagactttgaacatgacgctggcggagtttgacgctcaggcgaaaaaacagcagcagtct

SEQ ID NO: 2048 - protein, 408 aa, Neisseria gonorrhoeae
MTFLQRWQGLADNKICAFAWFVIRRFSEERVPQAAASMTFTTLLALVPVLTVMVAVASIFPVFDRWSDSFVSFVNQTIVPQGADMVFDYIDAFRDQANRLTAIGSVMLVVTSLMLIRTIDNAFNRIWRVNTQRPWMMQFLVYWALLTFGPLSLGVGISFMVGSVQDSVLSSGAQQWADALKTAARLAFMTLLLWGLYRFVPNRFVPARQAFVGALITAFCLETARFLFTWYMGNFDGYRSIYGAFAAVPFFLLWLNLLWTLVLGGAVLTSSLSYWQGEAFRRGFDSRGRFDDVLKILLLLDAAQKEGRTLSVQEFRRHINMGYDELGELLEKLARYGYIYSGRQGWVLKTGADSIELSELFKLFVYRPLPVERDHVNQAVDAVMTPCLQTLNMTLAEFDAQAKKQQQS

SEQ ID NO: 2049 - DNA, 378 bp, Neisseria gonorrhoeae
atgaacccaaatcccctcaaaatcctcgtcctctactattcccaaaacggcagcacccgcaatcccgcacgccgaatcactcgcggcatcgacagcgttgaaggttgcgaagccgtattgcgcaccgtccccaaagtgtccgccgtctgcgaagccgtcaaaaaagatattcccgacagcggctcccgtcctgaccgccgaagaaaacaatatcgccttcgcacaaggcagacgcttggcggaactcgccgtcaagtcggcatacgccgcgtgttcagacggcatggcgttcagatgccgtctgaacgcgtttgcctgtataatccgcgtctttactgtccaacttcgcggttcgcaaacctcccgcgttaccaaaac

SEQ ID NO: 2050 - protein, 126 aa, Neisseria gonorrhoeae
MNPNPLKILVLYYSQNGSTRNPARRITRGIDSVEGCEAVLRTVPKVSAVCEAVKKDIPDSGSRPDRRRKQYRLRTRQTLGGTRRQVGIRRVFRRHGVQMPSERVCLYNPRLYCPTSRFANLPRYQN

SEQ ID NO: 2051 - DNA, 414 bp, Neisseria gonorrhoeae
ttgacatatcgaatcctagttttggtaacgcgggaggtttgcgaaccgcgaagttggacagtaaagacgcggattatacaggcaaacgcgttcagacggcatctgaacgccatgccgtctgaacacgcggcgtatgccgacttgacggcgagttccgccaagcgtctgccttgtgcgaaggcgatattgttttcttcggcggtcaggacgggagccgctgtcgggaatatcttttttgacggcttcgcagacggcggacactttggggacggtgcgcaatacggcttcgcaaccttcaacgctgtcgatgccgcgagtgattcggcgtgcgggattgcgggtgctgccgttttgggaatagtagaggacgaggattttgaggggatttgggttcatgggcggattccgttaaaa

SEQ ID NO: 2052 - protein, 138 aa, Neisseria gonorrhoeae
LTYRILVLVTREVCEPRSWTVKTRIIQANAFRRHLNAMPSEHAAYADLTASSAKRLPCAKAILFSSAVRTGAAVGNIFFDGFADGGHFGDGAQYGFATFNAVDAASDSACGIAGAAVLGIVEDEDFEGIWVHGRIPLK

SEQ ID NO: 2053 - DNA, 663 bp, Neisseria gonorrhoeae
ttggcggacgacggctttgatatcgccgtccactgccgcagccgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggcctgacgcgcgacaatgccttccccgcgttttcagacgacgattgggatgtggtgccgcggactaatttggacggtttttacaatgtattgcatccgctggttatgccgatgatacgccgccgcaaagccggacggattgtgtgtatggcatcggtgtccggcctgacgggcaaccgggggcaggtcaattacagcgcgtcaaaagcgggcattatcggcgcggcaaaagccttggcggtcgaactggcgaaacgcaaaatcaccgtcaactgcgtggcgccgggtttgatggataccgatattatcgatgaaaacgtacccgtcggagaaatcttgaaagccgtccccgccgcgcgtatgggactgccggaagaagtggcgcacgcagtgcacttcctgatggatgaaaaagcggcgtatatcacgcgccaggtgattgcggtgaacggaggtttgtgt

SEQ ID NO: 2054 - protein, 221 aa, Neisseria gonorrhoeae
LADDGFDIAVHCRSRRDEAEAVAEEIRALGRNARVLQFDVSDREACREILTADIEANGAYYGVVLNAGLTRDNAFPAFSDDDWDVVPRTNLDGFYNVLHPLVMPMIRRRKAGRIVCMASVSGLTGNRGQVNYSASKAGIIGAAKALAVELAKRKITVNCVAPGLMDTDIIDENVPVGEILKAVPAARMGLPEEVAHAVHFLMDEKAAYITRQVIAVNGGLC

SEQ ID NO: 2055 - DNA, 102 bp, Neisseria gonorrhoeae
aaaacgcaacgcaagcaccgcaaagccgcacccgccttcccccaaccttttttcagacggcattttcggtaatctgctaaaatcgcccgcttgagtttccac

SEQ ID NO: 2056 - protein, 23 aa, Neisseria gonorrhoeae
KTQRKHRKAAPAFPQPFFRRHFR

SEQ ID NO: 2057 - DNA, 114 bp, Neisseria gonorrhoeae
atgccgtctgaaaatatttcagacggcattttgcctgttatgcttcccgatattttgcagacaacatatgcagccgtttttttcagacggcatttgagaaacatggaacaagta

SEQ ID NO: 2058 - protein, 38 aa, Neisseria gonorrhoeae
MPSENISDGILPVMLPDILQTTYAAVFFRRHLRNMEQV

SEQ ID NO: 2059 - DNA, 672 bp, Neisseria gonorrhoeae
atgtcaaaccaaaaagccttggtcatcttctcgggcggtcaggattcgaccacctgcctgattcaggcaatccaaacctacgggcgcgaaaacgtccaagccatcaccttccgatacgggcaacgccatgccgtcgagctggaacgcgcagagtggatcgcgcaggatttgggtgtcagtcaaaccgtactcgatttgagcctgatgcggcagattacgcacaacgccctgatggacgaaaccgccgccatcgaaaccgccgccatcgaaaccgccgacaacggcgttcccaatacctttgtggacgggcgtaacgcgcttttcctgctttacgccgccatttttgccaaagggcagggtatccggcacatcatcgcgggcgtgtgcgaaaccgatttttcgggctatcccgactgccgcggcgtgttcgtcaaatccatgaacgttacccttaatctggcgatggactacgattttcaaatccacacgccgctgatgtacctgaccaaggcgcaaacgtgggcgttggcggacgaaatgggcgtgttggactacatccgcgaacagacccacacctgctacaagggtatcgtcggcggctgccgcgaatgcccgagctgtatcttgcgcgaacgcgggctggcggaatgtctggaaagtaaaaaggccgtc

SEQ ID NO: 2060 - protein, 224 aa, Neisseria gonorrhoeae
MSNQKALVIFSGGQDSTTCLIQAIQTYGRENVQAITFRYGQRHAVELERAEWIAQDLGVSQTVLDLSLMRQITHNALMDETAAIETAAIETADNGVPNTFVDGRNALFLLYAAIFAKGQGIRHIIAGVCETDFSGYPDCRGVFVKSMNVTLNLAMDYDFQIHTPLMYLTKAQTWALADEMGVLDYIREQTHTCYKGIVGGCRECPSCILRERGLAECLESKKAV

SEQ ID NO: 2061 - DNA, 513 bp, Neisseria gonorrhoeae
atgcccaagctccatatgttttacctcggcggcaatgccggccggtcgaatatcgaagtgcacgacatccaatttgccgtgtgcgacgactaccgcgaagccgtccccgcactcaaagccgcgtggttcggcgatacggacaaaatccacatcgacggttggcaggttgtcgaatgggcggacggttacgacatcgccgtatccgaaacgcccaaaacgaaaatgccgcctgaaaacgctccgcgcctgtattttgccaatgtcggcggctatcgcgcggggcagcttgccgaggcgcacgcgttcgggctgttcgccgccgccacgcctgccgaagccaaacaaaaagccctgcaaaccctgttgaccgactatgttcggcagcataaagacaacttgaaagacgtggacaacctgcttgcgctcgagcacatcggcaatttccatatccgcctgaccccgaatccgcacggcaaacccgccgaaatcggctttcaaggctatttgcccatt

SEQ ID NO: 2062 - protein, 171 aa, Neisseria gonorrhoeae
MPKLHMFYLGGNAGRSNIEVHDIQFAVCDDYREAVPALKAAWFGDTDKIHIDGWQVVEWADGYDIAVSETPKTKMPPENAPRLYFANVGGYRAGQLAEAHAFGLFAAATPAEAKQKALQTLLTDYVRQHKDNLKDVDNLLALEHIGNFHIRLTPNPHGKPAEIGFQGYLPI

SEQ ID NO: 2063 - DNA, 1236 bp, Neisseria gonorrhoeae
ttgcgtggaaacatatccgctgcttcaaatgggcaaatagccttgaaagccgatttcggcgggtttgccgtgcggattcggggtcaggcggatatggaaattgccgatgtgctcgagcgcaagcaggttgtccacgtctttcaagttgtctttatgctgccgaacatagtcggtcaacagggtttgcagggctttttgtttggcttcggcaggcgtggcggcggcgaacagcccgaacgcgtgcgcctcggcaagctgccccgcgcgatagccgccgacattggcaaaatacaggcgcggagcgttttcaggcggcattttcgttttgggcgtttcggatacggcgatgtcgtaaccgtccgcccattcgacaacctgccaaccgtcgatgtggattttgtccgtatcgccgaaccacgcggctttgagtgcggggacggcttcgcggtagtcgtcgcacacggcaaattggatgtcgtgcacttcgatattcgaccggccggcattgccgccgaggtaaaacatatggagcttgggcatatcgtattccttgtgctttgcgcgcgttcagacggcctttttactttccagacattccgccagcccgcgttcgcgcaagatacagctcgggcattcgcggcagccgccgacgatacccttgtagcaggtgtgggtctgttcgcggatgtagtccaacacgcccatttcgtccgccaacgcccacgtttgcgccttggtcaggtacatcagcggcgtgtggatttgaaaatcgtagtccatcgccagattaagggtaacgttcatggatttgacgaacacgccgcggcagtcgggatagcccgaaaaatcggtttcgcacacgcccgcgatgatgtgccggataccctgccctttggcaaaaatggcggcgtaaagcaggaaaagcgcgttacgcccgtccacaaaggtattgggaacgccgttgtcggcggtttcgatggcggcggtttcgatggcggcggtttcgtccatcagggcgttgtgcgtaatctgccgcatcaggctcaaatcgagtacggtttgactgacacccaaatcctgcgcgatccactctgcgcgttccagctcgacggcatggcgttgcccgtatcggaaggtgatggcttggacgttttcgcgcccgtaggtttggattgcctgaatcaggcaggtggtcgaatcctgaccgcccgagaagatgaccaaggctttttggtt

SEQ ID NO: 2064 - protein, 412 aa, Neisseria gonorrhoeae
LRGNISAASNGQIALKADFGGFAVRIRGQADMEIADVLERKQVVHVFQVVFMLPNIVGQQGLQGFLFGFGRRGGGEQPERVRLGKLPRAIAADIGKIQARSVFRRHFRFGRFGYGDVVTVRPFDNLPTVDVDFVRIAEPRGFECGDGFAVVVAHGKLDVVHFDIRPAGIAAEVKHMELGHIVFLVLCARSDGLFTFQTFRQPAFAQDTARAFAAAADDTLVAGVGLFADVVQHAHFVRQRPRLRLGQVHQRRVDLKIVVHRQIKGNVHGFDEHAAAVGIARKIGFAHARDDVPDTLPFGKNGGVKQEKRVTPVHKGIGNAVVGGFDGGGFDGGGFVHQGVVRNLPHQAQIEYGLTDTQILRDPLCAFQLDGMALPVSEGDGLDVFAPVGLDCLNQAGGRILTAREDDQGFLV

SEQ ID NO: 2065 - DNA, 129 bp, Neisseria gonorrhoeae
gtgcaggttttggcatttgccgtcatgcccgtcgagcatatgcgaggagtcgaaggtaaatatcttggtaattttcatcccgattccttttcagtgaaaaccccgccgctttccgcccggagggtggct

SEQ ID NO: 2066 - protein, 43 aa, Neisseria gonorrhoeae
VQVLAFAVMPVEHMRGVEGKYLGNFHPDSFSVKTPPLSARRVA

SEQ ID NO: 2067 - DNA, 276 bp, Neisseria gonorrhoeae
atggtgatggatttcaccgacctcaaagccattgtaaaacaacacattaccgatcccttcgatcacgccttcatctaccacggcggcaatggccgcgaatctcaaatcgccgcgctcttggagggctggaacatgaaaaccctgcgcctgccctgccgcacaactgccgaaaatatggcggtcgaaatgtactgccgtctgaaaaacgcggggctgaacgtgtgccgcgtcaaattgtgggaaacgccgacatcgtgcgcggagtatgaaggggag

SEQ ID NO: 2068 - protein, 92 aa, Neisseria gonorrhoeae
MVMDFTDLKAIVKQHITDPFDHAFIYHGGNGRESQIAALLEGWNMKTLRLPCRTTAENMAVEMYCRLKNAGLNVCRVKLWETPTSCAEYEGE

SEQ ID NO: 2069 - DNA, 132 bp, Neisseria gonorrhoeae
atgcccaaccgcgtcattcccgcgcaggcgggaatccagaccttgatttatcaggaatatttaaaaattgcagcaattccaaatctctggattcccgcctgcgcgggaatgacagtgtggagcgtccttatt

SEQ ID NO: 2070 - protein, 44 aa, Neisseria gonorrhoeae
MPNRVIPAQAGIQTLIYQEYLKIAAIPNLWIPACAGMTVWSVLI

SEQ ID NO: 2071 - DNA, 1005 bp, Neisseria gonorrhoeae
atgaaattcccctccaccctcttagtcctcctcgtcgccgccgaacatttctacatcgcctggcttgaaatgacacagattcccggcgaaaaagcggcggaaatgttcaagctgccttacgaatttatggaacagaaacgcgtgcagaccctgtttggcaaccaagggctgtacaacggctttcttgccgtcgggcttttgtgggcgcagtttgccgctccggataatgccgtgtacggcgcgacggtactgtttctcggcttcgtcctgattgccgccgcgtggggtgcgttttcgtccggcaacaaaggcatacttgtcaaacagggttcgcccgccatttttggcagcggcggcggtgttggcggtatgaaaaaaatcagcgtcgcccccgaaaatccgcaataccgcatcgtcgaaatctttgaaagcctgcaaggcgagggctggaacacgggcatgcccgccgttttcgtccgcttgggcaaatgcaatctggcgtgcggctggtgtgataccgattatttgacattcggaatgatgagcctgtcagacatcttaggccgtctgaaaacctatgccgcccgcaacatcatcatcaccggcggagagccgaccatacagccgcatctcgatacgctgctggacgcgctcaaggcggaaggctatttcctctgtctcgaaaccaacgggctcaagcccgcgccgccgcaaatcgactatgtcgccaccagccccaaagcctgttatgccgccaaatacgaaaaaagctgtatcgaaacagccgacgaagtgcggattgttgccgacggcgatgccgtcggattctgcgaaaatatggaacgtaaaatccgcgcgcatcattactacctttcgccctgcgaacaagacggcgcaatgaacatttacgacaccatccgccaaatcggtattctgaacagccgccccgacgcgcccgtgcattggcagttgagcgtgcagacgcacaaatgggcgggaatagag

SEQ ID NO: 2072 - protein, 335 aa, Neisseria gonorrhoeae
MKFPSTLLVLLVAAEHFYIAWLEMTQIPGEKAAEMFKLPYEFMEQKRVQTLFGNQGLYNGFLAVGLLWAQFAAPDNAVYGATVLFLGFVLIAAAWGAFSSGNKGILVKQGSPAIFGSGGGVGGMKKISVAPENPQYRIVEIFESLQGEGWNTGMPAVFVRLGKCNLACGWCDTDYLTFGMMSLSDILGRLKTYAARNIIITGGEPTIQPHLDTLLDALKAEGYFLCLETNGLKPAPPQIDYVATSPKACYAAKYEKSCIETADEVRIVADGDAVGFCENMERKIRAHHYYLSPCEQDGAMNIYDTIRQIGILNSRPDAPVHWQLSVQTHKWAGIE

SEQ ID NO: 2073 - DNA, 99 bp, Neisseria gonorrhoeae
gtgtgccgcttccgcgtgaaactgccgacatttccgccgcccaatcaggacgaagccttaatgaataagatgccgcggttgggtacacgccaggcttcc

SEQ ID NO: 2074 - protein, 33 aa, Neisseria gonorrhoeae
VCRFRVKLPTFPPPNQDEALMNKMPRLGTRQAS

SEQ ID NO: 2075 - DNA, 1905 bp, Neisseria gonorrhoeae
ttgagtttccacagaaaaatccgaaaaatgaatattttttacgaagagtccggccagttcaaagttgccgtcgtcgtccaaaaaaacgacgctacctaccaagtcgatacccaacacggcaaacgcaccaaagtgaaggcaaacaatgtctttgccgagtttgacggcgatatggcggcgtttttggaaaacgctcaggcgcaggcggcggacatcgacaccgatttattgtgggaagtatgcggcgaagaggagtttaccgccgaagccatcgccgaagaatattacggccatgcgccgaccaaaaccgagctggcggcgactttgattgcgctgtacgccgcgccggtgtatttctacaaaaaagccaaaggcgtgttcaaagccgcgcccgaagaaactttgaaacaagcgcttgccgccatcgaacgcaaaaaacagcaagacgcgcaaatcgacgcttgggcggaagccttgaaacgcggcgagatgccgtctgaaatcgcggcggatttgagaaccatcttacacgcgcccgacaaacagtcgctgacctacaaagcctttaccaaagccgccgacgcactgaaaacctccgcctacgaactggcgaaaaaaacgggcggcattacgtccattccgcaatacctgcaagacggctttgaaatcaaatacttccccaaaggaacaggtttccccgacctctcccttcccgaaatgcccgacctgcccaaggccgacgttaccgccttttccattgacgacgaatcgaccaccgaagtggacgatgccttgagcctgaccgatttgggcaacggcacgaagcgcgtcggcatccacatcgccgcgccgtcgcttgccgtccgacaaggcggcggaatggaacaaatcattatgcagcggttgagtacggtttatttccccggcggcaaaatcacgatgctgcccgaaaactggattaccgcgttcagcctcgatgcaggcgcataccgccctgccgtcagcatttatttcgatgtggacggcgagttcaacgtcggcgagccgacctgcaaaatcgaagccgtcaacatcgccgcaaacctgcgtatccaagccatcgagccgcatttcaacgcagaaaccggcttggaccaagcaggcgaaatgatgttcgcccaccatcaagacctgatttggttctatcaattcgccaccgccctgcaaaaagcgcgcggcaaatacgaacccgaccgcgcgccgcaatacgattacagcatcgaattggatgaagaaggcaacgtctccgtcgtccgccgcgaacgcggttcgcccatcgatacgctggtcagcgagatgatgattcttgccaacagcacttgggcgcaaatgctagacgaaaacgggctgcccggccttttccgcgtccaaccggcaggcaaagtgcgcatgagcacccaatccgagccgcacatcggcatgggcgtgcagcattacggctggtttacctcgccgctgcgccgcgccgccgactacatcaaccaaaaacaactcctcagcctgatagacgacaccgccgagccgctcttccagcaaagcgatgccgaactcttcgccgccctgcgcgatttcgacaccgcctacgccgcctacgccgacttccaacggcagatggaagcctactggagcctcgtgtacctgcaacaacaaggcatcagcgaactgaccgcgacgattctgaaagaagacctcgtccgcatcgaaggtctgccactgacaacgcgcgcgaccggtattccgtttgacgcgctgcccaaatcgcaggcattgtttaaaatcaccgaattggatgccgagaagcagtttgtctcgctcaactacatcaaggcagccgcacccgggggcaaaacggcaggcaatgccgtc

SEQ ID NO: 2076 - protein, 635 aa, Neisseria gonorrhoeae
LSFHRKIRKMNIFYEESGQFKVAVVVQKNDATYQVDTQHGKRTKVKANNVFAEFDGDMAAFLENAQAQAADIDTDLLWEVCGEEEFTAEAIAEEYYGHAPTKTELAATLIALYAAPVYFYKKAKGVFKAAPEETLKQALAAIERKKQQDAQIDAWAEALKRGEMPSEIAADLRTILHAPDKQSLTYKAFTKAADALKTSAYELAKKTGGITSIPQYLQDGFEIKYFPKGTGFPDLSLPEMPDLPKADVTAFSIDDESTTEVDDALSLTDLGNGTKRVGIHIAAPSLAVRQGGGMEQIIMQRLSTVYFPGGKITMLPENWITAFSLDAGAYRPAVSIYFDVDGEFNVGEPTCKIEAVNIAANLRIQAIEPHFNAETGLDQAGEMMFAHHQDLIWFYQFATALQKARGKYEPDRAPQYDYSIELDEEGNVSVVRRERGSPIDTLVSEMMILANSTWAQMLDENGLPGLFRVQPAGKVRMSTQSEPHIGMGVQHYGWFTSPLRRAADYINQKQLLSLIDDTAEPLFQQSDAELFAALRDFDTAYAAYADFQRQMEAYWSLVYLQQQGISELTATILKEDLVRIEGLPLTTRATGIPFDALPKSQALFKITELDAEKQFVSLNYIKAAAPGGKTAGNAV

SEQ ID NO: 2077 - DNA, 132 bp, Neisseria gonorrhoeae
gtgtacccaaccgcggcatcttattcattaaggcttcgtcctgattgggcggcggaaatgtcggcagtttcacgcggaagcggcacactttccccgtatgtcaaacatcggcaaaacggtacgccggccctt

SEQ ID NO: 2078 - protein, 44 aa, Neisseria gonorrhoeae
VYPTAASYSLRLRPDWAAEMSAVSRGSGTLSPYVKHRQNGTPAL

SEQ ID NO: 2079 - DNA, 237 bp, Neisseria gonorrhoeae
ttgaaccttgccgataccctttgtcagtgcgcgcaaatggcaggattggggaaaacgaaatgccgtctgaaacagcattctgtttcagacggcatttttttgttgccgccaaaagggaaaaaccgccccggcaatcgatgtcgaggcggtctgaatatggtcggaatgagaggattcgaacctccgaccccttcgtcccgaacgaagtgcgctaccgggctgcgctacattccgaat

SEQ ID NO: 2080 - protein, 79 aa, Neisseria gonorrhoeae
LNLADTLCQCAQMAGLGKTKCRLKQHSVSDGIFLLPPKGKNRPGNRCRGGLNMVGMRGFEPPTPSSRTKCATGLRYIPN

SEQ ID NO: 2081 - DNA, 228 bp, Neisseria gonorrhoeae
ttgtcagtgcgcgcaaatggcaggattggggaaaacgaaatgccgtctgaaacagcattctgtttcagacggcatttttttgttgccgccaaaagggaaaaaccgccccggcaatcgatgtcgaggcggtctgaatatggtcggaatgagaggattcgaacctccgaccccttcgtcccgaacgaagtgcgctaccgggctgcgctacattccgaattaattaaggcg

SEQ ID NO: 2082 - protein, 76 aa, Neisseria gonorrhoeae
LSVRANGRIGENEMPSETAFCFRRHFFVAAKREKPPRQSMSRRSEYGRNERIRTSDPFVPNEVRYRAALHSELIKA

SEQ ID NO: 2083 - DNA, 165 bp, Neisseria gonorrhoeae
gtgattatagcgcaaaaaatacggcgtgcctataccgttttgcctttttgccgcgtgtcgggcggatttaaaaggcctctccgacttttacgccgcccgccgtgtcctgcggcgaggcaaggccggcaacaaaggcttgcgccgcttggaaacccattgtctgca

SEQ ID NO: 2084 - protein, 55 aa, Neisseria gonorrhoeae
VIIAQKIRRAYTVLPFCRVSGGFKRPLRLLRRPPCPAARQGRQQRLAPLGNPLSA

SEQ ID NO: 2085 - DNA, 1098 bp, Neisseria gonorrhoeae
ttggagcaaaccgcaatgaccgtcccccatattccgcgcggccccgtcatggcagacattgccgccttccgcctgaccgaagaagaaaaacaacgcctgctcgatcccgcaatcggcggcatcatcctcttccgccgcaacttccaaaacatcgaacaactcaaaacactcaccgccgaaatcaaagccctgcgcacacccgaactcattatcgccgtcgatcacgaaggcggcagggtgcaacgtttcatcgaaggttttacccgcctgcccgcaatgaacgttttagggcaaatttgggacaaagacggcgcgtccgccgccgaaaccgctgccggacaagtcggccgggttttggcaaccgagctttccgcctgcggcatcgatttgtccttcacgcccgtcttagatttggactggggaaactgcgccgtcatcggcaaccgcagcttccaccgcaatcccgaagcggtcgcccgcctcgccctcgcccttcaaaaaggtttggcaaaaggcggtatgaaatcatgcggcaaacattttcccggacacggatttgtcgaaggggacagccatttggtgctacccgaagacgggcgcagcctcgacgaactcgaagccgccgacctcgcccccttccgcattatgagccgcgaaggtatggcggcggtcatgcccgcccacgtcgtttatccgcaagtggacacaaagcccgcagggttttccgaaatctggctcaaacaaattttgcgccgcgatatcggattcaaaggcgtgattttttctgacgatttgaccatggagggcgcgtgcggggcaggcggcatcaaagaacgcgcccgcatttcctttgaggcaggttgcgacatcgtcctcgtctgcaaccgtcccgacttggtcgatgaattgcgcgacggtttcaccattcccgacaaccaggatttggccggacgttggcaatacatggaaaactcgctcggtcatgaggcggtacaagccgttatgcagacaatgggtttccaagcggcgcaagcctttgttgccggccttgcctcgccgcaggacacggcgggcggcgtaaaagtcggagaggccttt

SEQ ID NO: 2086 - protein, 366 aa, Neisseria gonorrhoeae
LEQTAMTVPHIPRGPVMADIAAFRLTEEEKQRLLDPAIGGIILFRRNFQNIEQLKTLTAEIKALRTPELIIAVDHEGGRVQRFIEGFTRLPAMNVLGQIWDKDGASAAETAAGQVGRVLATELSACGIDLSFTPVLDLDWGNCAVIGNRSFHRNPEAVARLALALQKGLAKGGMKSCGKHFPGHGFVEGDSHLVLPEDGRSLDELEAADLAPFRIMSREGMAAVMPAHVVYPQVDTKPAGFSEIWLKQILRRDIGFKGVIFSDDLTMEGACGAGGIKERARISFEAGCDIVLVCNRPDLVDELRDGFTIPDNQDLAGRWQYMENSLGHEAVQAVMQTMGFQAAQAFVAGLASPQDTAGGVKVGEAF

SEQ ID NO: 2087 - DNA, 1518 bp, Neisseria gonorrhoeae
atgcagctgattgactattcacattcatttttctcggttgtgccaccctttttggcactggcacttgccgtcattacccgccgcgtactgctgtctttaggcatcggtattttggtcggcgttgcctttttggtcggcggcaaccccgtcgacggtctgacacacctgaaagacatggtcgtcggcttggcttgggcagacggcgattggtcgctgggcaaaccaaaaatcttggttttcctgatacttttgggcattttcacttcactgctgacctactccggcagcaatcaggcgtttgccgactgggcaaaacggcacattaaaaaccggtgcggcgcgaaaatgctgaccgcctgcctcgtgttcgtaacctttatcgacgactatttccacagcctcgccgtcggtgcgattgcccgccccgttaccgacaagtttaaagtttcccgcgccaaactcgcctacatcctcgactccactgcctcgcccatgtgcgtgctgatgcccgtttcaagctggggcgcgtcgattatcgccacgcttgccggattgctcgttacctacaaaattaccgaatacacgccgatggggacgtttgtcgccatgagcctgatgaactattacgcgctgtttgccctgattatggtattcgtcgtcgcatggttctccttcgacatcggctcgatggcgcgtttcgaacaggctgcgttgaacgaagcccacgacgaaaccgccgcttcagacgctaccaaaggtcgtgtttacgcattgattattcccgttttggccttaatcgcctcaacggtttccgccatgatctacaccggcgcgcaggcaagcgaaaccttcagcattttgggggcatttgaaaataccgacgtaaacacttcgctggtattcggcggcacttgcggcgtgcttgccgtcgtcctctgcacgttcggcacgattaaaaccgccgattatcccaaagccgtgtggcagggtgcgaaatccatgttcggcgcaatcgccattttaatcctcgcctggctcatcagtacggttgtcggcgaaatgcacacgggcgactacctctccacgctggttgcgggcaacatccatcccggcttcctgcccgtcatcctcttcctgctcgccagcgtgatggcgtttgccacaggcacaagctgggggacgttcggcattatgctgccgattgccgccgccatggcggtcaaagtcgaacccgcgctgattatcccgtgtatgtccgcagtaatggcgggggcggtatgcggcgaccactgttcgcccatctccgacacgaccatcctgtcgtccaccggcgcgcgctgcaaccacatcgaccacgttacctcgcaactgccttatgccctgacggttgccgccgccgccgcatcgggctacctcgcattgggtctgacaaaatccgcgctgttgggctttggcacgaccggtattgtattggcggtgctgatttttctgttgaaagataaaaaacgcgccgacgtt

SEQ ID NO: 2088 - protein, 506 aa, Neisseria gonorrhoeae
MQLIDYSHSFFSVVPPFLALALAVITRRVLLSLGIGILVGVAFLVGGNPVDGLTHLKDMVVGLAWADGDWSLGKPKILVFLILLGIFTSLLTYSGSNQAFADWAKRHIKNRCGAKMLTACLVFVTFIDDYFHSLAVGAIARPVTDKFKVSRAKLAYILDSTASPMCVLMPVSSWGASIIATLAGLLVTYKITEYTPMGTFVAMSLMNYYALFALIMVFVVAWFSFDIGSMARFEQAALNEAHDETAASDATKGRVYALIIPVLALIASTVSAMIYTGAQASETFSILGAFENTDVNTSLVFGGTCGVLAVVLCTFGTIKTADYPKAVWQGAKSMFGAIAILILAWLISTVVGEMHTGDYLSTLVAGNIHPGFLPVILFLLASVMAFATGTSWGTFGIMLPIAAAMAVKVEPALIIPCMSAVMAGAVCGDHCSPISDTTILSSTGARCNHIDHVTSQLPYALTVAAAAASGYLALGLTKSALLGFGTTGIVLAVLIFLLKDKKRADV

SEQ ID NO: 2089 - DNA, 282 bp, Neisseria gonorrhoeae
atgatgctggcgggcggcggcgaagaattttgcccgtccgaagtgtatgttttcgactcgctctatgccgccagccgccgcaacggcgaaccggaagagaccccgcgtccatacgacgcgaaccgcgacgggctggtcatcggagaaaaggcgcggggattttcgtattggaagaattggaacacgccaaacggcgcggtgcgaaaatttacgccgaactcgtcggctacggcgccaacagcgacggcatcaatatcggcgaaggcgcagccgtattcatca

SEQ ID NO: 2090 - protein, 94 aa, Neisseria gonorrhoeae
MMLAGGGEEFCPSEVYVFDSLYAASRRNGEPEETPRPYDANRDGLVIGEKARGFSYWKNWNTPNGAVRKFTPNSSATAPTATASISAKAQPYSS

SEQ ID NO: 2091 - DNA, 333 bp, Neisseria gonorrhoeae
atgtttaaagattggaaagaacataccgcattggttaaaaaatcattcggcgagctgggtaaggcgcatcctaaaatactgcaagcctacggcgcattggaacaggccgccgccgccgaagcactcgatgccaaaacgcgcgaactgattgccatcgccgttgccatcaccacccgttgcgagagctgcatcagcgttcacgccgccgccgccgccaaagccggtgcgaccgacagcgagatcgcaggtgcattggcaaccgccattgccctgaatgcgggtgctgcttacacttacgccctgcgtgcattggaagcggttgaaacgcaaaaa

SEQ ID NO: 2092 - protein, 111 aa, Neisseria gonorrhoeae
MFKDWKEHTALVKKSFGELGKAHPKILQAYGALEQAAAAEALDAKTRELIAIAVAITTRCESCISVHAAAAAKAGATDSEIAGALATAIALNAGAAYTYALRALEAVETQK

SEQ ID NO: 2093 - DNA, 162 bp, Neisseria gonorrhoeae
gtgttaagcgtccggatgggtgggtatctgtccgcctccggtttgggttttgttggcaaaatgggtggaaatattttttgtcgtaaaaaatatttgtttaaaatcaaccaactgatttttgtaaaatgcccgttaatcggtattgacgggcattttatcatt

SEQ ID NO: 2094 - protein, 54 aa, Neisseria gonorrhoeae
VLSVRMGGYLSASGLGFVGKMGGNIFCRKKYLFKINQLIFVKCPLIGIDGHFII

SEQ ID NO: 2095 - DNA, 1497 bp, Neisseria gonorrhoeae
  MISC_FEATURE (1)..(1497): n = g, a, t, or c
gtgttcaaaaaataccaatacttcgctttggcggcactgtgtgccgccttgctggcaggctgcgaaaaggcaggcagctttttcggtgcggacaaaaaagaagcatccttcgtagaacgcatcgaacacaccaaagacgacggcagtgtcagtatgctgctgcccgactttgcccaactggttcaaagcgaaggcccggcagtcgtcaatattcaggcagcccccgccccgcgcacccaaaacggcagcggcaatgccgaaaccgattccgacccgcttgccgacagcgacccgttctacgaatttttcaaacgcctcgtcccgaacatgcccgaaatcccccaagaagaagcagatgacggcggattgaacttcggttcgggcttcatcatcagcaaaaacggctacatcctgaccaatacccacgtcgttgccggtatgggcagtatcaaagtcctgctcaacgacaagcgcgaatataccgccaaactcatcggttcggatgtccaatccgatgtcgcccttctgaaaatcgacgcaacggaagagctacccgtcgtcaaaatcggcaatcccaaaaatttgaaaccgggcgaatgggtcgctgccatcggcgcgcccttcggctttgacaacagcgtgaccgccggcatcgtgtccgccaaaggcagaagcctgcccaacgaaagctacacacccttcatccaaaccgacgttgccatcaatccgggcaattccggcggcccgctgttcaacttaaaaggacaggtcgtcggcatcaattcgcaaatatacagccgcagcggcggattcatgggcatctcctttgccatcccgattgacgttgccatgaatgtcgccgaacagctgaaaaacaccggcaaagtccaacgcggacaactgggcgtgattattcaggaagtatcctacggtttggcacagtcgttcggtctggataaagccagcggcgcattgattgccaaaatccttcccggcagccccgcagaacgtgccggcctgcaggcgggcgacatcgtcctcagcctcgacggcggagaaatacgttcttccggcgaccttcccgtcatggtcggcgccattacgccgggaaaagaagtcagcctcggcgtatggcgcaaaggcgaagaaatcacaatcaaagccaagctgggcaacgccgccgagcataccggcgcatcatccaaaacagatgaagccccctacaccgaacagcaatccggtacgttctcggtcgaatccgcaggcattacccttcagacacataccgacagcagcggcaaacacctcgtcgtcgtacgggtttccgacgcggcagaacgcgcaggcttaaggcgcggnnnnnnnnnnnnnnnnnnnnnnnnagtccccgtcaatgacgaagccggtttccgcaaagctatggacaaggcaggcaaaaacgtccccctgctggtcatgcgccgtggcaacacgctgttcatcgcattaaacctgcaa

SEQ ID NO: 2096 - protein, 499 aa, Neisseria gonorrhoeae
  MISC_FEATURE (1)..(499): Xaa = any amino acid
VFKKYQYFALAALCAALLAGCEKAGSFFGADKKEASFVERIEHTKDDGSVSMLLPDFAQLVQSEGPAVVNIQAAPAPRTQNGSGNAETDSDPLADSDPFYEFFKRLVPNMPEIPQEEADDGGLNFGSGFIISKNGYILTNTHVVAGMGSIKVLLNDKREYTAKLIGSDVQSDVALLKIDATEELPVVKIGNPKNLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKASGALIAKILPGSPAERAGLQAGDIVLSLDGGEIRSSGDLPVMVGAITPGKEVSLGVWRKGEEITIKAKLGNAAEHTGASSKTDEAPYTEQQSGTFSVESAGITLQTHTDSSGKHLVVVRVSDAAERAGLRRGXXXXXXXXVPVNDEAGFRKAMDKAGKNVPLLVMRRGNTLFIALNLQ

SEQ ID NO: 2097 - DNA, 96 bp, Neisseria gonorrhoeae
gtgcgaatatcccgccaaatcctgaccgccgccgcccttcaaaatgaaacgcttgaaaattcggacggacgttgtagaatttcaacctatgccgtc

SEQ ID NO: 2098 - protein, 32 aa, Neisseria gonorrhoeae
VRISRQILTAAALQNETLENSDGRCRISTYAV

SEQ ID NO: 2099 - DNA, 318 bp, Neisseria gonorrhoeae
gtgccggaagaccgcgaggctttggaatcgttgcctggcgtggggcgcaaaacggcaaacgtggtattgaacacagcgttcggacaccccgttatggcggtcgatacgcatattttccgcgtgtccaaccgaaccaaaatcgcacccggaaaagatgtacgcgaagtcgaagacaaactgatgcgcttcattcctaaagaatttctgatggacgcgcaccactggctgattttgcacggacgctacacctgcaaggctttaaagccgcaatgccaaacctgcatcatcaacgatttgtgcgaatatcccgccaaatcc

SEQ ID NO: 2100 - protein, 106 aa, Neisseria gonorrhoeae
VPEDREALESLPGVGRKTANVVLNTAFGHPVMAVDTHIFRVSNRTKIAPGKDVREVEDKLMRFIPKEFLMDAHHWLILHGRYTCKALKPQCQTCIINDLCEYPAKS

SEQ ID NO: 2101 - DNA, 321 bp, Neisseria gonorrhoeae
atgcgtatcgaccgccataacggggtgtccgaacgctgtgttcaataccacgtttgccgttttgcgccccacgccaggcaacgattccaaagcctcgcggtcttccggcacttagccgttgtatttttccagcacgatgcggcaggtttgcataatgtgtttggacttggttttatacagcccgatggttttcgtgtattccatcacgccgtccaagcccaaatccagcatcgcctgcggcgtatcggcaaccggaaacagcttcgccgtcgccttgtttacgccgacatcggtcgcctgcgccgaaagcagaacggcgat

SEQ ID NO: 2102 - protein, 107 aa, Neisseria gonorrhoeae
MRIDRHNGVSERCVQYHVCRFAPHARQRFQSLAVFRHLAVVFFQHDAAGLHNVFGLGFIQPDGFRVFHHAVQAQIQHRLRRIGNRKQLRRRLVYADIGRLRRKQNGD

SEQ ID NO: 2103 - DNA, 339 bp, Neisseria gonorrhoeae
atgccgaccgcacaaaccgactgcacaaaaaaaatgaacagacaaatccgccaagaaatcttcgagcgtttccgcgccgccaacccccatccgaccaccgagctgaatttcaactcccctttcgagcttttaatcgccgttctgctttcggcgcaggcgaccgatgtcggcgtaaacaaggcgacggcgaagctgtttccggttgccgatacgccgcaggcgatgctggatttgggcttggacggcgtgatggaatacacgaaaaccatcgggctgtataaaaccaagtccaaacacattatgcaaacctgccgcatcgtgctggaaaaatacaacggc

SEQ ID NO: 2104 - protein, 113 aa, Neisseria gonorrhoeae
MPTAQTDCTKKMNRQIRQEIFERFRAANPHPTTELNFNSPFELLIAVLLSAQATDVGVNKATAKLFPVADTPQAMLDLGLDGVMEYTKTIGLYKTKSKHIMQTCRIVLEKYNG

SEQ ID NO: 2105 - DNA, 600 bp, Neisseria gonorrhoeae
gtgcagtcggtttgtgcggtcggcattataacgcacggttcaggcggcgtaatattgcattccccacagaatgaaggcgtaacgcgccgttttgccgataaccagcatcagcccgcttgtccacggattcaaccgcagccagccggcggtaagcggcagtgcgtcgccgacgacgggcagccacgcaaacgcaagcagccaaataccgaaacgccgtatcagattcagtgttttttcagacggcatttttcgggaaggcagcaaacgtcccatccaataggaaaccatactgcccaatccgttggcaaggccggcgcacagcaacgcgccgtatgcgtgtttggggaagttgcggacgaacagggcgaaggcggcttcggacgtgccgggcaggagggtggcggaagtgaaggcggaaaaagcgagggcggcgtaggtgtaggagggtatcattgcaaacagtcccaaacaggtaaaaatcggcgacggattatacggtattttcacgcccccgccgaagggcggaggacggtgcaaaaatacggcacagccgtatgccccttttttgtcgggcatacgacattctttccgctccggttt

SEQ ID NO: 2106 - protein, 200 aa, Neisseria gonorrhoeae
VQSVCAVGIITHGSGGVILHSPQNEGVTRRFADNQHQPACPRIQPQPAGGKRQCVADDGQPRKRKQPNTETPYQIQCFFRRHFSGRQQTSHPIGNHTAQSVGKAGAQQRAVCVFGEVADEQGEGGFGRAGQEGGGSEGGKSEGGVGVGGYHCKQSQTGKNRRRIIRYFHAPAEGRRTVQKYGTAVCPFFVGHTTFFPLRF

SEQ ID NO: 2107 - DNA, 534 bp, Neisseria gonorrhoeae
atgcccgacaaaaaaggggcatacggctgtgccgtatttttgcaccgtcctccgcccttcggcgggggcgtgaaaataccgtataatccgtcgccgatttttacctgtttgggactgtttgcaatgataccctcctacacctacgccgccctcgctttttccgccttcacttccgccaccctcctgcccggcacgtccgaagccgccttcgccctgttcgtccgcaacttccccaaacacgcatacggcgcgttgctgtgcgccggccttgccaacggattgggcagtatggtttcctattggatgggacgtttgctgccttcccgaaaaatgccgtctgaaaaaacactgaatctgatacggcgtttcggtatttggctgcttgcgtttgcgtggctgcccgtcgtcggcgacgcactgccgcttaccgccggctggctgcggttgaatccgtggacaagcgggctgatgctggttatcggcaaaacggcgcgttacgccttcattctgtggggaatgcaatattacgccgcc

SEQ ID NO: 2108 - protein, 178 aa, Neisseria gonorrhoeae
MPDKKGAYGCAVFLHRPPPFGGGVKIPYNPSPIFTCLGLFAMIPSYTYAALAFSAFTSATLLPGTSEAAFALFVRNFPKHAYGALLCAGLANGLGSMVSYWMGRLLPSRKMPSEKTLNLIRRFGIWLLAFAWLPVVGDALPLTAGWLRLNPWTSGLMLVIGKTARYAFILWGMQYYAA

SEQ ID NO: 2109 - DNA, 807 bp, Neisseria gonorrhoeae
atgcaggtcgcgcaacaggttgacggttgcctgtccggctttttgttggaagatgtattgccgcacggaattgcggatacgttcctccggcgtgccggcatcgcgcacttcgttcaatttgatgatgtgccagccgaattgggtgcggacaggcgcgccgacctgtccgggtttgagcgcgtggacggcttcttcaaaggcgggaaccattacgccgtcggcaaaccagcccaagtcgccgccattgcccgcgcttgcgtcttgggaatatcggcgtgccaaacctgcgaaatccgtgccgttgcgcgcctggtcgtagattttgcggatggtactttccgcgccgacggcggcgtttttgctgtcggctttaatcaggatgtgttgggcgcggtattggcgcaacggtgcgccttcgggcagggtgatgccttgtttttgcgcctgctcgaggaaggcatcaatttcagcttcgctcacgcggctgttttgcatcactgcctgctggcggactttttcggcaatgatgttgtcggcaagctcgcggcgttgggtggggctgaggtttttgagggcgggattttgtgcgacgacggcatcgatttccgcttcacttgcctgaatgttgcggcgtttgcccgcctgtacaatcagggattggttgacaagctgcatcagcacctgtcgggacagctcggattcacttatctgcgcgtcttcgggcagggtggctttggcttcggcaacggcttcggcaagccggcggttggtgatgacttcgttgtcggcaacgacggcaatgccgtc

SEQ ID NO: 2110 - protein, 269 aa, Neisseria gonorrhoeae
MQVAQQVDGCLSGFLLEDVLPHGIADTFLRRAGIAHFVQFDDVPAELGADRRADLSGFERVDGFFKGGNHYAVGKPAQVAAIARACVLGISACQTCEIRAVARLVVDFADGTFRADGGVFAVGFNQDVLGAVLAQRCAFGQGDALFLRLLEEGINFSFAHAAVLHHCLLADFFGNDVVGKLAALGGAEVFEGGILCDDGIDFRFTCLNVAAFARLYNQGLVDKLHQHLSGQLGFTYLRVFGQGGFGFGNGFGKPAVGDDFVVGNDGNAV

SEQ ID NO: 2111 - DNA, 1251 bp, Neisseria gonorrhoeae
ttgaataccagaagggtcgcagtaacgggcataggcggcattaccgccttcggccgggattggcaaagcatacaggcagcattcaaagccgaaaaaaacgccgtcaaatatatggattggcgcgaacgtttccccgaattggaagcgcaactggatgcgccgattgaggattacgcgccgccgaaacattggacgcgcaagcggctcagaagtatggggcgcgtgtcgtacctgtgcgtcgatgcggcggagcaggctttgatggatgcaggtttgctcggggacgaaagcattaccgacggacggatgggcgttgcctgcggctcttccggcggcggcaccaaagacatcggagatgtgggagaattgttgctgaccggcacgtcgcgcaacttcggcgccaatacctatgtgcgtatgatgccgcacaccgccgacgccaatatcggcatctttttcggattaacaaggacgcatcatcccgacatcgagcgcgtgttcttcgggcagccaaggcataggttatgcttacgaggccatcaaatacggtctgaccgatatgatgctggcgggcggcggcgaagaattttgcccgtccgaagtgtatgttttcgactcgctctatgccgccagccgccgcaacggcgaaccggaagagaccccgcgtccatacgacgcgaaccgcgacgggctggtcatcggagaaaaggcgcggggattttcgtattggaagaattggaacacgccaaacggcgcggtgcgaaaatttacgccgaactcgtcggctacggcgccaacagcgacggcatcaatatcggcgaaggcgcagccgtattcatcatgacgcgcgatgcggatttttccggcggtatgcagcttctgggttacggcgcaagcagcgatgcctaccatatttccacgccccgccccgacgcaaaggcgcaatcctcgcctttcagacggcattgcagcacgccggccttgcgcccgaagacatcggccggattaatctgcacggcaccgggacgcaccacaacgacagtatggaaagccgcgccgttgcagcggttttcggcaacaatacgccctgcacgtccgccaagccgcaaaccggacacacgctgggcgcggcgggcgcaatcgaagccgcgttcgcgtggggcattgccgaccggcaaagcaatcccgaagggaaacttccgccccggctttgggacgggcagaacgaccccgacctgcccgccattaacc

SEQ ID NO: 2112 - protein, 417 aa, Neisseria gonorrhoeae
LNTRRVAVTGIGGITAFGRDWQSIQAAFKAEKNAVKYMDWRERFPELEAQLDAPIEDYAPPKHWTRKRLRSMGRVSYLCVDAAEQALMDAGLLGDESITDGRMGVACGSSGGGTKDIGDVGELLLTGTSRNFGANTYVRMMPHTADANIGIFFGLTRTHHPDIERVFFGQPRHRLCLRGHQIRSDRYDAGGRRRRILPVRSVCFRLALCRQPPQRRTGRDPASIRREPRRAGHRRKGAGIFVLEELEHAKRRGAKIYAELVGYGANSDGINIGEGAAVFIMTRDADFSGGMQLLGYGASSDAYHISTPRPDAKAQSSPFRRHCSTPALRPKTSAGLICTAPGRTTTTVWKAAPLQRFSATIRPARPPSRKPDTRWARRAQSKPRSRGALPTGKAIPKGNFRPGFGTGRTTPTCPPLT

SEQ ID NO: 2113 - DNA, 153 bp, Neisseria gonorrhoeae
ttgatgtgcgtattattgcaattattcagttgtgtttctcgtttaatcatctcattttatggttcaaaaagatttatggacattctggacaaactggtcgatctcgcccaattgacgggcagtgcggatgtgcagtgccttttgggcggacaa

SEQ ID NO: 2114 - protein, 51 aa, Neisseria gonorrhoeae
LMCVLLQLFSCVSRLIISFYGSKRFMDILDKLVDLAQLTGSADVQCLLGGQ

SEQ ID NO: 2115 - DNA, 147 bp, Neisseria gonorrhoeae
ttgatgccccgatgcggcatttccgaattttccggatacggcggaggattttcattttattgggaacggtttttgcaagcccgccggaattttttaaaatctattaaaacctatgcaaacaactgtaaaatattaatttctgctgct

SEQ ID NO: 2116 - protein, 49 aa, Neisseria gonorrhoeae
LMPRCGISEFSGYGGGFSFYWERFLQARRNFLKSIKTYANNCKILISAA

SEQ ID NO: 2117 - DNA, 105 bp, Neisseria gonorrhoeae
ttgaatttcagatcggcgcattgcctgcatccgataaagtttgcaaaatgttcaaatatcagtatgatttgcattgccgttaagaaatgtcaatttctattttct

SEQ ID NO: 2118 - protein, 35 aa, Neisseria gonorrhoeae
LNFRSAHCLHPIKFAKCSNISMICIAVKKCQFLFS

SEQ ID NO: 2119 - DNA, 1278 bp, Neisseria gonorrhoeae
atgtcaatttctattttcttgaaacgggcaatattccgacaccacgaaaggcaaatcatgtctgcgcaatcacaaaacaaccatacgtccccattggtcgtcttgaccacgctgttcttcatgatgggttttattacctgcatgaacgacatccttatccctcatttgaaagaaattttcgacctctcttacgttcaggcgatgctgattcaattttgcttttttaccgcctatgcggtaatgtccatcccgatgggggcttttgtcggcaaagtcggctacaaaaacggcgttatcggcggctttctgctgacggcggtcgggtgcctgctgttttatcctgctgcgggcagccattcttacgcggtatttttgggcgcgttgtttattttggcttccggcgtaacgctgcttcaggtcgccggtaatccttatgttaccctgctggcgaaacccggcaaggaatcggcaacgctgacgctggttcaggcgtttaacgctttgggtacgaccattgcgcctcaaatcggcgcgttcctgattttggcggacgcaacccaaaccgtcagcaaggcggaacagatttcttccgtacagattccctatttgggactggcggggctgctgattatccttgccgttttcgtgaaaatgatccggctgcccgacgcgcgcaaaattgccgccgaggaaagcgcgcacaaccacgacggcaaaaccggcgtatggcaatacaaacatctcgtgttcggtacggcaggcattttctgctacgtcggtgcggaggtgtctatcggttcgctgatggtcaatgtgttgggttatctgaaagggctggatcatgcttctgccgcgcattacctgtcgttttattggggcggagcgatggtcggacgtttcctcggttcggcggtaatggcgaaattcgcgcccaaccgttatttggcgtttaacgcatcggctgcggtcgtgctgcttgccgtcgcgatggcgacgggcagcggcaatgcggatgtggcgatgtggtcgctgcttgccatcggttttttcaactcgattatgttcccgacgattttctctttggcaaccaaagggttgggcaaattcaccaacgcggcttccggtgtgctgtgtaccgcgattgtcggcggtgcggtcgtgccggtaattcaaggttgggcggcggatacttacaccctgatgtcttcgtttgtcgtttccgttatctgttacctgtatatcgtgttttttgcggtgtacggatatagggcggacaaa

SEQ ID NO: 2120 - protein, 426 aa, Neisseria gonorrhoeae
MSISIFLKRAIFRHHERQIMSAQSQNNHTSPLVVLTTLFFMMGFITCMNDILIPHLKEIFDLSYVQAMLIQFCFFTAYAVMSIPMGAFVGKVGYKNGVIGGFLLTAVGCLLFYPAAGSHSYAVFLGALFILASGVTLLQVAGNPYVTLLAKPGKESATLTLVQAFNALGTTIAPQIGAFLILADATQTVSKAEQISSVQIPYLGLAGLLIILAVFVKMIRLPDARKIAAEESAHNHDGKTGVWQYKHLVFGTAGIFCYVGAEVSIGSLMVNVLGYLKGLDHASAAHYLSFYWGGAMVGRFLGSAVMAKFAPNRYLAFNASAAVVLLAVAMATGSGNADVAMWSLLAIGFFNSIMFPTIFSLATKGLGKFTNAASGVLCTAIVGGAVVPVIQGWAADTYTLMSSFVVSVICYLYIVFFAVYGYRADK

SEQ ID NO: 2121 - DNA, 1239 bp, Neisseria gonorrhoeae
atgttcagacggcatttctcaagaaaaagattatttgtccgccctatatccgtacaccgcaaaaaacacgatatacaggtaacagataacggaaacgacaaacgaagacatcagggtgtaagtatccgccgcccaaccttgaattaccggcacgaccgcaccgccgacaatcgcggtacacagcacaccggaagccgcgttggtgaatttgcccaaccctttggttgccaaagagaaaatcgtcgggaacataatcgagttgaaaaaaccgatggcaagcagcgaccacatcgccacatccgcattgccgctgcccgtcgccatcgcgacggcaagcagcacgaccgcagccgatgcgttaaacgccaaataacggttgggcgcgaatttcgccattaccgccgaaccgaggaaacgtccgaccatcgctccgccccaataaaacgacaggtaatgcgcggcagaagcatgatccagccctttcagataacccaacacattgaccatcagcgaaccgatagacacctccgcaccgacgtagcagaaaatgcctgccgtaccgaacacgagatgtttgtattgccatacgccggttttgccgtcgtggttgtgcgcgctttcctcggcggcaattttgcgcgcgtcgggcagccggatcattttcacgaaaacggcaaggataatcagcagccccgccagtcccaaatagggaatctgtacggaagaaatctgttccgccttgctgacggtttgggttgcgtccgccaaaatcaggaacgcgccgatttgaggcgcaatggtcgtacccaaagcgttaaacgcctgaaccagcgtcagcgttgccgattccttgccgggtttcgccagcagggtaacataaggattaccggcgacctgaagcagcgttacgccggaagccaaaataaacaacgcgcccaaaaataccgcgtaagaatggctgcccgcagcaggataaaacagcaggcacccgaccgccgtcagcagaaagccgccgataacgccgtttttgtagccgactttgccgacaaaagcccccatcgggatggacattaccgcataggcggtaaaaaagcaaaattgaatcagcatcgcctgaacgtaagagaggtcgaaaatttctttcaaatgagggataaggatgtcgttcatgcaggtaataaaacccatcatgaagaacagcgtggtcaagacgaccaatggggacgtatggttgttttg

SEQ ID NO: 2122 - protein, 413 aa, Neisseria gonorrhoeae
MFRRHFSRKRLFVRPISVHRKKHDIQVTDNGNDKRRHQGVSIRRPTLNYRHDRTADNRGTQHTGSRVGEFAQPFGCQRENRREHNRVEKTDGKQRPHRHIRIAAARRHRDGKQHDRSRCVKRQITVGREFRHYRRTEETSDHRSAPIKRQVMRGRSMIQPFQITQHIDHQRTDRHLRTDVAENACRTEHEMFVLPYAGFAVVVVRAFLGGNFARVGQPDHFHENGKDNQQPRQSQIGNLYGRNLFRLADGLGCVRQNQERADLRRNGRTQSVKRLNQRQRCRFLAGFRQQGNIRITGDLKQRYAGSQNKQRAQKYRVRMAARSRIKQQAPDRRQQKAADNAVFVADFADKSPHRDGHYRIGGKKAKLNQHRLNVREVENFFQMRDKDVVHAGNKTHHEEQRGQDDQWGRMVVL

SEQ ID NO: 2123 - DNA, 117 bp, Neisseria gonorrhoeae
atgccgtctgaaaacgtcgggcagattcggcatggtgtgttagaatccgttaactttatatcaaatcgggcaaagaatcatgtttgctttcaaatccttactcgatatgccgcgcgg

SEQ ID NO: 2124 - protein, 39 aa, Neisseria gonorrhoeae
MPSENVGQIRHGVLESVNFISNRAKNHVCFQILTRYAAR

SEQ ID NO: 2125 - DNA, 1350 bp, Neisseria gonorrhoeae
atgccgcgcggtgaggcacttgccgtcgtcgtcgctctgattgccgcaatgggctataccatcatttcattggagtggctgccgcatatgtccattattgccgccatcgtcgtgctgattttgtacggcttggcgcgcggtttgaaatacaacgatatgcaggcagggatgataggcgcgttgaatcagggtatgggcgcggtttacctgtttttcttcatcgggctgatggtcagcgcgctgatgatgagcggcgcgattccgacgctgatgtattacggtttcgggctgatttccccgacttatttttatttttccgccttcgcgctgtgttccgtcatcggcgtgtccatcggcagcagcctgaccgcctgcgccactgtcggcgttgcctttatggggatggcggcggcgtttcaggccgatatggcgatgacggcgggcgcgattgtttccggtgtgtttttcggcgataaaatgtccccgctttccgacaccacgggcatttccgcgtccatcgtcggtatcgacctgtttgaacacatcaaaaacatgatgtacaccaccatccctgcgtggcttatcagcgcggcactgatgctttggcttcttcccagcgtcgccgcgcaggatttgaacagcgtcgaatccttccgcagccagcttgaagccacgggattggtgcacggctattcgctgattccgtttgcactgttggtcgttttggcattgatgcgcgtcaatgccgtggtcgccatgctctttaccgtcattgccgccgttgccgtaacgtatctgcacagcacgcccgatctgcgtcagctcggcgcgtggttttatggcggctacaaactcgaaggcgaagcgtttaaagacattgccaaactgatttcgcgcggcggcttggagagtatgttctttacgcagaccatcgttatcctcggtatgagtttgggcgggctgctgtttgcgctcggtgtgattccttccttgctggaggccgtccgtaccttcttgacgaatgccggacgcgcgacgttcagcgttgccatgacttcggtcggggtcaatttcctgattggagagcaatatttgagcatcctgctttcgggagaaacgttcaaacccgtttacgacaaactcggcctgcattcgtgcaacctgtcgcggactctggaagatgcggggacggtgattaacccgctcgtgccgtggagcgtgtgcggcgtatttatcagccacgcccttggcgtacccgtttgggaatatctgccttatgcctttttctgctatttgagtttggctttaaccctgttattcggctggacggggctgactttgagcaaaaaa

SEQ ID NO: 2126 - protein, 450 aa, Neisseria gonorrhoeae
MPRGEALAVVVALIAAMGYTIISLEWLPHMSIIAAIVVLILYGLARGLKYNDMQAGMIGALNQGMGAVYLFFFIGLMVSALMMSGAIPTLMYYGFGLISPTYFYFSAFALCSVIGVSIGSSLTACATVGVAFMGMAAAFQADMAMTAGAIVSGVFFGDKMSPLSDTTGISASIVGIDLFEHIKNMMYTTIPAWLISAALMLWLLPSVAAQDLNSVESFRSQLEATGLVHGYSLIPFALLVVLALMRVNAVVAMLFTVIAAVAVTYLHSTPDLRQLGAWFYGGYKLEGEAFKDIAKLISRGGLESMFFTQTIVILGMSLGGLLFALGVIPSLLEAVRTFLTNAGRATFSVAMTSVGVNFLIGEQYLSILLSGETFKPVYDKLGLHSCNLSRTLEDAGTVINPLVPWSVCGVFISHALGVPVWEYLPYAFFCYLSLALTLLFGWTGLTLSKK

SEQ ID NO: 2127 - DNA, 375 bp, Neisseria gonorrhoeae
ttgcagcacgccggccttgcgcccgaagacatcggccggattaatctgcacggcaccgggacgcaccacaacgacagtatggaaagccgcgccgttgcagcggttttcggcaacaatacgccctgcacgtccgccaagccgcaaaccggacacacgctgggcgcggcgggcgcaatcgaagccgcgttcgcgtggggcattgccgaccggcaaagcaatcccgaagggaaacttccgccccggctttgggacgggcagaacgaccccgacctgcccgccattaacctgaccggcgacggctgggaaaccgaaaaacgcattgccgccagctcgtcgtttgccttcgggggaagcaactgcgtcttaatcatcgga

SEQ ID NO: 2128 - protein, 125 aa, Neisseria gonorrhoeae
LQHAGLAPEDIGRINLHGTGTHHNDSMESRAVAAVFGNNTPCTSAKPQTGHTLGAAGAIEAAFAWGIADRQSNPEGKLPPRLWDGQNDPDLPAINLTGDGWETEKRIAASSSFAFGGSNCVLIIG

SEQ ID NO: 2129 - DNA, 840 bp, Neisseria gonorrhoeae
atgtgcagtgccttttgggcggacaatgatgaaaccttgcaacgcgaagggctggtacacattgttacggcgggcagcggttatctctgcatcgacggcgaaacttccccgcgtccggtcggcacgggcgatattgtatttttcccgcgcggcttgggtcatgtgttgagccacgacggaaaatacggagaaagtttacaaccggacatacgacaaaacggcacatttatggtcaaacagtgcggcaacgggctggatatgagcctgttttgcgcccgtttccgctacgacacccacgccgatttgatgaacgggctgccggaaaccgtttttctgaacattgcccatccaagtttgcagtatgtggtttcaatgctgcaactggaaagcgaaaaacctttgacggggacggtttccgtggtcaacgcattaccgtccgtcctgctggtgcttatcctgcgcgcctatctcgaacaggataaggatgtcgaactctcgggcgtattgaaaggttggcaggacaaacgtttgggacatttgatccaaaaggtgatagacaaaccggaagacgaatggaatattgacaaaatggttgccgccgccaatatgtcgcgcgcgcaactgatgcgccgcttcaaaagccaagtcggactcagcccgcacgcctttgtgaaccatatccgcctgcaaaaaggcgcattgctgctgaagaaaaccccggattcggttttggaggtcgcgctgtcggtgggctttcagtcggaaacgcatttcggcaaggcgttcaaacggcaatatcacgtttcgccggggcaataccggaaagaaggcgggcaaaaa

SEQ ID NO: 2130 - protein, 280 aa, Neisseria gonorrhoeae
MCSAFWADNDETLQREGLVHIVTAGSGYLCIDGETSPRPVGTGDIVFFPRGLGHVLSHDGKYGESLQPDIRQNGTFMVKQCGNGLDMSLFCARFRYDTHADLMNGLPETVFLNIAHPSLQYVVSMLQLESEKPLTGTVSVVNALPSVLLVLILRAYLEQDKDVELSGVLKGWQDKRLGHLIQKVIDKPEDEWNIDKMVAAANMSRAQLMRRFKSQVGLSPHAFVNHIRLQKGALLLKKTPDSVLEVALSVGFQSETHFGKAFKRQYHVSPGQYRKEGGQK

SEQ ID NO: 2131 - DNA, 93 bp, Neisseria gonorrhoeae
ttgtatcgacttaatcctgaaacacaaaaggcaggattaagacacaacaaagcagtaagctttatcaaagtagggatttcaagtttgcttact

SEQ ID NO: 2132 - protein, 31 aa, Neisseria gonorrhoeae
LYRLNPETQKAGLRHNKAVSFIKVGISSLLT

SEQ ID NO: 2133 - DNA, 165 bp, Neisseria gonorrhoeae
gccaaaggcaggcgaagtaccgccgggcttcggtaccttgtgccaaggcaggcgaagtaccgcactttgcgggcgaagccgcaaacagccgagaagcgcggggggattggcgataagcgcgagggggtgtccccacagcgctgccgcgccgcgaatgcggagcaa

SEQ ID NO: 2134 - protein, 55 aa, Neisseria gonorrhoeae
AKGRRSTAGLRYLVPRQAKYRTLRAKPQTAEKRGGIGDKREGVSPQRCRAANAEQ

SEQ ID NO: 2135 - DNA, 285 bp, Neisseria gonorrhoeae
ttggcactttataaatatcagccgtcaagcgagtattttgggcaatcgatggcggttatagcgcaatctgaatttgttgaatttgcgaagattaataagtctgaaaatgttattgattgtttctcttttttctggaatagaagaatcaaacatgacatttggttaatatcatttcctgataattcggaaatggtaattaaagaatccttgaacgatggtcacaaaacatacaaatttgaattttgcgaaattgtcgataattgcaattttgatgatgtattcgtt

SEQ ID NO: 2136 - protein, 95 aa, Neisseria gonorrhoeae
LALYKYQPSSEYFGQSMAVIAQSEFVEFAKINKSENVIDCFSFFWNRRIKHDIWLISFPDNSEMVIKESLNDGHKTYKFEFCEIVDNCNFDDVFV

SEQ ID NO: 2137 - DNA, 201 bp, Neisseria gonorrhoeae
ttgcccgtttttgaggattcgcaaatgggagataagcaagggatgacaaaggcggttgccggcgtgatgacggacgcgccggcggacggcaggaagccggcaaccgcttcgaatcttccccccccttatctaacagggggggtacagaaaccgaaacggcgggcagggttcaggaagtcttcgaatgttacgaaacgtaca

SEQ ID NO: 2138 - protein, 67 aa, Neisseria gonorrhoeae
LPVFEDSQMGDKQGMTKAVAGVMTDAPADGRKPATASNLPPPYLTGGVQKPKRRAGFRKSSNVTKRT

SEQ ID NO: 2139 - DNA, 822 bp, Neisseria gonorrhoeae
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacaacatccactccgtttccgccgaacgctggcgcatccacgcggctaccgaaatcgaagacatcaacgcctttttcggtacggaatacggcagcgaagaagccgacaccatcggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaag

SEQ ID NO: 2140 - protein, 274 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADNIHSVSAERWRIHAATEIEDINAFFGTEYGSEEADTIGGLVIQELGHLPVRGEKVLIGGLQFTVARADNRRLHTLMATRVK

SEQ ID NO: 2141 - DNA, 633 bp, Neisseria gonorrhoeae
atgttcaatgcgttcaaagaatggaaacggcgtggagtctatcatattttgaacgtttcttcagacggcaccgtcaggtctatgttatatttacgcccacaaaacacgaaacccgccacaatgaaacgcgccaaaaaataccctttcttaacgttgcagcggcaacgtttccatttgaactttgaaaacgcctcttccgccgccggcatccccgccgaacgcgatttttaccgctgggcgtggtctgccttgaaaaacgaatacctccgcgccgacatcggtttgattcttttggacgaagaagaagcccgcgcctacaaccgcgactaccggggcaaagattatgccaccaatgtattgagtttcgcgctcaacgaaggcgaaatcctgccctgccaagtttcggaaagactgtacggcgatttgattatctgcccgcaagtcgttttaaaagaagccgccgaacagggcaaaacgcctgaacggcattttgcccacttaaccatacacggcacgctgcacctgatgggatacgaccacatcaaagacgatgaggccgaaataatggaagccgaagaaatccgcctgatgcgggcggcaggctatcccaacccctaccgagaggacggacat

SEQ ID NO: 2142 - protein, 211 aa, Neisseria gonorrhoeae
MFNAFKEWKRRGVYHILNVSSDGTVRSMLYLRPQNTKPATMKRAKKYPFLTLQRQRFHLNFENASSAAGIPAERDFYRWAWSALKNEYLRADIGLILLDEEEARAYNRDYRGKDYATNVLSFALNEGEILPCQVSERLYGDLIICPQVVLKEAAEQGKTPERHFAHLTIHGTLHLMGYDHIKDDEAEIMEAEEIRLMRAAGYPNPYREDGH

SEQ ID NO: 2143 - DNA, 948 bp, Neisseria gonorrhoeae
ttgaacgcattgaacatgaacccgaaaaaacttgttatcgccagccgcgaaagcctgcttgccatgtggcaggcgaaacatatccaaggccgtctgaaggcgctgtatcccgattgcgaagtcgaaattttgggcatgaccacgcgcggcgaccggattttggacagaactttgtcaaaagtcggcgggaaaggcttgtttgtcaaagagttggaacaatcccttcaagacgggcgcgccgatttggcggtgcattcgattaaggacgtgccgatggatttgcccgaaggcttcgcccttgccgccatcagcgaacgcgccaatccgtttgacgcgtttgtgtccaaccgatacgcgcgtttggaagaaatgcccgaaggcgcggttgtcggcacatccagcctgcgccgcgaagcccagttgcgcgcgcgctatccgcatttggtaattaaacccctgcgcggcaatgtacaaacccgtttgtccaaactcgacaacggcgaatacgatgcaattatcttggctgccgccgggttgcagcgtctggaattggatgaacgcatccgcatgattttgtcggaatccgacagcctgcctgccgccggacaaggcgcattgggtattgaaattgccacgcatcgcgaagatttgtacgaagtcttgaagccgttaaaccacgataccacacacgcctgcgttaccgccgaacgcgctttggcgcgcgctttgggcggaagctgccaagtgccgctggccgcgtattgcactgaagaaaacgggctgctgatcttgcgcggattggtcgggcatcccgacggatcgattgtgttgcaggcggacgcgcaagcccctgccggatatgccgatgcgcttggacgtgcggttgccaaaaaactggcggacgacggtgcgcaggaattgattggagcagtattgaatacggaaaat

SEQ ID NO: 2144 - protein, 316 aa, Neisseria gonorrhoeae
LNALNMNPKKLVIASRESLLAMWQAKHIQGRLKALYPDCEVEILGMTTRGDRILDRTLSKVGGKGLFVKELEQSLQDGRADLAVHSIKDVPMDLPEGFALAAISERANPFDAFVSNRYARLEEMPEGAVVGTSSLRREAQLRARYPHLVIKPLRGNVQTRLSKLDNGEYDAIILAAAGLQRLELDERIRMILSESDSLPAAGQGALGIEIATHREDLYEVLKPLNHDTTHACVTAERALARALGGSCQVPLAAYCTEENGLLILRGLVGHPDGSIVLQADAQAPAGYADALGRAVAKKLADDGAQELIGAVLNTEN

SEQ ID NO: 2145 - DNA, 195 bp, Neisseria gonorrhoeae
ttgtttttaattaatttatttaataagttttactcaccttatttcgtcattcccgcgcaggcgggaatccagtttgctcggtttcagttgtttttaatcaattcttgcagcattgggtttccagattcccgcctgcgcgggaatgacggcggaaaggtttttgtggcttcggataatactgtggcgttcaaattt

SEQ ID NO: 2146 - protein, 65 aa, Neisseria gonorrhoeae
LFLINLFNKFYSPYFVIPAQAGIQFARFQLFLINSCSIGFPDSRLRGNDGGKVFVASDNTVAFKF

SEQ ID NO: 2147 - DNA, 168 bp, Neisseria gonorrhoeae
ttgggtttccagattcccgcctgcgcgggaatgacggcggaaaggtttttgtggcttcggataatactgtggcgttcaaattttgaatttgagaatgatgatattcgtattttttattgtggctgtactagattatccctaaattccacaccaatcccgcaggatttt

SEQ ID NO: 2148 - protein, 56 aa, Neisseria gonorrhoeae
LGFQIPACAGMTAERFLWLRIILWRSNFEFENDDIRIFYCGCTRLSLNSTPIPQDF

SEQ ID NO: 2149 - DNA, 309 bp, Neisseria gonorrhoeae
ttgctccctgccgtcaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgacttaactccggcacaccgtcccggcagctaaaaatcctgcgggattggtgtggaatt

SEQ ID NO: 2150 - protein, 103 aa, Neisseria gonorrhoeae
LLPAVKKKIMPDGIVYADSPGSRGKLDAGGFTRCRINRSKEFADRRNHINGIGNFWNQAKRALRKYNGIDRKPFPPLLRECEFRLNSGTPSRQLKILRDWCGI

SEQ ID NO: 2151 - DNA, 999 bp, Neisseria gonorrhoeae
gcggatgtcgacatacgcgccggaatgcaggtcgcgcaacaggttgacggttgcctgtccggctttttgttggaagatgtattgccgcacggaattgcggatacgttcctccggcgtgccggcatcgcgcacttcgttcaatttgatgatgtgccagccgaattgggtgcggacaggcgcgccgacctgtccgggtttgagcgcgtggacggcttcttcaaaggcgggaaccattacgccgtcggcaaaccagcccaagtcgccgccattgcccgcgcttgcgtcttgggaatatcggcgtgccaaacctgcgaaatccgtgccgttgcgcgcctggtcgtagattttgcggatggtactttccgcgccgacggcggcgtttttgctgtcggctttaatcaggatgtgttgggcgcggtattggcgcaacggtgcgccttcgggcagggtgatgccttgtttttgcgcctgctcgaggaaggcatcaatttcagcttcgctcacgcggctgttttgcatcactgcctgctggcggactttttcggcaatgatgttgtcggcaagctcgcggcgttgggtggggctgaggtttttgagggcgggattttgtgcgacgacggcatcgatttccgcttcacttgcctgaatgttgcggcgtttgcccgcctgtacaatcagggattggttgacaagctgcatcagcacctgtcgggacagctcggattcacttatctgcgcgtcttcgggcagggtggctttggcttcggcaacggcttcggcaagccggcggttggtgatgacttcgttgtcggcaacgacggcaatgccgtctgaaaagcggataccgccctgctgttgtgcgggtgcggcttctttttgcgccgtggcggcagctttgaccgctttggcgggcgcggtttttgccttttgcggtgcggcgtggacatcggctgctgccagcaatgcggcggcaatcatcagggctttgattttcatcat

SEQ ID NO: 2152 - protein, 277 aa, Neisseria gonorrhoeae
ADVDIRAGMQVAQQVDGCLSGFLLEDVLPHGIADTFLRRAGIAHFVQFDDVPAELGADRRADLSGFERVDGFFKGGNHYAVGKPAQVAAIARACVLGISACQTCEIRAVARLVVDFADGTFRADGGVFAVGFNQDVLGAVLAQRCAFGQGDALFLRLLEEGINFSFAHAAVLHHCLLADFFGNDVVGKLAALGGAEVFEGGILCDDGIDFRFTCLNVAAFARLYNQGLVDKLHQHLSGQLGFTYLRVFGQGGFGFGNGFGKPAVGDDFVVGNDGNAV

SEQ ID NO: 2153 - DNA, 504 bp, Neisseria gonorrhoeae
ttgattataatggcgggtatgaaaaaataccttatccctctttccattgcggcagtcctttccgggtgccagtctatttatgtgcccacattgacggaaatccccgtgaatcccatcaataccgtcaaaacggaagcacctgcaaaaggttttcgcctcgccccttcgcattgggcggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcggtagacagccagcgcggcgaaatcaatacggaacagtccaagctgtatatcgagaatgccttgcgcggctggcagcagcgttggaaaaatatggatgccaaacccgataatcccgcatttaccaactttttgatggaagtgatgaagatgcagcccttgaaa

SEQ ID NO: 2154 - protein, 168 aa, Neisseria gonorrhoeae
LIIMAGMKKYLIPLSIAAVLSGCQSIYVPTLTEIPVNPINTVKTEAPAKGFRLAPSHWADVAKISDEATRLGYQVGIGKMTKVQAAQYLNNFRKRLVGRNAVDDSMYEIYLRSAVDSQRGEINTEQSKLYIENALRGWQQRWKNMDAKPDNPAFTNFLMEVMKMQPLK

SEQ ID NO: 2155 - DNA, 90 bp, Neisseria gonorrhoeae
ttgttttttaacaaaaaacagatgccgtctgaactggttaaggttcaggcggcattttcatatggctgcgctttttacagtatattcaat

SEQ ID NO: 2156 - protein, 30 aa, Neisseria gonorrhoeae
LFFNKKQMPSELVKVQAAFSYGCAFYSIFN

SEQ ID NO: 2157 - DNA, 150 bp, Neisseria gonorrhoeae
ttgtttgaaattgttatagtttattgttttttaacaaaaaacagatgccgtctgaactggttaaggttcaggcggcattttcatatggctgcgctttttacagtatattcaattaaaaacaaaatagtacaacactcgacgttgaaggtt

SEQ ID NO: 2158 - protein, 50 aa, Neisseria gonorrhoeae
LFEIVIVYCFLTKNRCRLNWLRFRRHFHMAALFTVYSIKNKIVQHSTLKV

SEQ ID NO: 2159 - DNA, 294 bp, Neisseria gonorrhoeae
atggcatactctgcggacttaagaaacaaagctttaaaccatagcggattaacaaaaatcaggacaaggcggcggaccgcaggcagtacgaatggtacggaaccggttcgcccggcgctccatcaccttagggaatcgttccctttgggccggggcggggcaacgccgtaccggtttttgttaatccgctatattacggacaatgcaaaaacaccggccaaaccgcagcaacgtttaacttgtcaagaaacacgctttacctgcggattcgccttaaaaaacaaacaggcagcc

SEQ ID NO: 2160 - protein, 98 aa, Neisseria gonorrhoeae
MAYSADLRNKALNHSGLTKIRTRRRTAGSTNGTEPVRPALHHLRESFPLGRGGATPYRFLLIRYITDNAKTPAKPQQRLTCQETRFTCGFALKNKQAA

SEQ ID NO: 2161 - DNA, 678 bp, Neisseria gonorrhoeae
atgccgccaaatcggataggcaaaaaccggctcgatatgtcgggcggcatccggatgcctgtctgcatgaaatcgccaaacattttgattgtacggcagccgccgtttgccatgcgcccaaacagatgcggatggcgcgcaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagggtgaaaagataccggcgcttatctttggtgtccgcacaagtcggcaaccggccgattgctccgatggtttgtcaaaatacggtggccggggtcttttttgaagcgcggtttcagcaatgcctactgcccgcattggctcaaaaatcggtgattatttcagataatgcgcgatttcgccgtatgggtgccttacggggaacggcggaaaaattgggacataaggtattgcctcccgcaccttattcgcctgagcccaacccgattgagaaagtgtgggcgaatattaagcggtatctgcgaaccgttttgtctgattacgcccgatttgacgatgcactactgtcctattttgattttaat

SEQ ID NO: 2162 - protein, 226 aa, Neisseria gonorrhoeae
MPPNRIGKNRLDMSGGIRMPVCMKSPNILIVRQPPFAMRPNRCGWRAKKTAAYKGQDPAKVTHYLTRPAGFSDCQRVCPDETGFDRRLFRPYARSLKGQMAKARIRVKRYRRLSLVSAQVGNRPIAPMVCQNTVAGVFFEARFQQCLLPALAQKSVIISDNARFRRMGALRGTAEKLGHKVLPPAPYSPEPNPIEKVWANIKRYLRTVLSDYARFDDALLSYFDFN

SEQ ID NO: 2163 - DNA, 267 bp, Neisseria gonorrhoeae
ttgctgcctgtacaatatcatttccttttccactcaaaccatcaggatttcccaatgcccacccaattcgatgtcgccgtaatcggcgcaggtccggcaggttcggccgcatccgccctgctccgcaaaaaaggttatcaagtctgcgtgttggaaaacagcactttccgcgcttcgtcatcggcgaaagcctgctgccgcactgtatggaaatgctggaagaagccggttttgccgatgccgttcgcaccgggcccggctttcagt

SEQ ID NO: 2164 - protein, 89 aa, Neisseria gonorrhoeae
LLPVQYHFLFHSNHQDFPMPTQFDVAVIGAGPAGSAASALLRKKGYQVCVLENSTFRASSSAKACCRTVWKCWKKPVLPMPFAPGPAFS

SEQ ID NO: 2165 - DNA, 1023 bp, Neisseria gonorrhoeae; identical to SEQ ID NO: 61

SEQ ID NO: 2166 - protein, 341 aa, Neisseria gonorrhoeae; identical to SEQ ID NO: 62

SEQ ID NO: 2167 - DNA, 192 bp, Neisseria gonorrhoeae
ttgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgcttcaccgttatgaacgtattgat

SEQ ID NO: 2168 - protein, 64 aa, Neisseria gonorrhoeae
LFGKKNKISASEAGKNTFHKPCRKVYNPTVLIATTVYGYRKKRHFRIGLDAGGGGLLHRYERID

SEQ ID NO: 2169 - DNA, 2403 bp, Neisseria gonorrhoeae
gggccgtttgttgcgtccggcggaaagagagtgggcggggatgtagccgggaacggcgacatccatcctgcctgcggggtttctgccgacgctgctgaggtctttcaactgaagtgaaaaaaagacggcgtttttgtaggtgttttcgccggtaacgtagcgttgggcgtacacgcccgcgccccagcagccgcaactgcttttgtattctgcaccggcaagcatttctatcggttttttggcttcaaaaccgtagttgtagcggacgacggcagacaggttgcgcgtcagcggccattgtgcggacaggtcgagctggctgagtttgtcgtaaaaataggaaccgtccgcctgcaggtagattttttcgttgcgcccgtatttgtagcgggcgttcaacacttttccgggggcggggcggtagcctgcgccgacggcgtaatgttcggcgcgtttgtcgttttggttgtagtggatgctgctgtcgagggtgaaacgcccgcctatgccgccggaggcgaatgccacccagtcggaacggctgcgcggatttttgccgacgctgccgtcaagcatcaccgcatcatccttgaaatagaatttctgaccgataccggcgcggaaacgctcctcccccgtcgcgccgtccaaaatacggctctgcacggcggtggaaaggctgttggcggcgttgatgcggtcgttgccgtaatagaggttttcgcggaaaagctgcccgtagccgaagctgctttccgacgaatcgaaattgggcaggtcgttttgagatttggcaggaatatagttgtagaacaggcgcggctcgatggtttgcacgactccgccgccgaacaggcgcgtattgcgttcgaaggttgtgccgccgtcgatattgacaacgggcaaaacgcgcccgacgctgcgggatgctttgccgccgaaactgtcgaggctgtaataagtggcgtgcagcccgagtttggggcggacgtagccccagctgttgctgaaatcccatttgataccgggatacacgaccagtcggctgccgtcttggcggccgtcgtggctgaagcgggtaaattgtgcggacacgccgatttgcgccctgcctgcgtttttatgccaatcggcagaaaggcggggcatgatggcgtaaggttcgtctttgtagccgctttggtttgccagcgtctggtatttctgaaccgaaaggccggcattcaggctgcctcccgccgccctgccgccataatccagccatacgcggcggttgaggttgacgttgccggcgatttcttcgccgccgtaaaagtcgcggtagtagccgctgtcggagacttggttgaaatcgacacccgcctgaagcgtgtcggaaatgtcgtgccggtgctgccattttgcctgatagcggttgttcctgccgcttttcttatcgtgcggcaaccaggtcaggtcggtctgtccgctgtaatcgggacgcaggtaacggatttgtccgtcaaacgtcgcgccgcgttcgccgataatgccgggggcgaaagtggcatcgaagttgggggcaaggttgaaataataggggacggaaagggaaacgccgtccgaaccggcagatacggacgggacgagcagtccgcttttgcggttgccgtcaagcgggaagtccgcccaaggcgtatagaaaaggggaacgccgccgaacacgaaggcggcgtgtttggcaacgcctatgccttttccccgatcggcttcgacagaggcggccttgacataccagccggcatctccggcggaacaggtgttgaattgggtttccgtcagtttgtaacgcccttcgcccaacatttcggcggtgcggctgacgctttgcagccgccgtccgccttgttcggtttccatacggacgttgtgcgcttcgccggtctgctgatcgagattgtaggtcagggtttcgccccgaatcagcgtaccgtcctgttggagggcgaaccggtcgcctacggtaacggtgtcgcccgactggtcgtaatccgcccaatcggtattgaggactgcgccgtcccgttcgatgataacgcttccttccgcgcgcaccttaaccttcgactgtccttccatcctgtcggcaacaatgcgcgtatagtcttcggggacggatgcttcgccgctgccttggacggcggcttcggttctctcggggctgccgctttcgttactgcaaaacaggcaggtcgaaccgagggtcaaatcggaagcttgtgcggattcggacgcgccctgcgcaccgccttctgcgacacgcccgtccgcctcttccgccgcaacggtatcggcggcgcaatgcgtgccgaaacagaagcccaatgccagcaccagtggtttgagtgaaaataaacgagccaa

SEQ ID NO: 2170 - protein, 38 aa, Neisseria gonorrhoeae
GPFVASGGKRVGGDVAGNGDIHPACGVSADAAEVFQLK

SEQ ID NO: 2171 - DNA, 1371 bp, Neisseria gonorrhoeae
atgagtaatccattttcctctttaggtttgggtacggaactggtttccgcactgaccgcgcaaggttacgaaaacccgacgcccatccaagccgcggccattcccaaagcactggccggacacgacctgcttgccgccgcgcaaaccggcacaggcaaaaccgctgcctttatgctgcccagtctggaacgcctcaaacgttacgccaccgccagcacctcgcctgcaatgcaccccgtgcgtatgctcgtgttgaccccgacgcgcgaacttgccgaccaaatcgaccaaaacgtgcagggctacattaaaaacctgccgctgcggcataccgtcctcttcggcggtgtcaacatggacaaacaaaccgccgacctgcgtgccggctgcgaaatagtcgtcgccaccgtcggacggctgctcgaccatgtgaaacagaaaaacatcagtttaaacaaagccgaaatcgtcgttctggacgaagcagaccgcatgttggatatggggtttatcgacgacatccgcaaaatcatgcagatgctgccccgccaacgccaaaccctgctcttttccgccaccttctccgcaccgatacgcaaactggcgcaagacttcatgaacgcgcccgaaaccgtcgaggttgccgcccaaaacaccaccaacgccaacgtcgaacaacacatcatcgccgtcgataccttccaaaagcgcaacctgctcgaacggctgattgtcgatctgcatatgaaccaagttatcgtcttttgcaaaaccaaacaaagcgtcgaccgcgtaacgcgcgaactggtgcgccgcaacctgtccgcacaggcgatacacggcgaccgttcccaacaaagcaggctcgaaacactcaacgccttcaaagacggcagcctgcgcgtcctcgtcgccaccgatatcgccgcgcgtgggctggacatcgccgaactgcccttcgtcatcaattacgaaatgcccgcccagcccgaagactacatccaccgcatcggacgcacggggcgcgccggtgcggacggcgtggcgatttccctgatggacgaatccgaacagaaaatgtttgaggccatcaaagaactgaccggcaacaagctgctcatcgaacgcatcgaaggcttcgagccccgatggtgggaacaggaaggctcaaaaccggaaaaaaccgaaacaagcgaaccgagacaacgcaaccgctacgaatccgccagggctcagcgcgaaaaaaatacccggccggaaaccacggcaaacgatgcgggcgcggcctgcggaaaaattgccgggcgcagccgccgaagccgccggggacaccggacgtgcgccctgctccaaccgcgttacggcgtaaaa

SEQ ID NO: 2172 - protein, 457 aa, Neisseria gonorrhoeae
MSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQGYIKNLPLRHTVLFGGVNMDKQTADLRAGCEIVVATVGRLLDHVKQKNISLNKAEIVVLDEADRMLDMGFIDDIRKIMQMLPRQRQTLLFSATFSAPIRKLAQDFMNAPETVEVAAQNTTNANVEQHIIAVDTFQKRNLLERLIVDLHMNQVIVFCKTKQSVDRVTRELVRRNLSAQAIHGDRSQQSRLETLNAFKDGSLRVLVATDIAARGLDIAELPFVINYEMPAQPEDYIHRIGRTGRAGADGVAISLMDESEQKMFEAIKELTGNKLLIERIEGFEPRWWEQEGSKPEKTETSEPRQRNRYESARAQREKNTRPETTANDAGAACGKIAGRSRRSRRGHRTCALLQPRYGVK

SEQ ID NO: 2173 - DNA, 117 bp, Neisseria gonorrhoeae
ttggggcgggcaccgttttatggcataatccgcacacaaattcccgtccccgccgttcacaggcgggcagtttatttccccgtcctatcggtttcccgcttcagacggcataaggtc

SEQ ID NO: 2174 - protein, 39 aa, Neisseria gonorrhoeae
LGRAPFYGIIRTQIPVPAVHRRAVYFPVLSVSRFRRHKV

SEQ ID NO: 2175 - DNA, 1092 bp, Neisseria gonorrhoeae
gtgcccgccccaatcgcgggcgcgtccgcagattggaaatcctgcttaaaaaatgtacaatggcgcacttttttgaaacgcgggcccattatgcacatcggcggttattttatcgacaaccccatcgcacttgcgccgatggcgggcattgccgacaaacccttccgccgcctctgtcgggcgtttggcgcaggttgggcggtgtgcgaaatgctggccagcgatccgacgctcaggaataccggaaaaaccctgcaccgcagtgattttgccgatgaaggcggcatcgttgccgtgcagattgccggcagcgaccccgaacagatggcggatgcggcgcgttacaacgtcggactcggggcgcaggtcatcgacatcaatatgggctgccccgccaagaaagtgtgcaacgtccaagccggtagcgcgctgatgcaggacgagccgctggttgccgccattttggaggcggtggtcaaggcggcgggcgtacccgttaccctcaaaacccgtttgggttggcacgacgaccatcaaaacctgcccgccatcgccaaaatcgccgaagattgcggcattgccgcccttgccgtccacgggcgcgcgcgcacgcaaatgtacaaaggcgaggcgcgttacgaactcatcgccgagaccaaaagccgtctgaacatcccggcctgggtcaacggcgacatcacttcgccgcaaaaagccgccgccgtcctcaaacaaaccgccgccgacggcatcatgatagggcgcggcgcgcaaggcaggccgtggtttttccgcgatttgaagcattatgccgaacacggcgttttaccgcctgccttgagtttggcagaatgcagagccgccattttgaaccacatccgcgccatgcacgcgttttatggtgagaccgtcggtgtgcgcatcgcacgcaaacacataggctggtacatcggcgaaatgcccgacggcgaacaggcgcggcgtgaaatcaaccgcttggacaatgcggcggcgcaatacgacacacttgccggttatcttgaaaggcttgccggaaaaaccgaccgttgggcgtgcggctatcgggaaggg

SEQ ID NO: 2176 - protein, 364 aa, Neisseria gonorrhoeae
VPAPIAGASADWKSCLKNVQWRTFLKRGPIMHIGGYFIDNPIALAPMAGIADKPFRRLCRAFGAGWAVCEMLASDPTLRNTGKTLHRSDFADEGGIVAVQIAGSDPEQMADAARYNVGLGAQVIDINMGCPAKKVCNVQAGSALMQDEPLVAAILEAVVKAAGVPVTLKTRLGWHDDHQNLPAIAKIAEDCGIAALAVHGRARTQMYKGEARYELIAETKSRLNIPAWVNGDITSPQKAAAVLKQTAADGIMIGRGAQGRPWFFRDLKHYAEHGVLPPALSLAECRAAILNHIRAMHAFYGETVGVRIARKHIGWYIGEMPDGEQARREINRLDNAAAQYDTLAGYLERLAGKTDRWACGYREG

SEQ ID NO: 2177 - DNA, 147 bp, Neisseria gonorrhoeae
atgccgccgttcgggttcggacggcatctgtctgcatggttcggaggtcgggcggaatcccggccggcgaatgtcgaaaacaataaatgccgtctgaaaacgagtggaacgggtttcgccaaaaggctttcagacggcattccgtct

SEQ ID NO: 2178 - protein, 49 aa, Neisseria gonorrhoeae
MPPFGFGRHLSAWFGGRAESRPANVENNKCRLKTSGTGFAKRLSDGIPS

SEQ ID NO: 2179 - DNA, 237 bp, Neisseria gonorrhoeae
atgaaccctgcgactgcggacattgcgcaatgtatcgagcagaacttgaaccaatatttcaaagacctgaacggcaccgaaccttgcggcgtgtacgatatggtactgcatcaggtggaaaagccgctgctggtgtgcgtgatggagcaatgcggcggcaaccagtccaaagcctccgtgatgctgggactgaaccgcaataccttgcgtaagaaactgattcaacacggtttgctg

SEQ ID NO: 2180 - protein, 79 aa, Neisseria gonorrhoeae
MNPATADIAQCIEQNLNQYFKDLNGTEPCGVYDMVLHQVEKPLLVCVMEQCGGNQSKASVMLGLNRNTLRKKLIQHGLL

SEQ ID NO: 2181 - DNA, 540 bp, Neisseria gonorrhoeae
gtgaatatgtcggcaaccgtccgtatcttgggcatcgacccgggcagccgcgtaacgggtttcggcatcatcgatgtcagggggcgcgatcatttttacgtcgcctccggctgcatcaaaacgcctgccgatgagcctctggcagacaggattgccgtgattgtgcggcatatcggcgaagtcgttgccgtttacaagccgcaacaggcggcggtggaacaggtgttcgtcaacgtcaatccggcatcgacgctgatgctcggtcaggcgcgcggagcggcattggcggctttggtcagccataagctgcccgtttcggaatacacggccttgcaggtcaaacaggcggtggtcggcaaaggcaaggcggcgaaagaacaggtgcagcatatggtggtgcaaatgctgggactttcgggaacgccgcaggcggatgcggcggacggtcttgccgtcgcgctgacccacgccttacgcaaccacgggcttgccgccaaactcaatccttcggggatgcaggtcaagcgcggaaggtttcaa

SEQ ID NO: 2182 - protein, 180 aa, Neisseria gonorrhoeae
VNMSATVRILGIDPGSRVTGFGIIDVRGRDHFYVASGCIKTPADEPLADRIAVIVRHIGEVVAVYKPQQAAVEQVFVNVNPASTLMLGQARGAALAALVSHKLPVSEYTALQVKQAVVGKGKAAKEQVQHMVVQMLGLSGTPQADAADGLAVALTHALRNHGLAAKLNPSGMQVKRGRFQ

SEQ ID NO: 2183 - DNA, 111 bp, Neisseria gonorrhoeae
ttgagtgaaaataaacgagccaaaatcgcccctcaagtcggtttaccggttagaatagtgtttattgtaacccgaaatgcccggatactgttatgcaacggcaaaccgaac

SEQ ID NO: 2184 - protein, 37 aa, Neisseria gonorrhoeae
LSENKRAKIAPQVGLPVRIVFIVTRNARILLCNGKPN

SEQ ID NO: 2185 - DNA, 1578 bp, Neisseria gonorrhoeae
atgccgtctgaaaaagctttcagacggcatttgcgtaccgcgtcatttcaagggctgcatcttcatcacttccatcaaaaagttggtaaatgcgggattatcgggtttggcatccatatttttccaacgctgctgccagccgcgcaaggcattctcgatatacagcttggactgttccgtattgatttcgccgcgctggctgtctaccgccgaacgcaggtagatttcatacatactgtcatcgacggcattgcgtccgaccaggcgttttctgaagttgttcagatattgcgccgcctgaaccttggtcattttaccgatacccacctgatagcccaagcgcgtcgcttcatcgctgattttggcaacatccgcccaatgcgaaggggcgaggcgaaaaccttttgcaggtgcttccgttttgacggtattgatgggattcacggggatttccgtcaatgtgggcacataaatagactggcacccggaaaggactgccgcaatggaaagagggataaggtattttttcatacccgccattataatcaagtttgccttgagaaaacaaattgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgcttcaccgttatgaacgtattgattaaagaggcatcggcaaaatttgccctcggcagcggcgaattggtcttttggcgcatgctgttttcaaccgttacgctcggtgctgccgccgtattgcggcgcgacaccttccgcacgccccattggaaaaaccacttaaaccgcagtatggtcgggacgggggcgatgctgctgctgttttacgcggtaacgcatctgcctttgacaaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaccggcggcactcgccgggctggcgggcggcgcgatgtccggctgggcgtatttgaaagtgcgcgaactgtctttggcgggcgaacccggctggcgcgtcgtgttttacctttccgcaaccggcgtggcgatgtcgtcggtttgggcgacgctgaccggctggcacaccctgtcctttccatcggcggtttatctgtcgggcatcggcgtgtccgcgctgattgcccaactgtcgatgacgcgcgcctacaaagtcggcgacaaattcacggttgcctcgctttcctatatgaccgtcgtcttttccgccctgtctgccgcattttttctgggcgaagagcttttctggcaggaaatactcggtatgtgcatcattatcctcagcggcattttgagcagcatccgccccattgccttcaaacagcggctgcaagccctcttccgccaaaga

SEQ ID NO: 2186 - protein, 526 aa, Neisseria gonorrhoeae
MPSEKAFRRHLRTASFQGLHLHHFHQKVGKCGIIGFGIHIFPTLLPAAQGILDIQLGLFRIDFAALAVYRRTQVDFIHTVIDGIASDQAFSEVVQILRRLNLGHFTDTHLIAQARRFIADFGNIRPMRRGEAKTFCRCFRFDGIDGIHGDFRQCGHINRLAPGKDCRNGKRDKVFFHTRHYNQVCLEKTNCSARKIKFRHQKQAKTHSTSLAARFTIRPSLSQRPFMDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 2187 - DNA, 93 bp, Neisseria gonorrhoeae
ttggtttcacagggcggcaaaaaagcccaaacatacgtccgggcttgggaattggtgggtccggtggggttcgaacccacgaccaagggatta

SEQ ID NO: 2188 - protein, 31 aa, Neisseria gonorrhoeae
LVSQGGKKAQTYVRAWELVGPVGFEPTTKGL

SEQ ID NO: 2189 - DNA, 897 bp, Neisseria gonorrhoeae
ttgccgcctgaaaagaaaatgtgtaccgagatgaaatttatattttttgtactgtatgttttgcagtttctgccgtttgcgctgctgcacaagattgccggcctgatcggttcgcttgcctaccttctggtcaaaccgcgccgccgtatcggcgaaatcaatttggcaaaatgttttcccgaatgggacgaagaaaagcgtaaaaccgtgttgaaacagcatttcaaacacatggcaaaactgatgctcgaatacggcttatattggtacgcgtctgccaaatgcctgaaatcgctggtgcgctaccgcaataagcattatttggacgacgcgctggcggcgggggaaaaagtcatcatcctgtacccgcactttaccgcgttcgagatggcggtgtacgcgcttaatcaggatgtcccgctgatcagtatgtattcccaccaaaaaaacaagatattggacgaacagattttgaaaggccgcaaccgctatcacaacgtcttccttatcgggcgcaccgaagggctgcgcgccctcgtcaaacagttccgcaaaagcagtgcgccgttcctgtatctgcccgatcaggatttcggacgcaacaattcggtttttgtggattttttcggcattcagacggcaacgattaccggcttgagccgcattgccgcgcttgcaaatgcaaaagtgatacccgccattcccgtccgcgaggcggacaatacggttacattgcaattctatcccgcttggaaatcctttccgagtgaagacgcgcaagccgacgcgcaacgtatgaaccgctttatcgaagaacgcgtgcgcgaacacccggaacaatatttctggctgcacaagcgtttcaaaacccgtccggaaggcagccccgatttttac

SEQ ID NO: 2190 - protein, 299 aa, Neisseria gonorrhoeae
LPPEKKMCTEMKFIFFVLYVLQFLPFALLHKIAGLIGSLAYLLVKPRRRIGEINLAKCFPEWDEEKRKTVLKQHFKHMAKLMLEYGLYWYASAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 2191 - DNA, 162 bp, Neisseria gonorrhoeae
ttgaaacccgggttgtacaaacaggatttgccggacggttttaacggttcagttgtttgtaaaaacaatgcttttttaaaattgacaaaaaacgaaatcggttttaaaggcttattccgagaacaaaggggagtggatgccgaaaacccggttaatatatta

SEQ ID NO: 2192 - protein, 54 aa, Neisseria gonorrhoeae
LKPGLYKQDLPDGFNGSVVCKNNAFLKLTKNEIGFKGLFREQRGVDAENPVNIL

SEQ ID NO: 2193 - DNA, 243 bp, Neisseria gonorrhoeae
ttgttaatccactataatatattaaccgggttttcggcatccactcccctttgttctcggaataagcctttaaaaccgatttcgttttttgtcaattttaaaaaagcattgtttttacaaacaactgaaccgttaaaaccgtccggcaaatcctgtttgtacaacccgggtttcaaattcccaaaaacaatcggggtttttgatctgaaacgcctgatttgttttgtaattttatgtagtcag

SEQ ID NO: 2194 - protein, 81 aa, Neisseria gonorrhoeae
LLIHYNILTGFSASTPLCSRNKPLKPISFFVNFKKALFLQTTEPLKPSGKSCLYNPGFKFPKTIGVFDLKRLICFVILCSQ

SEQ ID NO: 2195 - DNA, 183 bp, Neisseria gonorrhoeae
gtgaaaaaaggcgtacattccgctacacagaattacagatacagcggagcaatgccgtctgaaaggattttccggtcagtcttgcggttggtcggggtttcatcggatacggtgaaacgaaagtttgccggcgcagggttgagctacgcgggtaaagccgcaggcgaaagcctgtattgtttg

SEQ ID NO: 2196 - protein, 61 aa, Neisseria gonorrhoeae
VKKGVHSATQNYRYSGAMPSERIFRSVLRLVGVSSDTVKRKFAGAGLSYAGKAAGESLYCL

SEQ ID NO: 2197 - DNA, 807 bp, Neisseria gonorrhoeae
atgcaaggtactgccatgaatacgattttggctttcgatattgaaaccgtacccgatgtgcagggtatccgtacgttgtatgacttgccgtcttccctgccggatgacgaagtggtgctgttcgcgcagcagaaacgccgcgcacagaccggcggcgattttatgcagcaccacctccatcaggttgtggcggtttcctgctgtatgcgctgggggcaggacaaggttcatgtcggcaccatcggcgagatggacgatggcgaagaagtcgtgattgccaagtttttcgaattggttgaaaaacatacgccgcaactggtcagctggaacggcggcggtttcgacctgcccgtactgcattaccgctccctgatatacggcatcaacgccgcgcgctattgggatacgggcgacggcgatttcggcgacagccgcgatttcaagtggaacaactacatcagccgttatcaccaacgccactgcgatttgatggatttgctcgcgctttaccagccgagggcgaatgtgccgctggacgatatggcgaaactgtgcggctttccgggcaagctgggtatggacggcagcaaggtgtgggaggcgttccacgcgggcaggctgaaggaaatccgcaattattgcgaaaccgatgccgtgaatacgtatttgatgtatctgcgtttctgtctggtcagcggcagattcgacgcggacgaatacgaaatggaaatcaagcggatcagaaactatctctccgcccaaacagaagacaaaccgcattgggcagaatttgtccaagcgtggaaa

SEQ ID NO: 2198 - protein, 269 aa, Neisseria gonorrhoeae
MQGTAMNTILAFDIETVPDVQGIRTLYDLPSSLPDDEVVLFAQQKRRAQTGGDFMQHHLHQVVAVSCCMRWGQDKVHVGTIGEMDDGEEVVIAKFFELVEKHTPQLVSWNGGGFDLPVLHYRSLIYGINAARYWDTGDGDFGDSRDFKWNNYISRYHQRHCDLMDLLALYQPRANVPLDDMAKLCGFPGKLGMDGSKVWEAFHAGRLKEIRNYCETDAVNTYLMYLRFCLVSGRFDADEYEMEIKRIRNYLSAQTEDKPHWAEFVQAWK

SEQ ID NO: 2199 - DNA, 828 bp, Neisseria gonorrhoeae
ttggacaaattctgcccaatgcggtttgtcttctgtttgggcggagagatagtttctgatccgcttgatttccatttcgtattcgtccgcgtcgaatctgccgctgaccagacagaaacgcagatacatcaaatacgtattcacggcatcggtttcgcaataattgcggatttccttcagcctgcccgcgtggaacgcctcccacaccttgctgccgtccatacccagcttgcccggaaagccgcacagtttcgccatatcgtccagcggcacattcgccctcggctggtaaagcgcgagcaaatccatcaaatcgcagtggcgttggtgataacggctgatgtagttgttccacttgaaatcgcggctgtcgccgaaatcgccgtcgcccgtatcccaatagcgcgcggcgttgatgccgtatatcagggagcggtaatgcagtacgggcaggtcgaaaccgccgccgttccagctgaccagttgcggcgtatgtttttcaaccaattcgaaaaacttggcaatcacgacttcttcgccatcgtccatctcgccgatggtgccgacatgaaccttgtcctgcccccagcgcatacagcaggaaaccgccacaacctgatggaggtggtgctgcataaaatcgccgccggtctgtgcgcggcgtttctgctgcgcgaacagcaccacttcgtcatccggcagggaagacggcaagtcatacaacgtacggataccctgcacatcgggtacggtttcaatatcgaaagccaaaatcgtattcatggcagtaccttgcattcaaaaacagacttgcgcctattgtgtcat

SEQ ID NO: 2200 - protein, 276 aa, Neisseria gonorrhoeae
LDKFCPMRFVFCLGGEIVSDPLDFHFVFVRVESAADQTETQIHQIRIHGIGFAIIADFLQPARVERLPHLAAVHTQLARKAAQFRHIVQRHIRPRLVKREQIHQIAVALVITADVVVPLEIAAVAEIAVARIPIARGVDAVYQGAVMQYGQVETAAVPADQLRRMFFNQFEKLGNHDFFAIVHLADGADMNLVLPPAHTAGNRHNLMEVVLHKIAAGLCAAFLLREQHHFVIRQGRRQVIQRTDTLHIGYGFNIESQNRIHGSTLHSKTDLRLLCH

SEQ ID NO: 2201 - DNA, 159 bp, Neisseria gonorrhoeae
ttgtccaagcgtggaaatagaaacctgctgtccgaaggcggtacgcttgtgccgccgtttcggtttcagacggcgtatggtggattaaattcaaaccggtacagccttgcctctccttgccttactatctgtactgtctgcggcttcgtcgccttgtcc

SEQ ID NO: 2202 - protein, 53 aa, Neisseria gonorrhoeae
LSKRGNRNLLSEGGTLVPPFRFQTAYGGLNSNRYSLASPCLTICTVCGFVALS

SEQ ID NO: 2203 - DNA, 1002 bp, Neisseria gonorrhoeae
atgcaacggcaaaccgaactgaaaaattggcttcagaccgtttatcccgaacgggacttcgatctgtccttcgcggcggcggatgctgatttccgccgctatttccgtgcggcgttttcagacggcggcagcgtcgtctgtatggatgcgccgcccgacaagatgagtgtcgcgccttatttgaaggtgcagaagctgtttgacatggtcaatgtgccgcaggtattgcacgcggacacggatttggggtttgtggtattgaacgacttgggcaatacgacgtttttgaccgcgatgcttcaggagcagggcgaagcggcacacaaagccctgttgctggaggccatcggcgagctggtcggattgcagaaggcaagccgtgaaggggttttgcccgaatatgaccgtgaaacgatgctgcgcgaaatcaacctgttcccggaatggtttgtcgcaaaagaattggggcgcgaattaacattcaaacaacgccaactttggcagcaaaccgccgatacgctgctgccgcccttgttggcgcagcccaaagtctacgtgcaccgcgactttatcgtccgcaacctgatgctgacgcgcggcaggccgggcgttttagacttccaagacgcgctttacggcccgatttcctacgatttggtgtcgctgttgcgcgatgcctttatcgagtgggaagaagagtttgttttggatttggttatccgctactgggaaaaggcgcgggctgccggcttgcctgtccctgccgagtttgacgagttttaccgccggttcgaatggatgggcgtgcagcggcacttgaaggtcgcgggcatcttcgcacgcctgtactaccgcgacggcaaagacaaataccgtccggaaatcccgcgtttcttaaactatctgcgccgcgtatcgcgccgttatgccgaactcgccccgctctacgcgctcttggtcgaactggtcggcgatgaagaactggaaacgggctttacgttc

SEQ ID NO: 2204 - protein, 334 aa, Neisseria gonorrhoeae
MQRQTELKNWLQTVYPERDFDLSFAAADADFRRYFRAAFSDGGSVVCMDAPPDKMSVAPYLKVQKLFDMVNVPQVLHADTDLGFVVLNDLGNTTFLTAMLQEQGEAAHKALLLEAIGELVGLQKASREGVLPEYDRETMLREINLFPEWFVAKELGRELTFKQRQLWQQTADTLLPPLLAQPKVYVHRDFIVRNLMLTRGRPGVLDFQDALYGPISYDLVSLLRDAFIEWEEEFVLDLVIRYWEKARAAGLPVPAEFDEFYRRFEWMGVQRHLKVAGIFARLYYRDGKDKYRPEIPRFLNYLRRVSRRYAELAPLYALLVELVGDEELETGFTF

SEQ ID NO: 2205 - DNA, 756 bp, Neisseria gonorrhoeae
atgaaaaaagtcagcgtattgattgttgccaaaaacgaagcaaaccacattcgggaatgtattgaaagttgccgtttcgataaagaagttatcgttatcgacgaccatagcgccgacaacactgccgaaattgccgagggtttgggtgcaaaagtcttcagacggcatttgaacggggatttcggagcgcaaaaaacatttgccatcgaacaggcaggcggagaatgggttttcctgattgatgcagacgaacgctgcacgccggaactatctgatgaaatctcaaaaattgtccgaaccggcgattatgccgcctattttgtcgaacgccgcaaccttttccccaaccatcccgccacacacggcgcgatgcgtcccgacagcgtatgccgtctgatgccgaaaaaaggcggttcggtgcaaggcaaagtacacgaaaccgtacagaccccctaccccgaacgccgtctgaaacattttatgtaccattacacgtacgacaactgggaacaatatttcaacaagttcaacaaatatacttccatctcggccgagaaataccgggagcagggaaagcccgtgagtttcgttagggacattatcctccgtccgatttggggttttttcaaaatttatatcctgaacaaagggtttcttgatggaaaaatgggttggattatgtccgtcaaccacagctattacacgatgattaaatatgtcaaactatattatctgtacaaatccggcggaaaattt

SEQ ID NO: 2206 - protein, 252 aa, Neisseria gonorrhoeae
MKKVSVLIVAKNEANHIRECIESCRFDKEVIVIDDHSADNTAEIAEGLGAKVFRRHLNGDFGAQKTFAIEQAGGEWVFLIDADERCTPELSDEISKIVRTGDYAAYFVERRNLFPNHPATHGAMRPDSVCRLMPKKGGSVQGKVHETVQTPYPERRLKHFMYHYTYDNWEQYFNKFNKYTSISAEKYREQGKPVSFVRDIILRPIWGFFKIYILNKGFLDGKMGWIMSVNHSYYTMIKYVKLYYLYKSGGKF

SEQ ID NO: 2207 - DNA, 2601 bp, Neisseria gonorrhoeae
atgagcaaaaccgtccgttatctgaaagattaccaaacgcctgcctaccgcattcttgaaaccgaactgcatttcgacattgccgaaccgcaaaccgtcgtgaagtcgcgtttgacggtcgagccgcagagggcgggcgagccgctggtgttggacggttcggcaaaactcttgtccgtcaaaatcaacggcgcggcggcggattatgtgttggaaggcgagacgctgacgattgcagacgtaccgtccgaacgcttcaccgtcgaagtggaaaccgaaatcctgccggcggaaaacaaatcgctgatggggctgtatgcttccggcggcaatctgtttacccagtgcgagccggagggcttccgcaaaatcacgttctacatcgaccgtccggatgtgatgtccaagttcacgaccaccatcgtcgcggacaaaaaacgctatcccgttttgctttccaacggcaacaaaatcgacggcggcgagttttcagacggccgccattgggtgaaatgggaagacccgtttgccaaaccgagttatctgtttgctttggtcgcgggcgatttggcggtaacggaagaccgtttcaccaccatgagcggcagaaacgtcaaaatcgagttttacaccaccgaagcggacaaacccaaggtcggctttgccgtggaatcgttgaaaaacgcgatgaagtgggacgaaacgcgcttcgggttggaatatgacttggatattttcatggtcgtcgccgtaggcgatttcaatatgggcgcgatggaaaacaagggtttgaacatttttaacaccaagttcgtcctcgccgacagccgcaccgccaccgataccgatttcgaaggcattgaatccgtggtcggacacgaatatttccacaactggacgggcaaccgcgtaacctgccgcgactggttccagctttcgctgaaggaagggctgaccgtgttccgcgaccaagagttttccggcgaccgcgccggccgcgccgtgcgccgcatcgagaacatccgcctgctgcgccagaaccagttccccgaagacgcaggcccgaccgcccatccggtgcgccccgtcagctatgaggagatgaacaatttctacaccatgaccgtttatgaaaaaggcgcggaagtggtgcggatgtatcataccctgctcggcgaagagggcttccaaaaaggcatgaagctatatttccaacgccacgacggacaggcagtgacctgcgacgatttccgcgcggcgatggcggatgcgaacggcatcaatctcgaccagttcgccttgtggtacagccaggcgggcacgcccgttttggaagccgaaggccgtctgaaaaacaatgttttcgagttaaccattaaacaaaccgtgccgcccacgcccgatatggcggacaaacagccgatgatgattcccgtcaaagtcgggcttctgaaccgcaacggcgaagcggtggcattcgattatcagggcaaacgcgcaaccgaagccgtgttgctgatgaccgaagccgaacaggccttcccgctcgaaggtgtaaccgaagccgtcgttccctcgctgctgcgcgggttcagcgcgccagtgtatctgaactatccgtacagcgacgacgacctgctgctcctgctcgcccacgacagcgacgctttcacgtgctgggaagccgcccaaacgctctaccgtcgcgccgtcgccgccaaccttgccgcgctttcagacggcatcgggttgccgaaacacgaaaaactgcttgccgccgtcgaaaaagtcatttcagacgacctcttggacaacgccttcaaagccctgcttttgggcgtgccgtccgaagccgaactgtgggacggcacggaaaacatcgacccgctgcgctaccatcaggcgcgcgaagccttgttggatacgcttgccgtccgcttcctgccgaaatggcacgaattggaccgtcaggcggcgaagcaggaaaaccaaagttacgaatacagccccgaaaccgccgactggcgcacgctgcgcaacgtctgccgcgccttcgtcctgcgcgccgaccccgcgcacatcgaaactgttgccgaaaaatacggcgaaatggcgcaaaacatgacccacgaatggggcatcctgtccgccgtcaacggcaacgaaagcgatacgcgcaactgcctgctggcgcagtttgccgacaagttttcagacgacgcgctggtgatggacaaatatttcgcccttatcggctcaagccgccgcagcgacaccctgcaacaggttcaaaccgccttgcagcatccgaaattcagtctcgaaaaccccaacaaagcccgttcgctcatcggcagcttcagccgcaacgtcccgcattttcacgcacaagacggcagcggctaccgcttcatcgccgacaaagtcatcgaaatcgaccgcttcaacccgcaggtcgccgcccgcctggtgcaggcgttcaacctctgcaacaagctcgagccgcaccgcaaaaacttggtgaaacaagaattgcagtgcattcgggcgcaggaaggattgtcgaaagacgtgggcgaaatcgtcggcaagattttgggt

SEQ ID NO: 2208 - protein, 867 aa, Neisseria gonorrhoeae
MSKTVRYLKDYQTPAYRILETELHFDIAEPQTVVKSRLTVEPQRAGEPLVLDGSAKLLSVKINGAAADYVLEGETLTIADVPSERFTVEVETEILPAENKSLMGLYASGGNLFTQCEPEGFRKITFYIDRPDVMSKFTTTIVADKKRYPVLLSNGNKIDGGEFSDGRHWVKWEDPFAKPSYLFALVAGDLAVTEDRFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 2209 - DNA, 270 bp, Neisseria gonorrhoeae
ttgtttcaccaagtttttgcggtgcggctcgagcttgttgcagaggttgaacgcctgcaccaggcgggcggcgacctgcgggttgaagcggtcgatttcgatgactttgtcggcgatgaagcggtagccgctgccgtcttgtgcgtgaaaatgcgggacgttgcggctgaagctgccgatgagcgaacgggctttgttggggttttcgagactgaatttcggatgctgcaaggcggtttgaacctgttgcagggtgtcgctgcggcggct

SEQ ID NO: 2210 - protein, 90 aa, Neisseria gonorrhoeae
LFHQVFAVRLELVAEVERLHQAGGDLRVEAVDFDDFVGDEAVAAAVLCVKMRDVAAEAADERTGFVGVFETEFRMLQGGLNLLQGVAAAA

SEQ ID NO: 2211 - DNA, 573 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagggccccgccgggccgggcgcaagctgtttcggcggacggcgtaaaggcagacgcggtcgcggcgcggtaggaaaagcggttgtcttcggcattccgaaacgcaacgggcgggcctataccgttgccgaggacaatgccgagcctgaaacgttgctccctgccgtcaaaaaaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgt

SEQ ID NO: 2212 - protein, 191 aa, Neisseria gonorrhoeae
MKITHCKLKKEVQKEPLRSFVPEVTARSAADILGIHPDSAALFYRKIRTVTNHRLALAADEVFEGPAGPGASCFGGRRKGRRGRGAVGKAVVFGIPKRNGRAYTVAEDNAEPETLLPAVKKKSCRTVLFMPIARAAAASWTRAVLPVAASTVPRNLQTVGTTLTALGTFGIRQNAPCENTTESIVNLSRRC

SEQ ID NO: 2213 - DNA, 282 bp, Neisseria gonorrhoeae
atgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgacttaactccggcacaccgtcccggcagctaaaaatcctgcgggatcggtgtggaatt

SEQ ID NO: 2214 - protein, 94 aa, Neisseria gonorrhoeae
MPDGIVYADSPGSRGKLDAGGFTRCRINRSKEFADRRNHINGIGNFWNQAKRALRKYNGIDRKPFPPLLRECEFRLNSGTPSRQLKILRDRCGI

SEQ ID NO: 2215 - DNA, 156 bp, Neisseria gonorrhoeae
ttgggtgaatatttggaatttgaagaaaacggtacaaagattactgcggaaatcggcagtgcatggcattttttgggcgcggcttgtcggatttcaataaatggaaagtattatgcgggtaatcggattgtttggtttgccaaaaaagccgaaagc

SEQ ID NO: 2216 - protein, 52 aa, Neisseria gonorrhoeae
LGEYLEFEENGTKITAEIGSAWHFLGAACRISINGKYYAGNRIVWFAKKAES

SEQ ID NO: 2217 - DNA, 96 bp, Neisseria gonorrhoeae
atgcattttctttattctttatttaatcaaattatttggataagcgtagggtgggcacttgctgcccacgcgttctgtttcaagtttattattggg

SEQ ID NO: 2218 - protein, 32 aa, Neisseria gonorrhoeae
MHFLYSLFNQIIWISVGWALAAHAFCFKFIIG

SEQ ID NO: 2219 - DNA, 534 bp, Neisseria gonorrhoeae
ttggaaaagataataaattctaaggtaagggagactaattttaatcaggcatggcgtgttatacgcgccatgcaaataaataatatatctgatgaacaggttatgattgtcaaaatgtcttgttatcttaagaaagatgaaatttttaagaatatagaaagatatggatatcagtcatcagatattaagaaaattaatcctccttttccattaaatattttacctgttcccaaaccttattatttttatctttatgatacccatttgaatcaaatttatgatttggcttggtcatgtaatgattttttaatgtttgaaatatttattttggatagggaaagcatcaaatatatagataaagataaactttttaaatctggagaaacactatattcgaattttaaatctattaaaaatcaatgcaaaaattattttttttgcggttttgattttgatgccccttactttaaaagcggtgtgagtcaggtggcagattataattttgttcctgatgcattttctttattctttatt

SEQ ID NO: 2220 - protein, 178 aa, Neisseria gonorrhoeae
LEKIINSKVRETNFNQAWRVIRAMQINNISDEQVMIVKMSCYLKKDEIFKNIERYGYQSSDIKKINPPFPLNILPVPKPYYFYLYDTHLNQIYDLAWSCNDFLMFEIFILDRESIKYIDKDKLFKSGETLYSNFKSIKNQCKNYFFCGFDFDAPYFKSGVSQVADYNFVPDAFSLFFI

SEQ ID NO: 2221 - DNA, 378 bp, Neisseria gonorrhoeae
atgcaattgatatgtgccgattggacaggtataggaaattttatgaaaaccttcgaaaaaacatggtctgcacaatatcgggatatggaaatttcagtacggaatttttggaatttgaaacggacaggggcggaagtctatatcaacggcaggcgggtttatcataacgaagccgggatggcgtctgcttctttgcgttcgctaatgggggaatacctggaatttgaagaaagcggtacgaaaattaccgttgaaatcggcagcgcgtggcattttaatgaaactataagaaatattaatacacatttaagaggtacgaaacttccaggttctaactggagagttcaagataaggggcattttcatctttggaaaaga

SEQ ID NO: 2222 - protein, 126 aa, Neisseria gonorrhoeae
MQLICADWTGIGNFMKTFEKTWSAQYRDMEISVRNFWNLKRTGAEVYINGRRVYHNEAGMASASLRSLMGEYLEFEESGTKITVEIGSAWHFNETIRNINTHLRGTKLPGSNWRVQDKGHFHLWKR

SEQ ID NO: 2223 - DNA, 1062 bp, Neisseria gonorrhoeae
atggaaaaagaattcaggatattaaatatcgtatcggccaagatttggggtgggggcgaacaatatgtctatgatgtttcaaaagcattgggacttcggggctgcaccatgtttaccgccgtcaataaaaatgatgaattgatgcgcagacgcttttccgaagtttcttccgttttcacaacgcgccttcacacgttcaacgggctgttttcgctctacgcgcttacccgctttatccgggaaaaccacatttcccacctgatgatacacaccggcaaaattgccgccttatccgtacttttgaaaaaactgaccggggtgcgcctgatatttgtcaaacataatgtcgtcgccaacaaaaccgatttttatcaccgcctgatacagaaaaacaccgaccgctttatttgcgtttcccgtctggtttacgatgtgcaaaccgccgacaatccctttaaagaaaaataccggattgttcataacggtatcgataccggccggttccccccgtctcaagaaaaacccgacagccgtttttttaccgtcgcctacgccggcaggatcagtccggaaaaaggattggaaaacctgattgaagcctgtgtgatactgcatcggaaatatcctcaaatcaggctcaaattggcagggcacggacatccggattatatgtgccgcctgaagcggggcgtatctgcttcgggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggtgcgcaaaaggaaattatcgaacatcatcaatcggggattctgctggacaggcttacgcctgaatctttggcggacgaaatcgaacgcctcgtcttaaaccccgaagcaaaaaacgcactggcaacggcaggacatcaatgcgtcgccgcccgtttcaccatcaaccataccgccgacaaattattggatgcaata

SEQ ID NO: 2224 - protein, 354 aa, Neisseria gonorrhoeae
MEKEFRILNIVSAKIWGGGEQYVYDVSKALGLRGCTMFTAVNKNDELMRRRFSEVSSVFTTRLHTFNGLFSLYALTRFIRENHISHLMIHTGKIAALSVLLKKLTGVRLIFVKHNVVANKTDFYHRLIQKNTDRFICVSRLVYDVQTADNPFKEKYRIVHNGIDTGRFPPSQEKPDSRFFTVAYAGRISPEKGLENLIEACVILHRKYPQIRLKLAGHGHPDYMCRLKRGVSASGAEPFVSFEGFTEKLASFYRQSDVVVLPSLVPEAFGLSLCEAMYCRTAVISNTLGAQKEIIEHHQSGILLDRLTPESLADEIERLVLNPEAKNALATAGHQCVAARFTINHTADKLLDAI

SEQ ID NO: 2225 - DNA, 123 bp, Neisseria gonorrhoeae
atggggcggatgctgctcaaaatgccgctgaggataatgatgcacataccgagtatttcctgccagaaaagctcttcgcccagaaaaaatgcggcagacagggcggaaaagacgacggtcata

SEQ ID NO: 2226 - protein, 41 aa, Neisseria gonorrhoeae
MGRMLLKMPLRIMMHIPSISCQKSSSPRKNAADRAEKTTVI

SEQ ID NO: 2227 - DNA, 375 bp, Neisseria gonorrhoeae
atgtctttcggctatttgattgcaacatcgcaaccttgcgaattgttgacaaaatctcgaggtgaaactttttctttaattatggataagatggatttatggatttatttcagattttgtgaaggaaatatttatacaataaggaagaatgaaactgaatcttgccttacagaaagaggaggtgaatggttgaaacatatttatgaatttaatcgggaaagttttattttttctgatgtgcttctacaaaagggagaaagcgaagagaatttttcagaaattgtcttaaaatcaataaaaaataataaaattttgacagttgaggtacggtcaggcttgcattttgacttaagaaatatttatcgtattgagatg

SEQ ID NO: 2228 - protein, 125 aa, Neisseria gonorrhoeae
MSFGYLIATSQPCELLTKSRGETFSLIMDKMDLWIYFRFCEGNIYTIRKNETESCLTERGGEWLKHIYEFNRESFIFSDVLLQKGESEENFSEIVLKSIKNNKILTVEVRSGLHFDLRNIYRIEM

SEQ ID NO: 2229 - DNA, 285 bp, Neisseria gonorrhoeae
ttggaaaagaaaatagagccgcaggatttgatggatgatgtttaccgtgcttttgattcggttggaaatattctgaatttccgtatagtagaaaaagagcaaaaagggttttgggtaagtaccaaaatcaaaacagttgtatttgattcggcagatatgccttctgatgatctttttctgaaatgcttacagtcttcatataaggcttattctgaaactgaacctgccggtttagataaacggcagctgatgaaaacgttaattcaaaaatgcggattcagttgt

SEQ ID NO: 2230 - protein, 95 aa, Neisseria gonorrhoeae
LEKKIEPQDLMDDVYRAFDSVGNILNFRIVEKEQKGFWVSTKIKTVVFDSADMPSDDLFLKCLQSSYKAYSETEPAGLDKRQLMKTLIQKCGFSC

SEQ ID NO: 2231 - DNA, 537 bp, Neisseria gonorrhoeae
atgaaaaaacaaatcaccgcagccgtaatgatgctgtctatgatcgcccccgcaatggcaaacggattggacaatcaggcatttgaagaccaagtgttccacacgcgggcagatgcgccgatgcagttggcggagctttctcagaaggagatgaaggagactgaaggggcttttcttccattggctatcttgggtggtgctgccattggtatgtggacacagcatggttttagttatgcaacgacaggcagaccagcttctgttagagatgttgctggcggattaggcgcaattcctggtgatgtaggtgctgcaggaaaggttgtttcctttgctaaatatggacgtgagattaaaatcggcaataatatgcggatagcccctttcggtaatagaacaggtcatcctattggaaaatttccccattatcatcgtcgagttacggataatacgggcaagactttgcctggacagggaattggtcgtcatcgcccttgggaatcaaaatctacggacagatcatggaaaaaccgcttc

SEQ ID NO: 2232 - protein, 179 aa, Neisseria gonorrhoeae
MKKQITAAVMMLSMIAPAMANGLDNQAFEDQVFHTRADAPMQLAELSQKEMKETEGAFLPLAILGGAAIGMWTQHGFSYATTGRPASVRDVAGGLGAIPGDVGAAGKVVSFAKYGREIKIGNNMRIAPFGNRTGHPIGKFPHYHRRVTDNTGKTLPGQGIGRHRPWESKSTDRSWKNRF

SEQ ID NO: 2233 - DNA, 864 bp, Neisseria gonorrhoeae
atgaaaaatattctcttagtatttgttagctttgtgccattatgtgtccgcactgatctgccgctgaatatcgaagacataatgaccgacaagggaaaatggaaactggaaacttcccttacctacctgaacagcgaaaacagccgcgccgcacttgcctcaccggtttacattcagaccggctccgcttcctttatccccgtcccgaccgaaattcaggaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaatcccgcactcatcgctttcctcgaaagcacggtttacgaaaaatcgcgcaacaaagcctcgtcgggaaaatcgtggctcatcggcgccaccacctacaaagccatagatccgattgtcctttccctcaccgccgcctaccgcatcaacggcagcaaaaccctttcagacgacgtcaaatacaaagcaggcaattactggatgctgaatcccaacatctcatttgccgccaacgacagaatcagcctgaccggaggcatccaatggctgggcaaacagcccgaccgcatagacggcaaaaaagaatccgcaagaaacacatccacctacgcccatttcggcgcaggtttcggtttcaccaaaaccgcggctttaaacgcatccgcacgtttcaacgtttcagggcaaagcagttccgaactgaaattgggcgtacagcatacattt

SEQ ID NO: 2234 - protein, 288 aa, Neisseria gonorrhoeae
MKNILLVFVSFVPLCVRTDLPLNIEDIMTDKGKWKLETSLTYLNSENSRAALASPVYIQTGSASFIPVPTEIQENGSNTDMLAGTLGLRYGLTGNTDIYGSGSYLWHEERKLDGNGKTRNKRMSDISAGISHTFLKDGKNPALIAFLESTVYEKSRNKASSGKSWLIGATTYKAIDPIVLSLTAAYRINGSKTLSDDVKYKAGNYWMLNPNISFAANDRISLTGGIQWLGKQPDRIDGKKESARNTSTYAHFGAGFGFTKTAALNASARFNVSGQSSSELKLGVQHTF

SEQ ID NO: 2235 - DNA, 213 bp, Neisseria gonorrhoeae
atgttaatgaaattccatgtaatctgtctaaataatatttttaacgatattttcaatactgattgtttttttcttatcaatatttgtttactgctttattgcacaagagaaggccgtctgaaaacctcgtatttaattttcagacggccttttgccttttcaaattcaaaccaatcaaacggttttattgcttcatcgcgttggtcaaggctt

SEQ ID NO: 2236 - protein, 71 aa, Neisseria gonorrhoeae
MLMKFHVICLNNIFNDIFNTDCFFLINICLLLYCTREGRLKTSYLIFRRPFAFSNSNQSNGFIASSRWSRL

SEQ ID NO: 2237 - DNA, 702 bp, Neisseria gonorrhoeae
ctgcgcggctttttgttcttcacgtactttgtccgccaaaaggtcgatggtgttcataccggactcccagtcggcaaattcgactttatatttgccgccgacgataaccgtgggcgtaccgtcgatttggaaggtttcggtcagctcctgcattttgccggcgcgcgcctgactttcgggggattcgtaggcggcaaggacttttttgccgtcaaaggcggtttgttcgcccagccattttttgaggacttccggctcttgcagcttgattttttggttgaccatcgcatcgaaaatatggctgttcgccacatctttgctttcggcggcagccatatcgacggcggcggcgaggcgtgccagcggcagcatttctttctgccagacgacgtgttcggtacgcaggtacatatcgtctttaaaagacttggcgtgtttgctcaaaacaggttcgaggcgggcgcagtgcggacaaaaatagccgaaaaactcaagcacttcaaccttgcctgcctgctgttggggaatcgggttggcaaggacggtgtagttttgcccttcgaccagtcctgccggggcggcggctgccgaagcggcaggcgcgctgtcggcggggacgctggtttggactttgctgtcgcacgcggcaagggcgaacagggcggcaacgccgagggcgagggcgaggtgtctggatttcat

SEQ ID NO: 2238 - protein, 234 aa, Neisseria gonorrhoeae
LRGFLFFTYFVRQKVDGVHTGLPVGKFDFIFAADDNRGRTVDLEGFGQLLHFAGARLTFGGFVGGKDFFAVKGGLFAQPFFEDFRLLQLDFLVDHRIENMAVRHIFAFGGSHIDGGGEACQRQHFFLPDDVFGTQVHIVFKRLGVFAQNRFEAGAVRTKIAEKLKHFNLACLLLGNRVGKDGVVLPFDQSCRGGGCRSGRRAVGGDAGLDFAVARGKGEQGGNAEGEGEVSGFH

SEQ ID NO: 2239 - DNA, 987 bp, Neisseria gonorrhoeae
ttgaacaaacaggcggcttgttttaccataatgaatgttatgttatatcacaggaaaacagttatgaaacacctcaaacttacccttattgccgcattgctggccaccgccgcaactgccgcaccccttccggttgtaaccagtttcagcattttaggcgacgtagccaaacaaatcggcggtgagcgcgtagccgtacaaagcctcgtcggagccaaccaagatactcatgcctatcacatgaccagtggcgacattaaaaaaatccgcagtgcaaaactcgtcctgctcaacggcttgggacttgaagccgccgacatccaacgcgccgtcgaacagagcaaagtatcctatgccgaagcgaccaaaggcatccaacccctcaaagccgaagaagaaggcggacaccatcacgaccaccatcacgaccacgatcatgaccacgaaggacaccaccacgaccacggcgaatatgacccccacgtctggaacgaccctgttcttatgtccgactatgcccaaaacgtcgctgaaaccctgataaaggccgatcccgaaggcaaagtttattatcaacaacgcttgggcaactaccaaatgcagcttaaaaaactgcacagcgacgcacaagccgcatttaatgccgtccctgccgccaaacgcaaagtcctgaccgggcacgacgcattttcctacatgggcaaccgctacaacatcagcttcatcgccccgcaaggcgtgagcagcgaagccgagccgtccgccaaacaagtcgccgccatcatccggcaaatcaaacgcgaaggcatcaaagccgtatttaccgaaaatatcaaagacacccgcatggttgaccgcatcgccaaagaaaccggcgtcaacgtcagcggcaaactgtattccgacgcactcggcaacgcgcccgcagacacctacatcggcatgtaccgccacaacgtcaaagccttgaccaacgcgatgaagcaa

SEQ ID NO: 2240 - protein, 329 aa, Neisseria gonorrhoeae
LNKQAACFTIMNVMLYHRKTVMKHLKLTLIAALLATAATAAPLPVVTSFSILGDVAKQIGGERVAVQSLVGANQDTHAYHMTSGDIKKIRSAKLVLLNGLGLEAADIQRAVEQSKVSYAEATKGIQPLKAEEEGGHHHDHHHDHDHDHEGHHHDHGEYDPHVWNDPVLMSDYAQNVAETLIKADPEGKVYYQQRLGNYQMQLKKLHSDAQAAFNAVPAAKRKVLTGHDAFSYMGNRYNISFIAPQGVSSEAEPSAKQVAAIIRQIKREGIKAVFTENIKDTRMVDRIAKETGVNVSGKLYSDALGNAPADTYIGMYRHNVKALTNAMKQ

SEQ ID NO: 2241 - DNA, 825 bp, Neisseria gonorrhoeae
atgcactacgccctcgcatccgtcttctgcctgtccctcagcgccgcacccgtcggcgtattcctcgtcatgcgccgtatgagcctgataggcgacgcattgagccacgccgtcctgcccggtgccgccgtcggctacatgtttgccggcttgagcctgcccgctatgggtgtgggcgggtttgccgccggtatgctgatggcgctgcttgccggactcgtcagccgctttaccaccctgaaagaagatgccaactttgccgccttttacctgagcagcctcgccatcggcgtaatcctcatcagcaaaaacggcagcagcgtcgatttactccacctccttttcggatctgtgcttgccgtcgatattcccgcactgcaactcatcgccgccgtctccggcctcacgctcattacccttgccgtcatctaccgccccctggtgctagaaagcatagaccccctgttcctcaagtccgtcaacggcaaaggcgggctttggcacgtcattttcctcatcctcgtcgttatgaacctcgtatccggcttccaagctctcggcatcctgatgtcggtcggacttatgatgctgcccgccattaccgcccgcttatgggcaagaaatatggggacgctcattctgttgtccgtcctcatcgcccttttttgcggtttgatcgggctgctcatttcctaccacatcgaaatcccttccggccccgccatcatcctctgttgcagcgtcctttatctcttttccgtcatactcggcaaagaaggcggcatcttgcccaaatggttcaaaaaccaccgccaccacaccacc

SEQ ID NO: 2242 - protein, 275 aa, Neisseria gonorrhoeae
MHYALASVFCLSLSAAPVGVFLVMRRMSLIGDALSHAVLPGAAVGYMFAGLSLPAMGVGGFAAGMLMALLAGLVSRFTTLKEDANFAAFYLSSLAIGVILISKNGSSVDLLHLLFGSVLAVDIPALQLIAAVSGLTLITLAVIYRPLVLESIDPLFLKSVNGKGGLWHVIFLILVVMNLVSGFQALGILMSVGLMMLPAITARLWARNMGTLILLSVLIALFCGLIGLLISYHIEIPSGPAIILCCSVLYLFSVILGKEGGILPKWFKNHRHHTT

SEQ ID NO: 2243 - DNA, 135 bp, Neisseria gonorrhoeae
ttgccaacttccctttcaaaactgcaaatcattatgacaccttccctcttactgtcaggattgaccttccgactcttcctcgccctgattgccgtattccttttatggggtgtttacctttgggcggtatcggta

SEQ ID NO: 2244 - protein, 45 aa, Neisseria gonorrhoeae
LPTSLSKLQIIMTPSLLLSGLTFRLFLALIAVFLLWGVYLWAVSV

SEQ ID NO: 2245 - DNA, 738 bp, Neisseria gonorrhoeae
ttgggcggtatcggtatgagcatcatcgttgaaaacctgacggtcagctaccgccgccgccccgccgtacaccacgtcgacattacttttgaagaacatagtatgtgggcggttttcggtcccaacggcgcaggaaaatctacctttctcaaatccttaatgggattgcagcctatcgatacgggcagcatccggctggacggattgacccgtcaaaacattgcctatctcccccaacaatccgacatcgaccgttcccagcctatgaccgttttcgacttggcggcaatggggctgtggtatgaaatcggttttttcaaagggataaataccgctcaaaaacaacgcgttcacgaagccttggagcgtgtcggtatgcggcagtttgcccgccgccaaatcgcccacctctcaaacggacaattccaacgcgtccttttcgcccggatgctggttcaaaatgcaaaattcctgcttttggacgaacctttcaatgctgttgatgcacggacaacctacgagcttctcgacgtgttgcaaaaatgccattgcggcggacacgctatcattgccgttttgcacgattacgaacaagtccgtgcctactttcccaataccctgctgctcgcccgcgaaaaaattgcggcaggcgcaaccgagaccattctgacagaatcctacctcgcccaagccagcgccaaaatgcagcaacaggaaagccccgactggtgcgcctca

SEQ ID NO: 2246 - protein, 246 aa, Neisseria gonorrhoeae
LGGIGMSIIVENLTVSYRRRPAVHHVDITFEEHSMWAVFGPNGAGKSTFLKSLMGLQPIDTGSIRLDGLTRQNIAYLPQQSDIDRSQPMTVFDLAAMGLWYEIGFFKGINTAQKQRVHEALERVGMRQFARRQIAHLSNGQFQRVLFARMLVQNAKFLLLDEPFNAVDARTTYELLDVLQKCHCGGHAIIAVLHDYEQVRAYFPNTLLLAREKIAAGATETILTESYLAQASAKMQQQESPDWCAS

SEQ ID NO: 2247 - DNA, 363 bp, Neisseria gonorrhoeae
atgaacctgattcaacagctcgagcaagaagaaattgcccgcctgaacaaagaaatccccgaattcgcaccgggcgacaccgtagtcgtatccgtacgcgtcgtggaaggtacccgcagccgtctgcaagcctacgaaggcgtggttatcgcccgtcgcaaccgtggtttgaacagcaacttcatcgtccgcaaaatctccagcggcgaaggtgttgaacgtactttccaactgtattcccctactgttgagaaaatcgaagtcaaacgccgtggcgacgtacgccgtgccaaactgtactacctgcgcggtctgaccggcaaagctgcacgcatcaaagaaaaactgcctgcacgcaaaggt

SEQ ID NO: 2248 - protein, 121 aa, Neisseria gonorrhoeae
MNLIQQLEQEEIARLNKEIPEFAPGDTVVVSVRVVEGTRSRLQAYEGVVIARRNRGLNSNFIVRKISSGEGVERTFQLYSPTVEKIEVKRRGDVRRAKLYYLRGLTGKAARIKEKLPARKG

SEQ ID NO: 2249 - DNA, 948 bp, Neisseria gonorrhoeae
atgccgtctgaaaaccaagtttcagacggcatttttcaaacgggcctactgcgcggctttttgttcttcacgtactttgtccgccaaaaggtcgatggtgttcataccggactcccagtcggcaaattcgactttatatttgccgccgacgataaccgtgggcgtaccgtcgatttggaaggtttcggtcagctcctgcattttgccggcgcgcgcctgactttcgggggattcgtaggcggcaaggacttttttgccgtcaaaggcggtttgttcgcccagccattttttgaggacttccggctcttgcagcttgattttttggttgaccatcgcatcgaaaatatggctgttcgccacatctttgctttcggcggcagccatatcgacggcggcggcgaggcgtgccagcggcagcatttctttctgccagacgacgtgttcggtacgcaggtacatatcgtctttaaaagacttggcgtgtttgctcaaaacaggttcgaggcgggcgcagtgcggacaaaaatagccgaaaaactcaagcacttcaaccttgcctgcctgctgttggggaatcgggttggcaaggacggtgtagttttgcccttcgaccagtcctgccggggcggcggctgccgaagcggcaggcgcgctgtcggcggggacgctggtttggactttgctgtcgcacgcggcaagggcgaacagggcggcaacgccgagggcgagggcgaggtgtctggatttcatacggctctccgtgatgttggaaataaatcggatattggtattttattgtattttcgcgtgttgatacagtttgccgccgaaaaaggacgttttcgtttcgggaaaccgcttcagacggcatcaaacccgatgccatccgaagcggtttctgtcgtacaatacgcgccgccccggacggatacggctgttggggaacaa

SEQ ID NO: 2250 - protein, 316 aa, Neisseria gonorrhoeae
MPSENQVSDGIFQTGLLRGFLFFTYFVRQKVDGVHTGLPVGKFDFIFAADDNRGRTVDLEGFGQLLHFAGARLTFGGFVGGKDFFAVKGGLFAQPFFEDFRLLQLDFLVDHRIENMAVRHIFAFGGSHIDGGGEACQRQHFFLPDDVFGTQVHIVFKRLGVFAQNRFEAGAVRTKIAEKLKHFNLACLLLGNRVGKDGVVLPFDQSCRGGGCRSGRRAVGGDAGLDFAVARGKGEQGGNAEGEGEVSGFHTALRDVGNKSDIGILLYFRVLIQFAAEKGRFRFGKPLQTASNPMPSEAVSVVQYAPPRTDTAVGEQ

SEQ ID NO: 2251 - DNA, 114 bp, Neisseria gonorrhoeae
atgcaatataagccgctttcagacggcctatgccgtctgaaagcctttgatgcaacaaaccgccaaattatattcgttcattggaaaaaaacaccccgaattcatccttcaaaa

SEQ ID NO: 2252 - protein, 38 aa, Neisseria gonorrhoeae
MQYKPLSDGLCRLKAFDATNRQIIFVHWKKTPRIHPSK

SEQ ID NO: 2253 - DNA, 1143 bp, Neisseria gonorrhoeae
atgcaaggaatgataatggtcaaacatctgccactcgccgtcctgactgctttgctgcttgcagcgtgcggcggttcggacaaaccgcctgccgaaaaaccggcaccggcggaaaaccaaaacgtattgaaaatttataactggtcggaatacgtcgatccggaaaccgttgccgattttgaaaagaaaaacggcatcaaggttacttatgatgtgtacgacagtgatgaaacgctggaaagcaaggtgctgaccggaaaatccggttacgacattgtcgcgccgtccaatgcgtttgtgggcaggcagattaaggcaggtgcgtatcagaaaatcgataagtcgatgattcccaattataaacatctcaaccctgaaatgatgaggctgatggacggggtcgatcccgaccacgaatacgccgtgccgttttattgggggacaaataccttcgccatcaataccgaacgcgtgaaaaaggctttgggtacggacaagctgccggacaaccagtgggatttggtgttcaaccccgaatacacgttcaaactcaaacaatgcggcatcagctatttggacagcgcggcggaaatttatcccatggtgttgaactatttgggcaaaaacccgaacagcagcaatacggaagacatcagggaggcaaccgccctgctcaagaaaaaccgccccaatatcaaacgctttacttcgtccggctttatcgatgatttggcgcgcggcgatacctgcgtaacaatcggtttcggcggagatttgaacatcgccaaacgccgtgccgaagaagcgggcggcaaggaaaaaatccgcgtgatgatgccgaaagagggcgtggggatttgggtggattctttcgtgattccgaaagatgcgaaaaacgtcgccaacgcgcacaaatacatcaacgacttcctcgatccggaagtgtcggcgaaaaacggcaatttcgttacctacgcgccttcgagcaagccggcgcgcgatttgatggaggacgaatttaaaaacgacaatacgattttcccgagcggggaagatttgaaaaacagctttatcatggtgcctatccggccggcggcattgaagtttatggtgcgccagtggcaggatgtgaaggcggggaaa

SEQ ID NO: 2254 - protein, 381 aa, Neisseria gonorrhoeae
MQGMIMVKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSMIPNYKHLNPEMMRLMDGVDPDHEYAVPFYWGTNTFAINTERVKKALGTDKLPDNQWDLVFNPEYTFKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARDLMEDEFKNDNTIFPSGEDLKNSFIMVPIRPAALKFMVRQWQDVKAGK

SEQ ID NO: 2255 - DNA, 747 bp, Neisseria gonorrhoeae
atgcttatccaggcagttaccattttccccgaaatgttcgacagcattacccgctacggcgtaacgggacgcgcgaacagacagggaatctggcagtttgaagcagtcaatccccgaaagtttgccgacaacagattgggctatatcgacgaccgcccgttcggcggcggtccgggaatgattatgatggctccgccgcttcatgcggcgatagaacacgccaaagcacaatcttcccaaaccgcaaaagtcatctacctcagcccccaaggaaaaccgctgacacaccaaaaagcggcagaactggcagaacttacgcatctgattctgctgtgcggacgctatgagggaatagacgaaagactgctgcaaagcagcgtcgatgaagaaatcagcatcggagacttcgtcgtttccggcggagagcttcccgccatgatgctgatggatgcggtattgaggctcgtacccggcatattgggcgacattcagtctgccgaacaggattcgttctcaagcggtattttggactgcccccactacaccaaacccttagaatttcaaggcatggctgttccggaagtattgcgctccggaaatcatggcttgatagcggaatggcggttggaacaatcgctgcgccgcaccttggagcgcagacccgatcttttggaaaagcgcgttttaatcccaaaggaatcccgcctcttgaataaaatcctacaagagcaacgggaaatccaatca

SEQ ID NO: 2256 - protein, 249 aa, Neisseria gonorrhoeae
MLIQAVTIFPEMFDSITRYGVTGRANRQGIWQFEAVNPRKFADNRLGYIDDRPFGGGPGMIMMAPPLHAAIEHAKAQSSQTAKVIYLSPQGKPLTHQKAAELAELTHLILLCGRYEGIDERLLQSSVDEEISIGDFVVSGGELPAMMLMDAVLRLVPGILGDIQSAEQDSFSSGILDCPHYTKPLEFQGMAVPEVLRSGNHGLIAEWRLEQSLRRTLERRPDLLEKRVLIPKESRLLNKILQEQREIQS

SEQ ID NO: 2257 - DNA, 507 bp, Neisseria gonorrhoeae
atgacagacactcaaaaccgggtagccatgggctacatcaaaggcgtattcggcataaaaggctggctgaaaattgccgccaacaccgaatattccgacagccttttggactaccccgagtggcatttggccaaggacggcaaaaccgtcagcgttacccttgaagccggaaaagtcgtcaacggcgaactccaagtcaaattcgaaggcatagacgaccgcgattcagcattctcattgcgcggttacaccatcgaaataccccgtgaagcattcgccccgacagaagaagacgaatactactgggcagacttggtcggcatgaccgtcgtcaacaaagacgataccgttttaggcaaggtaagcaacctgatggaaaccggcgcaaacgacgtattgatgattgacggagaacacgggcagattctgattccgttcgtttcccaatatatcgaaaccgtcgataccggcagcaagaccattactgccgactggggtttggactac

SEQ ID NO: 2258 - protein, 169 aa, Neisseria gonorrhoeae
MTDTQNRVAMGYIKGVFGIKGWLKIAANTEYSDSLLDYPEWHLAKDGKTVSVTLEAGKVVNGELQVKFEGIDDRDSAFSLRGYTIEIPREAFAPTEEDEYYWADLVGMTVVNKDDTVLGKVSNLMETGANDVLMIDGEHGQILIPFVSQYIETVDTGSKTITADWGLDY

SEQ ID NO: 2259 - DNA, 243 bp, Neisseria gonorrhoeae
atggtagttatccgtttggcacgcggcggctcgaaacaccgccccttctacaacgtcatcgttactgactcacgcagccgccgcgacggccgcttcatcgaacgcgtaggcttctacaaccccgtagccaacgaaaaacaagagcgcgtccgcctcaatgcagaccgcctgaaccactggattgcacaaggcgcgcaagtcagcgactccgttgcaaaactgattaaagaacaaaaagccgtc

SEQ ID NO: 2260 - protein, 81 aa, Neisseria gonorrhoeae
MVVIRLARGGSKHRPFYNVIVTDSRSRRDGRFIERVGFYNPVANEKQERVRLNADRLNHWIAQGAQVSDSVAKLIKEQKAV

SEQ ID NO: 2261 - DNA, 225 bp, Neisseria gonorrhoeae
atgatggaactcatcatccaaaccgccgcacagcaaggctacctgagcatgagtgccgacattctcaaaaccaatacccccatgatcaaacttgctgaaaaatcaggatttaccctcaaggaatcggacaccgaaaaaaacctgtaccgcgcatatctgaaccttgcggcagacaaaacaacaggaaaaacaaataaaaacttgcgcaccggccacaaaataacc

SEQ ID NO: 2262 - protein, 75 aa, Neisseria gonorrhoeae
MMELIIQTAAQQGYLSMSADILKTNTPMIKLAEKSGFTLKESDTEKNLYRAYLNLAADKTTGKTNKNLRTGHKIT

SEQ ID NO: 2263 - DNA, 162 bp, Neisseria gonorrhoeae
ttggatgatgagttccatcattttctgtgccagcccgctgccgcgcatatgttccgccagtgtgatgccaaattcgcattcgttgcggttcaggcggctgtggcggacgacggcgacgatgttgctgtcggcatcccttgccgtccatgcggttcacagtgg

SEQ ID NO: 2264 - protein, 54 aa, Neisseria gonorrhoeae
LDDEFHHFLCQPAAAHMFRQCDAKFAFVAVQAAVADDGDDVAVGIPCRPCGSQW

SEQ ID NO: 2265 - DNA, 813 bp, Neisseria gonorrhoeae
ttgcagcggcaaatcccgccctgctcgccgaagccctgcacctccccctaccggcacaccacccataacgccgtccaattccaattcggcagccaccccctctatggcgacatcctgaccgcacgctgcaacggacaaaccactgccgtactcccgccgtttaccacgctcgacagccgccaccttgcccgctttgccgaactcgacggcacacaaaccctcgatcagttcctgcacacactgaccgtcatccccgaataccgccaacacattttcggcatcaccctcaacctcaacggcggacaatacagcagcgatttcatcttaaagacacccggaacacacgacacgcccaaacgcaagaacacaggcaaagccgcccaaaccctcgaacatgccgccgcaaaaatgcagagtgccgccgcatacctggaacacaaaaacccgacagccgccgaatttctccgccacacaagcgaagccgccgcagaactgctcggcagcaaaaccgaaaccggagcagccgtacccaacgtacttgccccctatcccgcagcacaccccaaaacactgtccctaaaaaacaacacgaccgttaccattatcccccttttacccgaagacgcagaagccaaacagcagttcgtccgcagcctcggccccgaagcacggtacacacgcttcatgacccacaccaacgaactgcccgcagccacgttggcacgcctgtgcaaccccgattaccactgtgaaccgcatggacggcaagggatgccgacagcaacatcgtcgccgtcgtccgccacagccgcc

SEQ ID NO: 2266 - protein, 271 aa, Neisseria gonorrhoeae
LQRQIPPCSPKPCTSPYRHTTHNAVQFQFGSHPLYGDILTARCNGQTTAVLPPFTTLDSRHLARFAELDGTQTLDQFLHTLTVIPEYRQHIFGITLNLNGGQYSSDFILKTPGTHDTPKRKNTGKAAQTLEHAAAKMQSAAAYLEHKNPTAAEFLRHTSEAAAELLGSKTETGAAVPNVLAPYPAAHPKTLSLKNNTTVTIIPLLPEDAEAKQQFVRSLGPEARYTRFMTHTNELPAATLARLCNPDYHCEPHGRQGMPTATSSPSSATAA

SEQ ID NO: 2267 - DNA, 1416 bp, Neisseria gonorrhoeae
ttgcagcgtcttccccggcttgtgccgccgcgtcaagtgctttgttacaatgcactaccttcacatttcttaataaattttatgagtaaccatacttcttggtcgtccaaaatcggtttcgtacttgctgcggcaggttcggccatcggtttgggcgcgatttggaaatttccttatacggcgggcaccaacggcggcgcggtgtttttcctgctgtttttgatatttaccgtcttggtcgccctgcccgtccagcttgccgaattttatatcgggcgcacgggcggtaaaaatgccgtcgattccttcagggttctgcgtccgggtacgcaatggctttgggtcgggcgcatgggcgttgccgcctgctttattttgctgtcgttttacagcgtggtcggcggatgggtattgaattatgtcgtccacagttttacaggagcaatccatgcgggagcggactttgaagccctgttcggcacaacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggctgtccgttcgctgacgctgccggatgcaatggagggcgtgtctttcctgctcaaacccaattggtcgtactttaaagccgatacgatgattacggctttgggccaggcgttttttgccctgagcatcggcgtttccgccatgattacctatgcttcgtatttgggaaaagatcaggatatgttccgttccggccatacgattatgtggatgaacctcttggtttccctgcttgccggcctggtgattttcccggcggtattcgccttcggttttgaaccgaaccaggggccgggattgatttttatcgtattgcccgcagtgttcatgaaaatgccgttcggtacggttttatttgcagtattcatgcttctggtcgttttcgccacgctgacttcggcattttcgatgttggaaacggtcattgcctcaaccatccgccaagacgagcgcaaacgcaaaaaacatacttggcttatcggcacggctattttcattgtcggcatcccgtccgcgctgtctttcggcgcatggggtgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcgtcaattctttaggcatcctt

SEQ ID NO: 2268 - protein, 472 aa, Neisseria gonorrhoeae
LQRLPRLVPPRQVLCYNALPSHFLINFMSNHTSWSSKIGFVLAAAGSAIGLGAIWKFPYTAGTNGGAVFFLLFLIFTVLVALPVQLAEFYIGRTGGKNAVDSFRVLRPGTQWLWVGRMGVAACFILLSFYSVVGGWVLNYVVHSFTGAIHAGADFEALFGTTISNPAGSLSYQALFMLITVWVVKGGISDGIEKANRYLMPGLFILFIALAVRSLTLPDAMEGVSFLLKPNWSYFKADTMITALGQAFFALSIGVSAMITYASYLGKDQDMFRSGHTIMWMNLLVSLLAGLVIFPAVFAFGFEPNQGPGLIFIVLPAVFMKMPFGTVLFAVFMLLVVFATLTSAFSMLETVIASTIRQDERKRKKHTWLIGTAIFIVGIPSALSFGAWGEFKVFGKTIFDLWDYVISAVIMPIGALSVSIFTAWIQDKQSVLKDAGAGSTVPRAVLLLWLNTLRYLAPIAIIIVFVNSLGIL

SEQ ID NO: 2269 - DNA, 1332 bp, Neisseria gonorrhoeae
ttgccttcaaacagcggctgcaagccctcttccgccaaagataaaaaatgccgtccgaacatccttcagacggcatatcgggctttatttccccgccttcacatcctgccactggcgcaccataaacttcaatgccgccggccggataggcaccatgataaagctgtttttcaaatcttccccgctcgggaaaatcgtattgtcgtttttaaattcgtcctccatcaaatcgcgcgccggcttgctcgaaggcgcgtaggtaacgaaattgccgtttttcgccgacacttccggatcgaggaagtcgttgatgtatttgtgcgcgttggcgacgtttttcgcatctttcggaatcacgaaagaatccacccaaatccccacgccctctttcggcatcatcacgcggattttttccttgccgcccgcttcttcggcacggcgtttggcgatgttcaaatctccgccgaaaccgattgttacgcaggtatcgccgcgcgccaaatcatcgataaagccggacgaagtaaagcgtttgatattggggcggtttttcttgagcagggcggttgcctccctgatgtcttccgtattgctgctgttcgggtttttgcccaaatagttcaacaccatgggataaatttccgccgcgctgtccaaatagctgatgccgcattgtttgagtttgaacgtgtattcggggttgaacaccaaatcccactggttgtccggcagcttgtccgtacccaaagcctttttcacgcgttcggtattgatggcgaaggtatttgtcccccaataaaacggcacggcgtattcgtggtcgggatcgaccccgtccatcagcctcatcatttcagggttgagatgtttataattgggaatcatcgacttatcgattttctgatacgcacctgccttaatctgcctgcccacaaacgcattggacggcgcgacaatgtcgtaaccggattttccggtcagcaccttgctttccagcgtttcatcactgtcgtacacatcataagtaaccttgatgccgtttttcttttcaaaatcggcaacggtttccggatcgacgtattccgaccagttataaattttcaatacgttttggttttccgccggtgccggtttttcggcaggcggtttgtccgaaccgccgcacgctgcaagcagcaaagcagtcaggacggcgagtggcagatgtttgaccattatcattccttgcatatcgggttggagaaagcggccattatagccgatattggtaacagggcttcagacggcattcaaaatcccgcaatgccgtctgaaagccgccgcttccatagc

SEQ ID NO: 2270 - protein, 444 aa, Neisseria gonorrhoeae
LPSNSGCKPSSAKDKKCRPNILQTAYRALFPRLHILPLAHHKLQCRRPDRHHDKAVFQIFPARENRIVVFKFVLHQIARRLARRRVGNEIAVFRRHFRIEEVVDVFVRVGDVFRIFRNHERIHPNPHALFRHHHADFFLAARFFGTAFGDVQISAETDCYAGIAARQIIDKAGRSKAFDIGAVFLEQGGCLPDVFRIAAVRVFAQIVQHHGINFRRAVQIADAALFEFERVFGVEHQIPLVVRQLVRTQSLFHAFGIDGEGICPPIKRHGVFVVGIDPVHQPHHFRVEMFIIGNHRLIDFLIRTCLNLPAHKRIGRRDNVVTGFSGQHLAFQRFITVVHIISNLDAVFLFKIGNGFRIDVFRPVINFQYVLVFRRCRFFGRRFVRTAARCKQQSSQDGEWQMFDHYHSLHIGLEKAAIIADIGNRASDGIQNPAMPSESRRFHS

SEQ ID NO: 2271 - DNA, 1461 bp, Neisseria gonorrhoeae
ttgcacaaacagttaccccaaaacaaacacacagcgggtgcatctccaaaaatcacgcacataccgtccgcaaaggaatatatcatgccggcacaaaccgatccgggctacttcttcatgcccaaccacattatcctgataggcgcgagcgaacaaccgtacagcctgggtgaacgcgtactcagcaacctgctgagtacgccctttcaaggaaaaatcacccccgtaaacccgcgccaccacaccatagccgggcttcccgcctacaccagcctcaacaaaatccccggcagtgcagacctgattattaccgttaccccgcccgacagttacgacaccctcctcaaaacctgccgtaaaaagcagctccgacacatcatcctcatacaggactgggacagcctgtctgccgcagaactgcacaccgccgaaactgccatccgcaaacaccacggcaacggactcaacatcaccgcctgcaccaccgcaggcatccaactgccctcactcggactcaacatcagtacccaagacggatatgccgcaggccataccgccatactgaccggcaatgccgccgtcagccgccaaatcgacaacatcctgaacaaactccgtcaaggcacatcccgccacatcagcctgcatcccggcatcagccccatcacatccgccgattggctcaaccgcttcggacacagcctgcacaccaaaaccgccgtcctacaccacaaccctgaagaggatcagcgcaggctgttcagcgcaatccgccaatttacccgccatacgccgctgattctccacatcacctgcctcacgacagaaaccgaccgtgccgtactgcactgcctcgcccgacactgcaacttcctcatcagtttcaacgccgacgacctcgaagccgcactgagcgcccaactgtccgaccttccacccctgtcccgactcgacatcctgtccgacacgcctgccgaatggctgcacgcgcacgcaccaaaaaacctcaccctccactttcccaaccttccccaccacatccgcaacggacacctgaccggcacacccacaccctcaatctgccacgacatcgcctcacgtcagcttgcccgccccgacacccaagccgtcctgaccatcctcggtccctccggacacgaggattacaaaaaaacagcacgcgcccttatccgcctgtccgaacagaccgccaaacccctgctcgtcagcagccccttttcagacggcataacacatttcgacacccccgcacaggcaatccgcaccctttcctaccgtaacaccgccgccgccctgaaacaggcacagctcgacattgcaccgccgcagccatgccgtctgaaaacaccgcaaccccaaaacatcaaaaaagcccttgcagcggcaaatcccgccctgctcgccgaagccctgcacctccccctaccggcacaccaccca

SEQ ID NO: 2272 - protein, 487 aa, Neisseria gonorrhoeae
LHKQLPQNKHTAGASPKITHIPSAKEYIMPAQTDPGYFFMPNHIILIGASEQPYSLGERVLSNLLSTPFQGKITPVNPRHHTIAGLPAYTSLNKIPGSADLIITVTPPDSYDTLLKTCRKKQLRHIILIQDWDSLSAAELHTAETAIRKHHGNGLNITACTTAGIQLPSLGLNISTQDGYAAGHTAILTGNAAVSRQIDNILNKLRQGTSRHISLHPGISPITSADWLNRFGHSLHTKTAVLHHNPEEDQRRLFSAIRQFTRHTPLILHITCLTTETDRAVLHCLARHCNFLISFNADDLEAALSAQLSDLPPLSRLDILSDTPAEWLHAHAPKNLTLHFPNLPHHIRNGHLTGTPTPSICHDIASRQLARPDTQAVLTILGPSGHEDYKKTARALIRLSEQTAKPLLVSSPFSDGITHFDTPAQAIRTLSYRNTAAALKQAQLDIAPPQPCRLKTPQPQNIKKALAAANPALLAEALHLPLPAHHP

SEQ ID NO: 2273 - DNA, 1404 bp, Neisseria gonorrhoeae
atgaaactgttccaacgcattttcgccacattttgcgcggttatcgtctgcgcaatctttgtggcgagtttttctttttggctggtgcagaacacccttgccgaaaaccaattcaaccaacgccgcaccatcgaaaccacattgatgggcagcattatttccgcattcaagacacggggcgacaacggcgcgcgcgaaatcctgaccgaatggaaaaacagccccgtctcatccgccgtttacgtcatacagggcgacgagaaaaaagacatcttaaaccgctatatcgacaattacaccatagaacgcgcccggctgtttgccgccaacaacccccattccaaccttgtccgcatcgaatacgaccgtttcggcgaagaatacctgttcttcattaaaggctgggacaaccaccaggcacaacgcctgcccagcccgctgtttatcccgggcctgccgcttgccccgatttggcacgaattcatcatcctctccttcatcatcattgtcggactgctgatggcatatatccttgccggcaacattgccaaacccatcagaatcttaggcaacggcatggacagggtggcaaacggagaacttgaaacccgcatctcccaacaggtcgacgaccgcgacgacgaattgtcccatcttgccatccaattcgacaaaatggcggaaaaactcgaaaaacttgtcgccaaagaacgttacctactccaccacgtttcccacgaaatgcgctccccgcttgcccgtatgcaggcaattgtcggactgattcaggcacagccccaaaaacgggagcaatatctcaaacggctggaaggcgaactgacccgcatggatacgctggccggggaactgttaaccctgtcccgcctcgaaacctccaatatggctttggaaaaagaaagcctgaaactcctgcccttcctgggcaacctggtagaagacaaccaaagtatcgcccaaaagaacggacagacggtcgccctgtctgccgacggaaaaatccccgaaaacacaaccatccttgccaacgaaagctacctgtaccgcgccttcgacaacgtcatccgcaacgccgtcaactacagccccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggtttcaaaacagaaaaaagtgcgaac

SEQ ID NO: 2274 - protein, 468 aa, Neisseria gonorrhoeae
MKLFQRIFATFCAVIVCAIFVASFSFWLVQNTLAENQFNQRRTIETTLMGSIISAFKTRGDNGAREILTEWKNSPVSSAVYVIQGDEKKDILNRYIDNYTIERARLFAANNPHSNLVRIEYDRFGEEYLFFIKGWDNHQAQRLPSPLFIPGLPLAPIWHEFIILSFIIIVGLLMAYILAGNIAKPIRILGNGMDRVANGELETRISQQVDDRDDELSHLAIQFDKMAEKLEKLVAKERYLLHHVSHEMRSPLARMQAIVGLIQAQPQKREQYLKRLEGELTRMDTLAGELLTLSRLETSNMALEKESLKLLPFLGNLVEDNQSIAQKNGQTVALSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGFKTEKSAN

SEQ ID NO: 2275 - DNA, 675 bp, Neisseria gonorrhoeae
atgagccgcgtattactcgtagatgacgatgccctgctgaccgaactgctgaccgaatacctgagcgccgaaggtctgaacgtccgcagcgttcccgacggggaagcaggcgtacaggaaatcctgagcgggcaatacgatgtagtcgtattggattccatgatgcccaaaatgaacggcttggatgtcttgaaaaacgtacgcgcccgaagcaccgtccccatcatcatgctgaccgccaaaggcgacgacatcgaccgaatcatcggcttggaaatgggtgcggacgactatgtccccaaaccctgcacaccacgcgaactcttggcacgcatcaatgccatcctccgccgagcacaacacagcggcgaacagaacaacgcacccaacagcatctccgtcagcgatgtcgtcctataccccgccaaacgccaggcatccgtcaaagacatgccgctcgaactgaccagcaccgaattcaacctgctcgaagtcctgatgcgccatgccggacaggtagtcagcaaagaaaccctgtccgtcgaagcactcgaccgcaagctggcaaaattcgaccgcagtatcgacgtacacatctccagcatccgccacaagctgggcgatgcctccctgattcaaaccgtacgcggcttgggctacctgtttgtcaaaaac

SEQ ID NO: 2276 - protein, 225 aa, Neisseria gonorrhoeae
MSRVLLVDDDALLTELLTEYLSAEGLNVRSVPDGEAGVQEILSGQYDVVVLDSMMPKMNGLDVLKNVRARSTVPIIMLTAKGDDIDRIIGLEMGADDYVPKPCTPRELLARINAILRRAQHSGEQNNAPNSISVSDVVLYPAKRQASVKDMPLELTSTEFNLLEVLMRHAGQVVSKETLSVEALDRKLAKFDRSIDVHISSIRHKLGDASLIQTVRGLGYLFVKN

SEQ ID NO: 2277 - DNA, 147 bp, Neisseria gonorrhoeae
atgcaagacattgcaaaaaacagcaaaccggtagggaaatacgctatcaaaaaacattgcagccgtgttaagataaactgtcaaacaatcttttcacgccacgcccgaaacagggtcggggcatacccttacgaaaaggaaacacca

SEQ ID NO: 2278 - protein, 49 aa, Neisseria gonorrhoeae
MQDIAKNSKPVGKYAIKKHCSRVKINCQTIFSRHARNRVGAYPYEKETP

SEQ ID NO: 2279 - DNA, 1812 bp, Neisseria gonorrhoeae
atgtccgctgaaacgaccgtatccggcgcgcgccccgccgccaaactgccgatttacatcctgccctgcttcctttggataggcatcatcccctttaccttcgcactcaggctgaaaccgtcgcccgacttttaccacgatgccgccgccgcggccggcctgattgtcctgttgttcctcacggcaggaaaaaagctgtttgatgtcaaaatccccgccatcagcttcctcctgtttgcaatggcggcattttggtggcttcaggcacgcctgatgaacctgatttatcccggaatgaacgacatcgcctcttgggttttcatcttgctcgccgtcagcgcgtgggcctgcaagagtttggtcgcacactacggacaagaacgcatcgttaccctgtttgcctggtcgctgcttatcggctccctgcttcaatcctgcatcgtcgtcatccagtttgccggctgggaaaacacccccctgcttcaaaacatcatcgttcacagagggcaaggcgtaatcggacacatcgggcagcgcaacaacctcggacactacctcatgtggggcatactcgcctccgcctacctcaacggacaacgaaaaatccccgcagccctcggcgcaatctgcctgattatgcagaccgccgttttaggtttggtcaattcgcgcaccatcttgacctacatagccgccatcgccctcatccttcccttctggtatttccgttcggacaaatccaacagacggacgatgctcggcatagccgcagccgtattccttaccgcgctgttccaattttccatgaacgccattctggaaacctttacaggcatccgctacgaaactgccgtcgaacgcgtcgccaacggcggtttcacagacttgccgcgccaaagcgaatggaataaagcccttgccgccttccagtccgccccgatattcgggcacggctggaacagttttgcccaacaaaccttcctgatcaatgccgaacagcacaccatacacgacaacttcctcagcaccttgttcacccattcccacaacatcatcctccaactccttgcagaaatggggatcagcggcacgcttctggttgccgcaaccctgctgacgggcattgccgggctgctgaaacgctccctgacccccgcatcacttttcctgctgtgcgcgcttgccgtcagtatgtgccacagtatgctcgaatatcctttgtggtatgtctatttcctcatccccttcggactgatgctctttctgtcccccgcagaggcttcagacggcatcgccttcaaaaaagccgccaatctcggcatactgaccgcctccgccgccatattcgcaggattgctgcacttggactggacatacacccggctggttaactccttttcccccgccgctgacgacagtgccaaaaccctcaaccggaaaatcaacgaactgcgctatatttccgcaaacagcccgatgctgtccttttatgccgacttctccctcgtaaacttcgccctgccggaataccccgaaacccagacttgggcggaagaagcaaccctcaaagcactaaaataccgcccctactccgccacctaccgcatcgccctctacttgatgcggcaaggcaaagttgcagaagcaaaacaatggatgcgggcaacacagtcctattacccctacctgatgccccgatacgccgacgaaatccgcaaactgcccgtatgggcaccgctgctgcccgaactgctcaaagactgcaaagccttcgccgccgctcccggccatccggaaacaaaaccctgcaaa

SEQ ID NO: 2280 - protein, 604 aa, Neisseria gonorrhoeae
MSAETTVSGARPAAKLPIYILPCFLWIGIIPFTFALRLKPSPDFYHDAAAAAGLIVLLFLTAGKKLFDVKIPAISFLLFAMAAFWWLQARLMNLIYPGMNDIASWVFILLAVSAWACKSLVAHYGQERIVTLFAWSLLIGSLLQSCIVVIQFAGWENTPLLQNIIVHRGQGVIGHIGQRNNLGHYLMWGILASAYLNGQRKIPAALGAICLIMQTAVLGLVNSRTILTYIAAIALILPFWYFRSDKSNRRTMLGIAAAVFLTALFQFSMNAILETFTGIRYETAVERVANGGFTDLPRQSEWNKALAAFQSAPIFGHGWNSFAQQTFLINAEQHTIHDNFLSTLFTHSHNIILQLLAEMGISGTLLVAATLLTGIAGLLKRSLTPASLFLLCALAVSMCHSMLEYPLWYVYFLIPFGLMLFLSPAEASDGIAFKKAANLGILTASAAIFAGLLHLDWTYTRLVNSFSPAADDSAKTLNRKINELRYISANSPMLSFYADFSLVNFALPEYPETQTWAEEATLKALKYRPYSATYRIALYLMRQGKVAEAKQWMRATQSYYPYLMPRYADEIRKLPVWAPLLPELLKDCKAFAAAPGHPETKPCK

SEQ ID NO: 2281 - DNA, 351 bp, Neisseria gonorrhoeae
gtgaacagacaaaccgcttacttccttgcctccttcagcctgattgcactgattgccctatccctttcttgggaattatggattgcaccgttacgcccgggcggttcgtggctcgcgctcaaagccctgcccctctgcctgccgctttcaggtattctaaagaaaaaaatctatacctaccaatacagctccatgctggttctgatttactttgccgaagccgtcatgcgcctgttcaacgcctatcccgcagaaaaaatttgcgccgcgctttccgcagtattcagcatcatcttcttcatatcctgcctgtcgttcgtcaaacaatacaaggaaacaaacaatgtccgc

SEQ ID NO: 2282 - protein, 117 aa, Neisseria gonorrhoeae
VNRQTAYFLASFSLIALIALSLSWELWIAPLRPGGSWLALKALPLCLPLSGILKKKIYTYQYSSMLVLIYFAEAVMRLFNAYPAEKICAALSAVFSIIFFISCLSFVKQYKETNNVR

SEQ ID NO: 2283 - DNA, 1536 bp, Neisseria gonorrhoeae
atgaatatgcttggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatataaggaaacgcgttctaaagaggcgacggaggcttttatccgccacgttgcgggaatgctgtcgtttgtgctgatcgtcgttaccgcgctgggcatacttgccgcgccttgggtgatttatgtttccgcgcccggctttaccaaagacgcggacaagttccaactttccatcagcctgctgcggattacgtttccttatatattattgatttctttgtcttcttttgtcggctcgatactcaattcctaccataagttcggcattcccgcgtttacgcccacgtttttaaacatctcttttatcgtattcgcactgtttttcgtgccgtatttcgatccgcccgttaccgcgctggcgtgggcggtttttgtcggcggtattttgcagctcggtttccaactgccgtggctggcgaaactgggctttttgaaactgcccaaactgaatttcaaagatgcggcggtcaaccgcgtcatgaaacagatggcgcctgcgattttgggcgtgagcgtggcgcaaatttctttggttatcaacacgattttcgcgtcttatctgcaatcgggcagcgtttcatggatgtattacgccgaccgcatgatggagctgcccggcggcgtgctgggggctgcactcggtacaattttgctgccgactttgtccaaacactcggcaaaccaagatacggaacagttttccgccctgctcgactggggtttgcgcctgtgcatgctgctgacgctgccggcggcggccggactggcggtattgtcgttcccgctggtggcgacgctgtttatgtaccgagaattcacgctgtttgacgcacaaatgacgcaacacgcgctgattgcctattctttcggtttaatcggtttaattatgattaaagtgttggcatccggcttttatgcgcggcaaaacatcaaaacgcccgtcaaaatcgccatcttcacgctcatctgcacgcagttgatgaacctcgcctttatcggtccgttgaaacacgccgggctttcgctcgccatcggcctgggcgcgtgcatcaacgccggattgttgttcttcctgttgcgcaaacacggtatttaccggcccggcaggggttgggcggcgttcttggcgaaaatgctgctcgcgctcgccgtgatgtgcggcggactgtgggcggcgcaggcttgcctgccgttcgaatgggcgcacgccggcggaatgcggaaagcggggcagctctgcatcctgattgccgtcggcggcggactgtatttcgcatctctggcggctttgggcttccgtccgcgccatttcaaacgcgtggaaagc

SEQ ID NO: 2284 - protein, 512 aa, Neisseria gonorrhoeae
MNMLGALAKVGSLTMVSRVLGFVRDTVIARAFGAGMATDAFFVAFKLPNLLRRVFAEGAFAQAFVPILAEYKETRSKEATEAFIRHVAGMLSFVLIVVTALGILAAPWVIYVSAPGFTKDADKFQLSISLLRITFPYILLISLSSFVGSILNSYHKFGIPAFTPTFLNISFIVFALFFVPYFDPPVTALAWAVFVGGILQLGFQLPWLAKLGFLKLPKLNFKDAAVNRVMKQMAPAILGVSVAQISLVINTIFASYLQSGSVSWMYYADRMMELPGGVLGAALGTILLPTLSKHSANQDTEQFSALLDWGLRLCMLLTLPAAAGLAVLSFPLVATLFMYREFTLFDAQMTQHALIAYSFGLIGLIMIKVLASGFYARQNIKTPVKIAIFTLICTQLMNLAFIGPLKHAGLSLAIGLGACINAGLLFFLLRKHGIYRPGRGWAAFLAKMLLALAVMCGGLWAAQACLPFEWAHAGGMRKAGQLCILIAVGGGLYFASLAALGFRPRHFKRVES

SEQ ID NO: 2285 - DNA, 645 bp, Neisseria gonorrhoeae
atgccgtctgaagccccgccgcacattaaggagcacaccgtgaacaccctttacttaggttcgggcagcccgcgccggatggaaatcctgacacagttgggctatcgggtcgtcaagctgcccgccggcatcgacgaaaccgttaaagccggcgaaacgcccgccccttacgtccaaaggatggcggaagaaaaaaatcaggcggctttgaccctcttttgcgaaaccaacggcgcaatgcccgatttccccctgattaccgccgacacctgcgtcttttcagacggcatcatattgggcaaacctcgctcccaagccgaagcaatcgaatttttaaaccgattgtccggcaaacaacataccgtcctgactgctgtctgcattcattatcgcggcaaaacgtcaagccgcgtccaaaccaaccgcgtcgttttcaagcccctgagttcggaagaaatttccgcctatgtgcaaagcggcgaaccgatggagaaagccggtgcctacgccgtgcaaggcataggcggtatctttatccaatctatcgaaggcagcttcagcggcattatggggctgcccgtttatgaaaccgtttccatgttgcaggatttgggataccgcccccccttatccgcccttaaaccg

SEQ ID NO: 2286 - protein, 215 aa, Neisseria gonorrhoeae
MPSEAPPHIKEHTVNTLYLGSGSPRRMEILTQLGYRVVKLPAGIDETVKAGETPAPYVQRMAEEKNQAALTLFCETNGAMPDFPLITADTCVFSDGIILGKPRSQAEAIEFLNRLSGKQHTVLTAVCIHYRGKTSSRVQTNRVVFKPLSSEEISAYVQSGEPMEKAGAYAVQGIGGIFIQSIEGSFSGIMGLPVYETVSMLQDLGYRPPLSALKP

SEQ ID NO: 2287 - DNA, 768 bp, Neisseria gonorrhoeae
gtgtccgaaacacaaaacgaacaaaccgtccaaccgcttgtcgaacacctcatcgagctacgccgccgcctgatgtggatggttgtcggcattctcgtctgctttttcggcatgatgccgtttgcccagcagctctatacttttatcgccgacccgctgatggcaaacctgcccaaagacaccagtatgattgcgaccgatgtcatcgcaccgtttttcgttccggtcaaagttaccctgatggcggcgtttttggtttcactgccgcatacgctctaccaaatctgggcattcgtcgcccccgcactctaccaaaacgaaaaacgcctgattacgccgctcgtcctctccagcgtcagcctgtttttcatcggcatggcatttgcctatttcctggttttccccgtcattttcaaattccttgccggcgtaacccccgtcggggtcaatatggcgaccgacatagacaaatacctgtcctttatcttaggtatgttcgttgcgttcggcacggcatttgaagtgcccatcgtcgtcatcctgttaaccaaaatcggcgcagtcacgaccgagcagctcaaacacgcccggccttatgtcattgtcggcgcgtttgtcgttgccgcagtcatcacgccgcccgacattatttctcagaccctgcttgccattccgctgatcctcttatacgaggcgggcatttggttcggacgcttcttcactccacgttcagaacaggatggcgacatacagccgcctgcaaaaacc

SEQ ID NO: 2288 - protein, 256 aa, Neisseria gonorrhoeae
VSETQNEQTVQPLVEHLIELRRRLMWMVVGILVCFFGMMPFAQQLYTFIADPLMANLPKDTSMIATDVIAPFFVPVKVTLMAAFLVSLPHTLYQIWAFVAPALYQNEKRLITPLVLSSVSLFFIGMAFAYFLVFPVIFKFLAGVTPVGVNMATDIDKYLSFILGMFVAFGTAFEVPIVVILLTKIGAVTTEQLKHARPYVIVGAFVVAAVITPPDIISQTLLAIPLILLYEAGIWFGRFFTPRSEQDGDIQPPAKT

SEQ ID NO: 2289 - DNA, 684 bp, Neisseria gonorrhoeae
atgtttgatttcggtttgggcgagctgatttttgtcggcattatcgccctgattgtccttggtccagaacgcctgcccgaagccgcccgcactgccggacggcttatcggcaggctgcaacgctttgtaggaagcgtcaaacaagaacttgacactcaaatcgaactggaagagctgaggaaggtcaagcaggcattcgaagctgccgccgctcaggttcgagacagcctcaaagaaaccgatacggatatgcagaacagtctgcacgacatttccgacggtctgaagccttgggaaaaactgcccgaacagcgcacgcctgccgatttcggtgtcgatgaaaacggcaatccccttcccgatacggcaaacaccgtatcagacggcatttccgacgttatgccgtctgaacgttccgatacttccgccgaaacccttggggacgacaggcaaaccggcagtacagccgaacctgcggaaaccgacaaagaccgcgcatggcgggaatacctgactgcttctgccgccgcacctgtcgtacaggccgtcgaagtcagctatatcgatactgctgttgaaacgcctgttccgcacaccacttccctgcgcaaacaggcaataaaccgcaaacgcgattttcgtccgaaacaccgcgccaaaccgaaattgcgcgtccgtaaatca

SEQ ID NO: 2290 - protein, 228 aa, Neisseria gonorrhoeae
MFDFGLGELIFVGIIALIVLGPERLPEAARTAGRLIGRLQRFVGSVKQELDTQIELEELRKVKQAFEAAAAQVRDSLKETDTDMQNSLHDISDGLKPWEKLPEQRTPADFGVDENGNPLPDTANTVSDGISDVMPSERSDTSAETLGDDRQTGSTAEPAETDKDRAWREYLTASAAAPVVQAVEVSYIDTAVETPVPHTTSLRKQAINRKRDFRPKHRAKPKLRVRKS

SEQ ID NO: 2291 - DNA, 201 bp, Neisseria gonorrhoeae
atgggcagtttttctctgacgcactggattatcgtactgattatcgtcgttttgatattcggcaccaaaaaattgcgcaacgtcggcaaagacctcggcggtgcggttcatgacttcaaacaggggctgaacgaaggcacagacggcaaagaagcccaaaaagacgatgtaatcgaacacaaaaaagacgaagacaaagca

SEQ ID NO: 2292 - protein, 67 aa, Neisseria gonorrhoeae
MGSFSLTHWIIVLIIVVLIFGTKKLRNVGKDLGGAVHDFKQGLNEGTDGKEAQKDDVIEHKKDEDKA

SEQ ID NO: 2293 - DNA, 201 bp, Neisseria gonorrhoeae
gtgttcgattacatcgtctttttgggcttctttgccgtctgtgccttcgttcagcccctgtttgaagtcatgaaccgcaccgccgaggtctttgccgacgttgcgcaattttttggtgccgaatatcaaaacgacgataatcagtacgataatccagtgcgtcagagaaaaactgcccatgatgtatccttaagtaagtat

SEQ ID NO: 2294 - protein, 67 aa, Neisseria gonorrhoeae
VFDYIVFLGFFAVCAFVQPLFEVMNRTAEVFADVAQFFGAEYQNDDNQYDNPVRQRKTAHDVSLSKY

SEQ ID NO: 2295 - DNA, 351 bp, Neisseria gonorrhoeae
gtgcttttttcagacggcaacggagccgttatggacaactgtattttctgcaaaatcgccgccaaagagattccggcgcaaaccgtctatgaagacggcgaaatggtttgtttcaaagacatcaaccccgccgctccgcttcatctgctgctgattcccaaagtccattttgattcgttggcacacgccgcgcccgaacatcagccccttttgggaaaaatgatgctgaaagttcccgaaatcgccaaagcttcgggactgaccgacggtttcaaaacccttatcaataccggcaaaggcggcggacaagaggtcttccacctgcatatacacatcatgggcacacccgta

SEQ ID NO: 2296 - protein, 117 aa, Neisseria gonorrhoeae
VLFSDGNGAVMDNCIFCKIAAKEIPAQTVYEDGEMVCFKDINPAAPLHLLLIPKVHFDSLAHAAPEHQPLLGKMMLKVPEIAKASGLTDGFKTLINTGKGGGQEVFHLHIHIMGTPV

SEQ ID NO: 2297 - DNA, 384 bp, Neisseria gonorrhoeae
ttgcccgagagcagccgtttagcctatcattccgaacaaacagaaacaaacagaaggaaaatcatgggagattccgtactatccgccatccaacaaaccattatacagcgcaaatctgccgacccgtccgaatcttacgtcgcacagctcctgcacaagggcgaggacaaaatcctaaaaaaagtgattgaagaagcgggcgaagtgttgatggcatccaaagacaaagacccgtcccacctggtttacgaagttgccgacttatggttccacaccatgattcttctgacacaccacgacctgaaggcggaagacgtattggacgaactttcccgccgtcaggggctgtcggggctggccgaaaaagccgcccgtacagaatcc

SEQ ID NO: 2298 - protein, 128 aa, Neisseria gonorrhoeae
LPESSRLAYHSEQTETNRRKIMGDSVLSAIQQTIIQRKSADPSESYVAQLLHKGEDKILKKVIEEAGEVLMASKDKDPSHLVYEVADLWFHTMILLTHHDLKAEDVLDELSRRQGLSGLAEKAARTES

SEQ ID NO: 2299 - DNA, 699 bp, Neisseria gonorrhoeae
ttgttaatccactatattgtccggcatggccagcctaactttaagccgcctgctttcggcaaccgaccgtatcagcggcaaatccatcacggaaaacgccgtcgacaaggcatcggcaaccgccgcatcatccgccattacgctcatgcttttataacgcggcgtactcacgccggttcgcggatcgaacaaatgggtaagcctgcccgctttgtccatcaccgtcccatagccgcccgaagtggcaaacgccttgtctttcatcgtgatatttgccaacacgccttcttcgtcgtccggattgcggatgccgacattccacatccgcctgccgtttgtatcaaaccccctgatttcgcccatatcgaccagcgcggcaggcactccgtttgctttaagcagcgcaacaaccttgtccgtgatatagccttgcgcgatgccgttcaaggacaaacccatacccttttcggcaaaacggatttcacggtcgtcaaacgagactttgccgaagccgacccgtttcagggtttccttcacgctattctccggcggcgtttccgcatcgggacgggcggcaaaataatcggcatacagtttccacaacgcctgaaccgtcggatcgaacgcgccttccgtcagcgcgtgaatatcgcggccaggctcaacagttccaaaaaatccgccggaggcgaagtcaga

SEQ ID NO: 2300 - protein, 233 aa, Neisseria gonorrhoeae
LLIHYIVRHGQPNFKPPAFGNRPYQRQIHHGKRRRQGIGNRRIIRHYAHAFITRRTHAGSRIEQMGKPARFVHHRPIAARSGKRLVFHRDICQHAFFVVRIADADIPHPPAVCIKPPDFAHIDQRGRHSVCFKQRNNLVRDIALRDAVQGQTHTLFGKTDFTVVKRDFAEADPFQGFLHAILRRRFRIGTGGKIIGIQFPQRLNRRIERAFRQRVNIAARLNSSKKSAGGEVR

SEQ ID NO: 2301 - DNA, 2655 bp, Neisseria gonorrhoeae
atgacaagacatttgagagacattgaaaaaattatgaaaacctccgaactgcgccaaaaattcctaaaattttttgaaaccaaaggccacaccgtcgtccgctcttccagcctcgtgccgcacgacgacccgaccctgctgtttaccaacgcaggcatgaaccagtttaaagacgtatttttaggtttcgacaaacgcccgtacagccgcgccaccaccgcgcaaaaatgtgtacgcgcaggcggcaagcacaacgacttggaaaacgtcggctacaccgcccgccaccacaccttctttgaaatgatgggcaacttctccttcggcgattacttcaaacgcgacgcgatccacttcgcttgggagtttctcacttcccccgaatggctcaacatccccaaagacaaactcttggcgaccgtttacgcagaagacgacgaagcctacaacatctggttgaacgaaatcggtatgccgtctgaacgcatcgtccgcatcggcgacaacaaaggcgcgaaatacgcgtccgacaacttctggcaaatgggcgacaccggcccttgcggcccctgctccgaaattttctacgaccacggcaaagaaatctggggcggcattcccggcagccccgaagaagacggcgaccgctggattgaaatttggaactgcgtattcatgcagttcaaccgcgacgaacaaggcaatatgaatccgctgcccaagccgtccgtcgataccggtatgggcttggaacgtatggccgccgtgatgcagcacgtccacagcaactacgaaatcgacctgttccaagacctgctcaaagccgttgcccgcgaaaccggcgcgccgttcagtatggaagaacccagcctgaaagttatcgccgaccacatccgctcctgctcattcctgattgcagacggcgtattgccttccaacgaaggacgcggctacgtattgcgccgcatcatccgccgcgccgtgcgccacggttacaaactgggtcaaagcaaaccgttcttccacaaactcgttgccgatttggttcaagagatgggcggcgcgtatcctgaattgaaagaaaaacaggcgcaaatcgaagaagctttgaaaaacgaagaaagccgttttgcccaaactctggaaaccggtatggctttgttggaaaacgcgctggccaaaggcggcaaaacactcggcggcgaaattatcttcaaactctacgatacctacggcttcccatacgacctgactgccgacatctgccgcgaacgcaatatcgaaccggacgaagcaggcttcgagcgcgaaatggaagcccaacgcgcacgcgcacgcgccgcccaaagcttcaaagccaacgcccaactgccttacgacggtcaagacaccgagtttaaaggttatagcgaacgccaaaccgaatccaaagtcctcgccctctacaaagacggcgagcaagtcgtcgaattgaacgaaggcgacagcggtgccgtcgttatcgactttaccccgttctatgcagaatccggcggccaagtcggcgacgtcggctatatcttcgcaggcgaaaaccgctttgaagtacgcgatacccaaaaaatcaaagcggccgtattcggccaattcggcgtacaaacttcaggccgtctgaaagtcggcgacagcattaccgccaaagtggatgacgaaatccgcaatgccaatatgcgcaaccacagcgcgacccacctgatgcacaaagccctgcgcgacgtattgggcggacacgtcgaacaaaaaggctctttggttaccgccgaatccacccgtttcgacatttcccatccccaagcggtaactgccgaagaaatcgccgaagtagaacgccgcgtcaacgaagccatcttggccaacgttgccgtcaacgcagccattatgagcatggaagacgcgcaaaaaaccgacgccatgatgctcttcggcgaaaaatacggcgacgaagtacgcgtactgcaaatgggcggtttctctaccgaattgtgcggcggcacacacgtttcacgcaccggcgacatcggcctcttcaaaatcatcagcgaaggcggtattgccgcaggcgtacgccgtatcgaagccatcaccggcctgaacgcactcaaatgggcgcaagagcaagagcgtttggtaaaagacatcattgccgaaaccaaagcccaaaccgaaaaagacgtactggcgaaaatccaagcaggcgcggcacacgccaaagcattggaaaaagaattggcacgcgccaaagccgaactcgccgtccacgcaggcgccaaactcttggacgacgcaaaagacctgggcgcggccaaactcgttgccgcacaaatcgaagccgacgcagccgccctgcgcgaaaccgtaaccgacctgaccggaaaatccgacaacgccgtgattcttttagcggcagtaaacgagggtaaagtctccctgtgcgccggcgtatccaaagccctgaccggaaaagtcaaagcaggagatctggttaaatttgcagccgaacaagtcggcggcaaaggcggcggccgtcccgacttggcgcaagccggcggtacggatgccgacaaattgcccgaaatgctggcaagcgcggaaggttggctttgtcagaaattaagt

SEQ ID NO: 2302 - protein, 885 aa, Neisseria gonorrhoeae
MTRHLRDIEKIMKTSELRQKFLKFFETKGHTVVRSSSLVPHDDPTLLFTNAGMNQFKDVFLGFDKRPYSRATTAQKCVRAGGKHNDLENVGYTARHHTFFEMMGNFSFGDYFKRDAIHFAWEFLTSPEWLNIPKDKLLATVYAEDDEAYNIWLNEIGMPSERIVRIGDNKGAKYASDNFWQMGDTGPCGPCSEIFYDHGKEIWGGIPGSPEEDGDRWIEIWNCVFMQFNRDEQGNMNPLPKPSVDTGMGLERMAAVMQHVHSNYEIDLFQDLLKAVARETGAPFSMEEPSLKVIADHIRSCSFLIADGVLPSNEGRGYVLRRIIRRAVRHGYKLGQSKPFFHKLVADLVQEMGGAYPELKEKQAQIEEALKNEESRFAQTLETGMALLENALAKGGKTLGGEIIFKLYDTYGFPYDLTADICRERNIEPDEAGFEREMEAQRARARAAQSFKANAQLPYDGQDTEFKGYSERQTESKVLALYKDGEQVVELNEGDSGAVVIDFTPFYAESGGQVGDVGYIFAGENRFEVRDTQKIKAAVFGQFGVQTSGRLKVGDSITAKVDDEIRNANMRNHSATHLMHKALRDVLGGHVEQKGSLVTAESTRFDISHPQAVTAEEIAEVERRVNEAILANVAVNAAIMSMEDAQKTDAMMLFGEKYGDEVRVLQMGGFSTELCGGTHVSRTGDIGLFKIISEGGIAAGVRRIEAITGLNALKWAQEQERLVKDIIAETKAQTEKDVLAKIQAGAAHAKALEKELARAKAELAVHAGAKLLDDAKDLGAAKLVAAQIEADAAALRETVTDLTGKSDNAVILLAAVNEGKVSLCAGVSKALTGKVKAGDLVKFAAEQVGGKGGGRPDLAQAGGTDADKLPEMLASAEGWLCQKLS

SEQ ID NO: 2303 - DNA, 558 bp, Neisseria gonorrhoeae
atgaaaatgccgtaccgatccggacaacaaccgatgccgcaccctgcgggcaggcttcgcactctgaaaggttcaggcggcatttttattggaaggcttttttttgcaaccgccttacacaaagcggttttttgtgtaagaactgctataatagccgcctgtcatcgtcaggggcggctaatgcctttaaaattccaaccaagggaacgttcagttatcatgtgcgactttcgcggttatgaagaaccggaaatggtcaagaaacgccctgtcgtcgtcatagcgcgaaacaggcacaacggcaaactggtaacggtcgtacccttaagcagcacagagcctgtccctttggcggactgccaccacaaaatgagtgaaaaccccttaccggacaagccgcacatccaatgtcgggcaaaatgcgatatgacggcaacagtcggattggcacgattagaccgatacaaacccaaagggcgcgaccgttgcatcccaataatcagtgaagaggattttcaggcggttaaaacagccgttgccaaggcattcaaactgtac

SEQ ID NO: 2304 - protein, 186 aa, Neisseria gonorrhoeae
MKMPYRSGQQPMPHPAGRLRTLKGSGGIFIGRLFFATALHKAVFCVRTAIIAACHRQGRLMPLKFQPRERSVIMCDFRGYEEPEMVKKRPVVVIARNRHNGKLVTVVPLSSTEPVPLADCHHKMSENPLPDKPHIQCRAKCDMTATVGLARLDRYKPKGRDRCIPIISEEDFQAVKTAVAKAFKLY

SEQ ID NO: 2305 - DNA, 753 bp, Neisseria gonorrhoeae
atgaagtacgtccggttatttttcctcggcacggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattgaaacagccggttaccaatatttcctggtttgccgccaacgcctattgcgccgcacaaggcaaacgcctgccgaccatcgacgaatgggaatttgccggacttgcttccgccacgcagaaaaacggctcaaacgaacccggctacaaccgcactattctcgattggtatgccgacggcggacggaaaggcctgcacgatgtcggcaaagaccgcccgaactactggggtgtttatgatatgcacgggctgatttgggaatggacggaagatttcaacagcagcctgctttcttccggcaatgccaacgcgcaaatgttttgcagcggcgcatctgtcggggcgagcgactcgtccaactatgccgccttcctccgctacggcatccgcaccagcctgcaatccaaatacgtcctgcacaacttgggcttccgctgcgcaagccga

SEQ ID NO: 2306 - protein, 251 aa, Neisseria gonorrhoeae
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKNGSNEPGYNRTILDWYADGGRKGLHDVGKDRPNYWGVYDMHGLIWEWTEDFNSSLLSSGNANAQMFCSGASVGASDSSNYAAFLRYGIRTSLQSKYVLHNLGFRCASR

SEQ ID NO: 2307 - DNA, 147 bp, Neisseria gonorrhoeae; identical to SEQ ID NO: 1369

SEQ ID NO: 2308 - protein, 49 aa, Neisseria gonorrhoeae; identical to SEQ ID NO: 1370

SEQ ID NO: 2309 - DNA, 1215 bp, Neisseria gonorrhoeae
ttgcgtttcgttggaaaatgccgtctgagcgtttcagacggcatttgtgctgttgcaaatgtaatttgcttacaggtttggattcacaataattttaacggcggattcgttgttgtggatcagacgctcgaagccttcggaaaccagtttgtccagcttgatgcgctgggtgatgaagggttcgaggttgattttgccttcttcgaccagtttgatggtttccgcgtggtcgttgcagtaggcaatcgtgccgcgcacatccagttctttcatcacgacgctgtggacgttgacggtggcggggtggctccagatggatacgataaccaagttggcggcgggtttgcaggcttcgaccaaagtatccaacactttgttcacgctggtacattcgaacgccacgtccacgccttcgccgttggtcagttttttcacttcttcaacaacatcgacttcggacgggtcgaggatgtagtcggcaacgccggattcgcgggctttgtctttgcgtgctttactcaactcggtaatgatgactttgatgcctttggctttcaacacggcggccaacagcaaaccgatcgggcctgcgccgccgaccaatgcgacatcgcctgctttcgcgccgctgcgtacataggcgtggtgtccgacagacagaggttcaatcaaagcagcttgatccaacgggattttgtcggaaatcggatgcacccaacggcgtttgacggcgattttttcggacaggccgccgccgcagccgcccaagccgataaagttcatgtctttggagaggtggtagttgctgccttcgccggtcggtacgtcgtcgcggatgatgtagggttcgaccacgacgtgttggccgactttaatgtcgtccacgccttcgccgacggcataaaccacgccggagaactcgtgtcccatcgttacgggcgcggactcgccggaaatcggatgcggatgaccgcagggcgggatgaaaatcgggccttccataaattcgtgcaggtcggtaccgcagatgccgcaccaggcgacattgatgccgacggtgccgggggcgacggtcggttcggggatgtcttcgatgcggatgtcgcctttgttgtaaaaacgtgctgctttcattgtaacgctccttgttttcaagtaggaatgccgtctgaatctagcaggcggcggttgaaatgggaatggcgtgaagaagcc

SEQ ID NO: 2310 - protein, 405 aa, Neisseria gonorrhoeae
LRFVGKCRLSVSDGICAVANVICLQVWIHNNFNGGFVVVDQTLEAFGNQFVQLDALGDEGFEVDFAFFDQFDGFRVVVAVGNRAAHIQFFHHDAVDVDGGGVAPDGYDNQVGGGFAGFDQSIQHFVHAGTFERHVHAFAVGQFFHFFNNIDFGRVEDVVGNAGFAGFVFACFTQLGNDDFDAFGFQHGGQQQTDRACAADQCDIACFRAAAYIGVVSDRQRFNQSSLIQRDFVGNRMHPTAFDGDFFGQAAAAAAQADKVHVFGEVVVAAFAGRYVVADDVGFDHDVLADFNVVHAFADGINHAGELVSHRYGRGLAGNRMRMTAGRDENRAFHKFVQVGTADAAPGDIDADGAGGDGRFGDVFDADVAFVVKTCCFHCNAPCFQVGMPSESSRRRLKWEWREEA

SEQ ID NO: 2311 - DNA, 1230 bp, Neisseria gonorrhoeae
ttgggtttcggatgtcgaaggaagggaattttgcaaaggtctcagtttgtagtaaaatatctaaacagattcaatcggaaacggtcaggcttcttcacgccattcccatttcaaccgccgcctgctagattcagacggcattcctacttgaaaacaaggagcgttacaatgaaagcagcacgtttttacaacaaaggcgacatccgcatcgaagacatccccgaaccgaccgtcgcccccggcaccgtcggcatcaatgtcgcctggtgcggcatctgcggtaccgacctgcacgaatttatggaaggcccgattttcatcccgccctgcggtcatccgcatccgatttccggcgagtccgcgcccgtaacgatgggacacgagttctccggcgtggtttatgccgtcggcgaaggcgtggacgacattaaagtcggccaacacgtcgtggtcgaaccctacatcatccgcgacgacgtaccgaccggcgaaggcagcaactaccacctctccaaagacatgaactttatcggcttgggcggctgcggcggcggcctgtccgaaaaaatcgccgtcaaacgccgttgggtgcatccgatttccgacaaaatcccgttggatcaagctgctttgattgaacctctgtctgtcggacaccacgcctatgtacgcagcggcgcgaaagcaggcgatgtcgcattggtcggcggcgcaggcccgatcggtttgctgttggccgccgtgttgaaagccaaaggcatcaaagtcatcattaccgagttgagtaaagcacgcaaagacaaagcccgcgaatccggcgttgccgactacatcctcgacccgtccgaagtcgatgttgttgaagaagtgaaaaaactgaccaacggcgaaggcgtggacgtggcgttcgaatgtaccagcgtgaacaaagtgttggatactttggtcgaagcctgcaaacccgccgccaacttggttatcgtatccatctggagccaccccgccaccgtcaacgtccacagcgtcgtgatgaaagaactggatgtgcgcggcacgattgcctactgcaacgaccacgcggaaaccatcaaactggtcgaagaaggcaaaatcaacctcgaacccttcatcacccagcgcatcaagctggacaaactggtttccgaaggcttcgagcgtctgatccacaacaacgaatccgccgttaaaattattgtgaatccaaacctg

SEQ ID NO: 2312 - protein, 410 aa, Neisseria gonorrhoeae
LGFGCRRKGILQRSQFVVKYLNRFNRKRSGFFTPFPFQPPPARFRRHSYLKTRSVTMKAARFYNKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKAGDVALVGGAGPIGLLLAAVLKAKGIKVIITELSKARKDKARESGVADYILDPSEVDVVEEVKKLTNGEGVDVAFECTSVNKVLDTLVEACKPAANLVIVSIWSHPATVNVHSVVMKELDVRGTIAYCNDHAETIKLVEEGKINLEPFITQRIKLDKLVSEGFERLIHNNESAVKIIVNPNL

SEQ ID NO: 2313 - DNA, 447 bp, Neisseria gonorrhoeae
atgagcaccttcttccggcaaaccgcccaagccatgactgccaaacacatcggccgcttcccgctatcggagttggaccaggtgattgattggcagccgatcgaacaatacctgatccgtcaaaaaacccgttacctccgagaccgccgcggccgtcccgcccatcccctgtcgtccatgttcaaagccgtcctgcccggacaatggcacagcctctccgatcccgaactcgaacacagcctcatcacccgcatcggtttcaacctgttttgccgttttgacgaaccgggcatccccggttgcagcaccttatgccgctaccgtaaattccgctatgcgcgggcagcctatttcgggctgctcaaagtgggtgcgcaaagccacctgaaggcgatgtgtttgaacctgttgaaagccgccaacaggctaagtgcgcccgctgccgcc

SEQ ID NO: 2314 - protein, 149 aa, Neisseria gonorrhoeae; identical to SEQ ID NO: 1798

SEQ ID NO: 2315 - DNA, 138 bp, Neisseria gonorrhoeae
ttggggatttttgcaaaggtctcaagagatgtgtttaagcacgcggaaggctttctgtttgcgtcaggtcaaataatgatgccgtctgaaaaccgaatcggcttcagacggcatttatatcgtaacggtcggattggg

SEQ ID NO: 2316 - protein, 46 aa, Neisseria gonorrhoeae
LGIFAKVSRDVFKHAEGFLFASGQIMMPSENRIGFRRHLYRNGRIG

SEQ ID NO: 2317 - DNA, 1116 bp, Neisseria gonorrhoeae
atgccgctgacccgcctgttcctgaaactctacgccctgttgcgcctttttttgggcaaaaacgcccagaccgcctggattttccaccccgcctgcaccgggcacgaccccggggcaaaccatcccgattcgcccgaccgcatcctctgcatcgagcaggcattgcgccgcgccggtatttggcagcacctccaaaccgtagaggcggaagaaatcagcgatacgcgccttgcacttgtccgctcgagcaaatatctgaaccgtttggaatcttgcctacccgaagacggcaagatttgccgtttggacgacgacaccgttatcagcaaaaactccctgtccgccgcccgtttttccgccggttcggcagttcaggcagtcgatatggtcatgaaacgcaaagcgtggcacgccttttgcgccgcccgcccgccggagcatcacgcgaaaagcggcaaagccggcggattctgcctgctgaacaacgttgccgccggcgtcatgcatgccattgccgaataccgcctgaaacgcattgccgtcatcgatttcgatgtccactacggcgacggtacggcagaaatattcaaagacgatccgcgcatcctgtttttcaacctgtttgaaaccgaccttttccccttccccgaaaacaacggtatgcccgacggcggcaatatggtgcacctgcccttgccgtcgggaacgggcagccgcacattccgcgaagccgtccgcagacagtggctgccccggcttgccgcattcaaacccgaactggtgctgctgtcggcaggattcgacgcacaccgtctggacgaatcgggcaggctcaacctgcacgaggcggattttgcctggctgacacacaaaatcattcagacggcatccagctgccccggcaaaatcgtatccgtactcgaaggcggctacacccttgaacctctggcacaatctgctgccgagcatatccgcgtactggcggggctgggcaaatccgatgccgcaaccgcctatcagaaaacactgaacccaacaaaaaaaccgtttgccaaaccgaaaaccggacaggtgcgccaacctacccaatccgaccgttacgatataaatgccgtc

SEQ ID NO: 2318 - protein, 372 aa, Neisseria gonorrhoeae
MPLTRLFLKLYALLRLFLGKNAQTAWIFHPACTGHDPGANHPDSPDRILCIEQALRRAGIWQHLQTVEAEEISDTRLALVRSSKYLNRLESCLPEDGKICRLDDDTVISKNSLSAARFSAGSAVQAVDMVMKRKAWHAFCAARPPEHHAKSGKAGGFCLLNNVAAGVMHAIAEYRLKRIAVIDFDVHYGDGTAEIFKDDPRILFFNLFETDLFPFPENNGMPDGGNMVHLPLPSGTGSRTFREAVRRQWLPRLAAFKPELVLLSAGFDAHRLDESGRLNLHEADFAWLTHKIIQTASSCPGKIVSVLEGGYTLEPLAQSAAEHIRVLAGLGKSDAATAYQKTLNPTKKPFAKPKTGQVRQPTQSDRYDINAV

SEQ ID NO: 2319 - DNA, 264 bp, Neisseria gonorrhoeae
atgaatcaagctgttgcacaatttgctcctttggtgttgattatggtggtgttctacttcctgatcatgcgcccccaacaaaagaaattcaaagcgcatcaggcaatgcttgccgccttgaaagccggcgacaaagtggtcttggcggcaggtttcaagggtaaggtaaccagagtcggcgaacagttttttaccgtggatatcggacagggtacaaaaatcgaggtcgaagtggaacgcaatgcgattgccgcaaaagtcgat

SEQ ID NO: 2320 - protein, 88 aa, Neisseria gonorrhoeae
MNQAVAQFAPLVLIMVVFYFLIMRPQQKKFKAHQAMLAALKAGDKVVLAAGFKGKVTRVGEQFFTVDIGQGTKIEVEVERNAIAAKVD

SEQ ID NO: 2321 - DNA, 369 bp, Neisseria gonorrhoeae
atggtcaagccttcggttggaattcaaaacaaagtgccgcattcgggctttcccgatgcggcttgtcggcacaaatcaatcgacttttgcggcaatcgcattgcgttccacttcgacctcgatttttgtaccctgtccgatatccacggtaaaaaactgttcgccgactctggttaccttacccttgaaacctgccgccaagaccactttgtcgccggctttcaaggcggcaagcattgcctgatgcgctttgaatttcttttgttgggggcgcatgatcaggaagtagaacaccaccataatcaacaccaaaggagcaaattgtgcaacagcttgattcataatttatccgttctttctaaatatgat

SEQ ID NO: 2322 - protein, 123 aa, Neisseria gonorrhoeae
MVKPSVGIQNKVPHSGFPDAACRHKSIDFCGNRIAFHFDLDFCTLSDIHGKKLFADSGYLTLETCRQDHFVAGFQGGKHCLMRFEFLLLGAHDQEVEHHHNQHQRSKLCNSLIHNLSVLSKYD

SEQ ID NO: 2323 - DNA, 957 bp, Neisseria gonorrhoeae
atgattttgacaccgccggacacgccctttttcctccgcaacggcaatgccgacacgattgccgccaaattcctgcaacaccccgcacccgcataccgccgcgagatgcttcccgacagcacgggtaaaaccaaaaccgcctacgacttttcagcaggcggcatttcgcccgatgcgccgctggtcgtgctgtttcacggtttggaaggaagcagccgcagccattacgcggtcgaactgatgctcgcggtacgcaatcggggttggcacggcgcagtcgtccatttccgcagctgcggcggcgtagcgaacaccgccccggtgttctaccacttgggtgataccgccgaaatcgcctttgctttggacacgctcaccgcgcgttaccgtgaaatatacgccgtcggcgtatcgctgggcggcaacgcgccggcaaaatatttgggcgaacagggcaaaaaggcattgccgcacgcctcggccgccgtatccgcccccgttgatgcagaggcggcaggcagccgcttcgacagcggcatcacgcggctgctctacacgcgctacttcctccgcacactgatacccaaagcacgttcgctccaaggttttcagacggcatttgccgcagggtgcaaaacactgggcgagtttgacgaccgtttcaccgcaccgctgcacggctttgccgaccggcacgactactaccgccaaacttcctgcaaaccgctgctcaaacacgttgccaaaccgctgctcctgctcaatgccgccaacgaccccttcctgccgcccgaagccctgccccgtgcagacgaagcgtccgaagccgttaccctgttccaacctgcacacggcgggcacgccggctttgtcagcagcaccggcggcaggctgcacctgcaatggctgccgcagaccgtcctgtcctattttgacagcttccgcacaaacaggcgt

SEQ ID NO: 2324 - protein, 319 aa, Neisseria gonorrhoeae
MILTPPDTPFFLRNGNADTIAAKFLQHPAPAYRREMLPDSTGKTKTAYDFSAGGISPDAPLVVLFHGLEGSSRSHYAVELMLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 2325 - DNA, 372 bp, Neisseria gonorrhoeae; identical to SEQ ID NO: 117

SEQ ID NO: 2326 - protein, 124 aa, Neisseria gonorrhoeae; identical to SEQ ID NO: 118

SEQ ID NO: 2327 - DNA, 597 bp, Neisseria gonorrhoeae
ttgtggaaactgtatgccgattattttgccgcccgtcccgatgcggaaacgccgccggagaatagcgtgaaggaaaccctgaaacgggtcggcttcggcaaagtctcgtttgacgaccgtgaaatccgttttgccgaaaagggtatgggtttgtccttgaacggcatcgcgcaaggctatatcacggacaaggttgttgcgctgcttaaagcaaacggagtgcctgccgcgctggtcgatatgggcgaaatcagggggtttgatacaaacggcaggcggatgtggaatgtcggcatccgcaatccggacgacgaagaaggcgtgttggcaaatatcacgatgaaagacaaggcgtttgccacttcgggcggctatgggacggtgatggacaaagcgggcaggcttacccatttgttcgatccgcgaaccggcgtgagtacgccgcgttataaaagcatgagcgtaatggcggatgatgcggcggttgccgatgccttgtcgacggcgttttccgtgatggatttgccgctgatacggtcggttgccgaaagcaggcggcttaaagttaggctggccatgccggacaatatagtggat

SEQ ID NO: 2328 - protein, 199 aa, Neisseria gonorrhoeae
LWKLYADYFAARPDAETPPENSVKETLKRVGFGKVSFDDREIRFAEKGMGLSLNGIAQGYITDKVVALLKANGVPAALVDMGEIRGFDTNGRRMWNVGIRNPDDEEGVLANITMKDKAFATSGGYGTVMDKAGRLTHLFDPRTGVSTPRYKSMSVMADDAAVADALSTAFSVMDLPLIRSVAESRRLKVRLAMPDNIVD

SEQ ID NO: 2329 - DNA, 360 bp, Neisseria gonorrhoeae
  MISC_FEATURE (1)..(360): n = g, a, t, or c
ttggaaccccaccctttcggtggtgtcggaatcnggctatttcagaagaggcaaaacccctccctgccaggcaagaccgaaaggcagcatcctgaatatgccgccctgcgtgtcggaacatggtcaagccttcggttggaattcaaaacaaagtgccgcattcgggctttcccgatgcggcttgtcggcacaaatcaatcgacttttgcggcaatcgcattgcgttccacttcgacctcgatttttgtaccctgtccgatatccacggtaaaaaactgttcgccgactctggttaccttacccttgaaacctgccgccaagaccactttgtcgccggctttcaaggcggcaagcattgcc

SEQ ID NO: 2330 - protein, 120 aa, Neisseria gonorrhoeae
  MISC_FEATURE (1)..(120): Xaa = any amino acid
LEPHPFGGVGIXLFQKRQNPSLPGKTERQHPEYAALRVGTWSSLRLEFKTKCRIRAFPMRLVGTNQSTFAAIALRSTSTSIFVPCPISTVKNCSPTLVTLPLKPAAKTTLSPAFKAASIA

SEQ ID NO: 2331 - DNA, 1854 bp, Neisseria gonorrhoeae
atgatgaaccgttatcctttatggaaatatctgctgattgtgttcacgattgcggttgccgcagtgtattcgctgcccaacctattcggcgaaacgcccgccgtgcaggtatcgaccaaccgacaagccatcatcatcaacgaacagactcaatccaaagtggatgctgcgctgaaaaacgcgggcattcagaccgacgggatgtttgttgtggataattcactgaaagtgcgtttcaaagacacagaaacgcagcttaaagcgcgcgacgttatcgaaaacactttgggcgaagggtatattaccgcgctcaacctgttggcggacagccccgaatggatggcgaaaatcaaagccaatccgatgtttttgggtttggacctgcgcggcggcgtgcatttcaccatgcaggtcgatatgaaagccgcgatgcagaaaacgtttgagcgttattcgggcgacatccgccgcgaactgcgccgtgaaaaaatccgcagcggcacggtgcgtcaggctgaaaacagcctgaccgtccctttgcaggatgccggcgatgtgcaaaaggcactgcctcagttactcaagctgtttcctgaggcaacgttaaattcagaaggcagcaatatcgtcttgacgctttcggaagaggcggtgaataaagtacgatcagatgcggtgaagcaaaacatcactacactgcataaccgtgtaaacgaattgggtgtggcagagccgattatccaacagtcaggtttggaccgcattgtcgtacagcttcccggcgtgcaagatactgccaaggcaaaagacatcatcggccgtaccgcgactttggaagtccgcatggtggaggacgatcctgccaagttgcgcgaggcattggaaggcaacgtgccgagcggttatgagctgctttcaagcggcggggagcatcccgaaactctgctgatcagcaaacaggtcgagctgaccggcgacaacatcaacgatgcgcaaccgagtttcgaccaaatgggcgcacctgccgtcagtctgagcttggacagcgcgggcggcagcattttcggcgaactgactgccgcaaatgtcggcaaacgcatggcgatggttttgatcgaccaaggaaaatccgaggttgtaaccgcaccggttatccgtactgccattaccggcggacgcgtggaaatttccggaagcatgacgacagccgaagccaacgatacgtctttgctgttgcgtgccggttctcttgccgcaccgatgcagattgtcgaagaacgtaccatcggtccgtctttgggtaaggagaacatcgaaaaaggcttccattcgactttatggggttttgccatcgttgctgcattcatggtggtttattaccgcctgatgggtttcttttctactattgcattgagtgccaacatactgttcctaatcggtattttgtctgccatgcaggcaacgttgacgttaccgggtatggccgcgctggcgttgactttgggtatggcaatcgactccaacgtcttgattaacgaacgtatccgagaggaattgcgtgccggcgtgccgccgcagcaggcaatcaatctcggtttccaacacgcatgggcgaccattgttgattcgaacctgacttcgctgattgccggtatcgcgcttttggtattcggttccggaccggtaagaggttttgccgtcgtacactgcttgggtattctgacttcgatgtattcgtccgtcgtcgtattccgtgcgttggtcaatctgtggtacggccgccgccgcaaattgcagaatatttccatcggtgcggtatggaaacctgaagccgaaactgcggcaggtaaggag

SEQ ID NO: 2332 - protein, 618 aa, Neisseria gonorrhoeae
MMNRYPLWKYLLIVFTIAVAAVYSLPNLFGETPAVQVSTNRQAIIINEQTQSKVDAALKNAGIQTDGMFVVDNSLKVRFKDTETQLKARDVIENTLGEGYITALNLLADSPEWMAKIKANPMFLGLDLRGGVHFTMQVDMKAAMQKTFERYSGDIRRELRREKIRSGTVRQAENSLTVPLQDAGDVQKALPQLLKLFPEATLNSEGSNIVLTLSEEAVNKVRSDAVKQNITTLHNRVNELGVAEPIIQQSGLDRIVVQLPGVQDTAKAKDIIGRTATLEVRMVEDDPAKLREALEGNVPSGYELLSSGGEHPETLLISKQVELTGDNINDAQPSFDQMGAPAVSLSLDSAGGSIFGELTAANVGKRMAMVLIDQGKSEVVTAPVIRTAITGGRVEISGSMTTAEANDTSLLLRAGSLAAPMQIVEERTIGPSLGKENIEKGFHSTLWGFAIVAAFMVVYYRLMGFFSTIALSANILFLIGILSAMQATLTLPGMAALALTLGMAIDSNVLINERIREELRAGVPPQQAINLGFQHAWATIVDSNLTSLIAGIALLVFGSGPVRGFAVVHCLGILTSMYSSVVVFRALVNLWYGRRRKLQNISIGAVWKPEAETAAGKE

SEQ ID NO: 2333 - DNA, 933 bp, Neisseria gonorrhoeae
atggaactctttaaaatcaaacgcgatattccgtttatgagctacggcaaactgacaaccttcatttcgttggttacctttattgccgccgtattctttttggttgccagaggcctgaatttctctgtcgaatttaccggcggtacggtaatggaagtccaatatcagcagggtgcggatgtcaataagatgcgcgaacgcctcgatacgctgaaaatgggtgatgtacaggttcaggcattgggtacgaacaaacacatcatgatccgcctgccgaacaaagaaggtgttacttccgcacagttgtccaatcaggttatggatttgctgaaaaaagacagtcccgacgttactttgcgccaagtcgaatttatcggcccgcaagtcggtgaggaattggtaaataatggattgatggctttaggttttgtcgttatcggcatcattatttacctgtcgatgcgtttcgaatggcgttttgccgtatctgccattatcgccaatatgcacgacatcgtgattattctcggctgctttgccttcttccaatgggaattttcgctgaccgtcttggcaggtatccttgccgtattgggctattctgtgaacgaatccgtcgtcgtcttcgaccgtatccgtgaaaatttccgcaagccggcgatgcgcggacataccgtgccggaagtcattgacaacgcgattaccgcaacgatgagccgcaccatcattacccacggttcgaccgaggcgatggttgtttctatgctggtgttcggcggtgcagccttgcacggcttttctatggcactgaccatcggtatcgtgttcggcatctactcttccgtattggttgccagcccgctcttgctgatgttcggtttgagccgcgacaatatcgccaaggaagcgaaacagaaggaagaaattgtggtc

SEQ ID NO: 2334 - protein, 311 aa, Neisseria gonorrhoeae
MELFKIKRDIPFMSYGKLTTFISLVTFIAAVFFLVARGLNFSVEFTGGTVMEVQYQQGADVNKMRERLDTLKMGDVQVQALGTNKHIMIRLPNKEGVTSAQLSNQVMDLLKKDSPDVTLRQVEFIGPQVGEELVNNGLMALGFVVIGIIIYLSMRFEWRFAVSAIIANMHDIVIILGCFAFFQWEFSLTVLAGILAVLGYSVNESVVVFDRIRENFRKPAMRGHTVPEVIDNAITATMSRTIITHGSTEAMVVSMLVFGGAALHGFSMALTIGIVFGIYSSVLVASPLLLMFGLSRDNIAKEAKQKEEIVV

SEQ ID NO: 2335 - DNA, 342 bp, Neisseria gonorrhoeae
ttgccgttgtcgaggcttggcaaacttgtccgaatcccatttggggttctttttatttttcggagtttttccattatggcactgaccgtagaacaaaaagcacaaatcgttaaagatttccaacgtaaagaaggcgacaccggctcttctgaagtacaagttgccctgttgactttccgcatcaacgatctgaccccccacttcaaagccaaccccaaagaccaccacagccgtcgcggcctgttgaaaatggtcagccaacgccgccgcctgttggcctatttgcgccgtacccagcccgatacgtatcgcgcgttgattacccgcttgggtctgcgtaaa

SEQ ID NO: 2336 - protein, 114 aa, Neisseria gonorrhoeae
LPLSRLGKLVRIPFGVLFIFRSFSIMALTVEQKAQIVKDFQRKEGDTGSSEVQVALLTFRINDLTPHFKANPKDHHSRRGLLKMVSQRRRLLAYLRRTQPDTYRALITRLGLRK

SEQ ID NO: 2337 - DNA, 303 bp, Neisseria gonorrhoeae; identical to SEQ ID NO: 119

SEQ ID NO: 2338 - protein, 101 aa, Neisseria gonorrhoeae; identical to SEQ ID NO: 120

SEQ ID NO: 2339 - DNA, 378 bp, Neisseria gonorrhoeae
atgggcaggcatttcgggcgcagacgttttctgacggctgccgccgttgctgtggccggtgcggcggtttcttttttgccgaatccttttgccgccggcggcgaaaaacgcaacatggataaaaaacgcgatgaaaatgtgtttttctggaaaggtgtcgcgctgggttccggcgcggagctgcgcctgttcggcgtggacgacagacaggcggcggatttggtcaataaggttttggcggaagtggcgcgtttggaaaaaatgttcagcctttaccgtgaagacagcctgatcagccgtctgaaccgcgacggttatctgacttcgcctccggcggattttttggaactgttgagcctggccgcgatattcacgcgc

SEQ ID NO: 2340 - protein, 126 aa, Neisseria gonorrhoeae
MGRHFGRRRFLTAAAVAVAGAAVSFLPNPFAAGGEKRNMDKKRDENVFFWKGVALGSGAELRLFGVDDRQAADLVNKVLAEVARLEKMFSLYREDSLISRLNRDGYLTSPPADFLELLSLAAIFTR

SEQ ID NO: 2341 - DNA, 432 bp, Neisseria gonorrhoeae
atgggtttgagcttgtcggaaagcaacagaaaagaaaacaccgcccatttttctgggcggtgtcggaaagcgcaattatttacgcagacccaagcgggtaatcaacgcgcgatacgtatcgggctgggtacggcgcaaataggccaacaggcggcggcgttggctgaccattttcaacaggccgcgacggctgtggtggtctttggggttggctttgaagtggggggtcagatcgttgatgcggaaagtcaacagggcaacttgtacttcagaagagccggtgtcgccttctttacgttggaaatctttaacgatttgtgctttttgttctacggtcagtgccataatggaaaaactccgaaaaataaaaagaaccccaaatgggattcggacaagtttgccaagcctcgacaacggcaaactccctattcc

SEQ ID NO: 2342 - protein, 144 aa, Neisseria gonorrhoeae
MGLSLSESNRKENTAHFSGRCRKAQLFTQTQAGNQRAIRIGLGTAQIGQQAAALADHFQQAATAVVVFGVGFEVGGQIVDAESQQGNLYFRRAGVAFFTLEIFNDLCFLFYGQCHNGKTPKNKKNPKWDSDKFAKPRQRQTPYS

SEQ ID NO: 2343 - DNA, 204 bp, Neisseria gonorrhoeae
atgctgcccgtgcgcttcacaagagtttcagacggcatcagacgttgcgactcccgccagcaatcaaacagctttttatcacccattcgaaaatccgttttgccggtactcgtctttttattggagtattgccattatgaccgcaaccacagcgtcttcagccaaaccttatctgcaaatccaaggtttggtgaaaaagtttgg

SEQ ID NO: 2344 - protein, 68 aa, Neisseria gonorrhoeae
MLPVRFTRVSDGIRRCDSRQQSNSFLSPIRKSVLPVLVFLLEYCHYDRNHSVFSQTLSANPRFGEKVW

SEQ ID NO: 2345 - DNA, 1290 bp, Neisseria gonorrhoeae
atgcggggttctttagaacccctttttatttcatgctgcccgtgcgcttcacaagagtttcagacggcatcagacgttgcgactcccgccagcaatcaaacagctttttatcacccattcgaaaatccgttttgccggtactcgtctttttattggagtattgccattatgaccgcaaccacagcgtcttcagccaaaccttatctgcaaatccaaggtttggtgaaaaagtttggtgacaattacgctgtcgataacatcgacttggacatttatcaaaacgaaatcttcgcccttttgggcagttccggcagcggaaaatctacgctgctgcgtatgctggcgggtatggaaagtcccaatcagggaaaaatcatccttgatggtcaagatattaccaaacttgcaccctatgaccgccccatcaatatgatgttccaaagttacgcgctttttccgcatatgacggtggagcaaaacattgccttcggtctgaaacaggacaaaatgcctaaaggcgaaatcgatgcgcgcgtcgaagaaatgctgcgtctggttcagatgaccaaatttgccaaacgcaaaccgcaccaattgtccggtggtcagcagcaacgtatcgccttggcgcgcagtttggcaaaacgtccgaaaatcctgttgcttgacgaacctttgggggcgttggataagaaattgcgccagcaaacccagctcgagttggtcaatacgctggaacaagtcggcgtaacctgcattatggttacgcacgaccaagaagaggcgatgacgatggcgacccgcatcgccattatgtccgacggtcagttgcagcaggtcggcacgcccagcgacgtgtacgactatcccaacagccgcttcactgccgagtttatcggcgaaaccaacatctttgacggtgtggtgattgaaaatcatgccgactatgccgttatcgaatgcgaaggtttggaaaaccacgtccgtatcgaccatggtttgggtggcccgagcgagcaggatctttgggttagtattcgaccagaggatattgatttatataaagaaaaacccgaatatttgggcgactacaactgggcgaaaggcacggtaaaagaaattgcctatttgggcagcttcgccatataccatatcaaactcgccaacgggcgcgtcgtcaaaagccaagttcctgcaccttactggtatgtgcgtaacatcacgccgccgacttgggatgaaaccgtctatatcagctggccggaaaaccaaccgactccgttgttccgt

SEQ ID NO: 2346 - protein, 430 aa, Neisseria gonorrhoeae
MRGSLEPLFISCCPCASQEFQTASDVATPASNQTAFYHPFENPFCRYSSFYWSIAIMTATTASSAKPYLQIQGLVKKFGDNYAVDNIDLDIYQNEIFALLGSSGSGKSTLLRMLAGMESPNQGKIILDGQDITKLAPYDRPINMMFQSYALFPHMTVEQNIAFGLKQDKMPKGEIDARVEEMLRLVQMTKFAKRKPHQLSGGQQQRIALARSLAKRPKILLLDEPLGALDKKLRQQTQLELVNTLEQVGVTCIMVTHDQEEAMTMATRIAIMSDGQLQQVGTPSDVYDYPNSRFTAEFIGETNIFDGVVIENHADYAVIECEGLENHVRIDHGLGGPSEQDLWVSIRPEDIDLYKEKPEYLGDYNWAKGTVKEIAYLGSFAIYHIKLANGRVVKSQVPAPYWYVRNITPPTWDETVYISWPENQPTPLFR

SEQ ID NO: 2347 - DNA, 141 bp, Neisseria gonorrhoeae
atgaaccttaataaactgaaaaacaaactgttccgccgtccggggcagcgtgcggtgattgccgtaccgtatatgccgccgacttgggatgaaaccgtctatatcagctggccggaaaaccaaccgactccgttgttccgt

SEQ ID NO: 2348 - protein, 47 aa, Neisseria gonorrhoeae
MNLNKLKNKLFRRPGQRAVIAVPYMPPTWDETVYISWPENQPTPLFR

SEQ ID NO: 2349 - DNA, 141 bp, Neisseria gonorrhoeae; identical to SEQ ID NO: 2347

SEQ ID NO: 2350 - protein, 47 aa, Neisseria gonorrhoeae; identical to SEQ ID NO: 2348

SEQ ID NO: 2351 - DNA, 963 bp, Neisseria gonorrhoeae
atgaaccttaataaactgaaaaacaaactgttccgccgtccggggcagcgtgcggtgattgccgtaccgtatatttggcttttggtgctgtttctgattccgttcgccatcgtgctgaaaatcagctttgccgaacaagaaatcgccattccaccgtttactcctttaacgacgatagatgaggatttgggtcgcctgaacatcgccgtcagctatcaaaactatgccgatattttccaaaatttttggcatacccttaaccccttcggcgacagtgaaaacagtaatatctatctgatgacttattggtcttcaattaagactgcgctgacgacgacggtgatttgcctgttggtcggttacccgaccgcctatgcgatttcccgtgccaatccttccgtccgcaatggtttgctgcttgccatcatgttacctttttggacatcgttcctgctgcgtgtctatgcgtggatgggtttgctcgggcataacggcatcataaacaacttattgattaagatgggtattatcagagaaccattagatttgttctataatgcgttttcgttaaatttggtaatggtttatgcctatctgccgtttatgattctgccgctttacacgcagctggtgaaactggacagccgcctgcttgaagcggcttccgacttgggcgcgggaccggtcaaatcgttcttgacgattaccctgcctttgtcgaaaaccggcattattgcaggttcgatgctggttttcgtccccgctgtcggtgagttcgtcattcccgagctggtcggcggttcggaaaacctgatgatcggtaaagtattgtggcaggcattctttgatcaaaacaactggccgttggcttctgccgtcgccgtcgtgatggtcgcgctactggttgtaccgattgccctgttccagcactatgaaaaccgcgaattggaagaaggagccaaa

SEQ ID NO: 2352 - protein, 321 aa, Neisseria gonorrhoeae
MNLNKLKNKLFRRPGQRAVIAVPYIWLLVLFLIPFAIVLKISFAEQEIAIPPFTPLTTIDEDLGRLNIAVSYQNYADIFQNFWHTLNPFGDSENSNIYLMTYWSSIKTALTTTVICLLVGYPTAYAISRANPSVRNGLLLAIMLPFWTSFLLRVYAWMGLLGHNGIINNLLIKMGIIREPLDLFYNAFSLNLVMVYAYLPFMILPLYTQLVKLDSRLLEAASDLGAGPVKSFLTITLPLSKTGIIAGSMLVFVPAVGEFVIPELVGGSENLMIGKVLWQAFFDQNNWPLASAVAVVMVALLVVPIALFQHYENRELEEGAK

SEQ ID NO: 2353 - DNA, 885 bp, Neisseria gonorrhoeae
atgcagaaatccaaattatcttggttcttgaaactgatgttggcactatcgctggcgtttctgtatatcccgctggttgttttggtcatctattcgttcaacgaatccaaacttgttaccgtttggggcggcttttcgaccaagtggtacggcgcattgctggaaaacgacaccattttggaagccgcttggctgtcgctgcggattgccgttgtgtcttcgcttgccgccgtcgttttgggcacgctggcgggctatgcgatggcgcgtatcaaacgctttcgcggcagcacgctgtttgccggtatgatttccgcgcccatggtcatgcccgacgtgattaccggtctgtctatgctgctgctgattattcaggtgcagatatttttgcagggcagcgaatggttgcaacatctctacttcgatcgcggctttttcaccatcttcctcggacatacgacgctgtgcatggcatacattaccgttgtcatccgttcgcggctggtcgagcttgaccagtcgctcgaagaagccgcaatggacttgggcgcgcgtccgctgaaaatcttttttgtcatcactttgcctttgattgcccctgccattgcttcaggcttcctactcggcattaccttgtctttggatgatttggtaattacctcattcctctccggccccggttcatccacattgccgcaggttattttctccaagatcaagttgggtctcgatcctcagatgaatgtcttggcaaccatcctgatcggcatcatcggaacattggtcatcatcgtcaattattggatgatgaggcaggcaaccaagcgcaaccgagaagcggcagaagcctaccgccaagaaaaattggctgccgagaaagcaaat

SEQ ID NO: 2354 - protein, 295 aa, Neisseria gonorrhoeae
MQKSKLSWFLKLMLALSLAFLYIPLVVLVIYSFNESKLVTVWGGFSTKWYGALLENDTILEAAWLSLRIAVVSSLAAVVLGTLAGYAMARIKRFRGSTLFAGMISAPMVMPDVITGLSMLLLIIQVQIFLQGSEWLQHLYFDRGFFTIFLGHTTLCMAYITVVIRSRLVELDQSLEEAAMDLGARPLKIFFVITLPLIAPAIASGFLLGITLSLDDLVITSFLSGPGSSTLPQVIFSKIKLGLDPQMNVLATILIGIIGTLVIIVNYWMMRQATKRNREAAEAYRQEKLAAEKAN

SEQ ID NO: 2355 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgggggccccgccgggccgggcggaagctatttcggcggacggcgtaaaggcagacgcggtcgcggcgcggcaggaaaagcggttgtcttcggcattccgaaacgcaacgggcgggcctataccgttgccgcggacaatgccgagcctgaaacgttgctccctgccgtcaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgatttaacttcggcacaccgtcccggcagctaaaaatcctgcgggattggtgtggaatt

SEQ ID NO: 2356 - protein, 217 aa, Neisseria gonorrhoeae
MKITHCKLKKEVQKEPLRSFVPEVTARSAADILGIHPDSAALFYRKIRTVTNHRLALAADEVFGGPAGPGGSYFGGRRKGRRGRGAAGKAVVFGIPKRNGRAYTVAADNAEPETLLPAVKKKIMPDGIVYADSPGSRGKLDAGGFTRCRINRSKEFADRRNHINGIGNFWNQAKRALRKYNGIDRKPFPPLLRECEFRFNFGTPSRQLKILRDWCGI

SEQ ID NO: 2357 - DNA, 771 bp, Neisseria gonorrhoeae
atgcgccacgtcctcgacaacggtacggacaaatcagaccgcaccggtacgggtacgcgctccgtattcggttatcagatgcgttttgacttgggcaaaggttttccgctgctgacgaccaaaaagctgcatttgcgctcgataatccacgagctgctttggttcctcaaaggcgataccaatatcaaatacctgaaggataacaatgtttccatttgggacgagtgggcggacgaaaacggcgacttgggcccggtttacggctaccaatggcgcagctggcccgcgcccgacggcaggcatatcgaccaaatcgccaatgtggtggaacaaattaagaaaaaccccgactcgcgccgcctgattgtgtcggcgtggaatccggctttggtcgatgagatggccttgccgccctgccacgcgctgtttcagttttacgttgccgacggcaaactgtcctgccagctttaccagcgtagtgcagatattttccttggtgtgccgtttaatattgccagctacgcgctgttgacgatgatgatggcgcaagtgtgcgggctggaggcgggcgagtttgtccatacgtttggcgacgcgcatttgtaccgtaaccatttcgaacaggccgcattgcagttggaacgcgaaccgcgcgccttgcctgtgatgaaaatcaatcctgaagtcaaggatttgtttgccttcaagtttgaagatttcgagttggaaggctacgatccgcatccgcacatcaaggcggtagtgtcggtt

SEQ ID NO: 2358 - protein, 257 aa, Neisseria gonorrhoeae
MRHVLDNGTDKSDRTGTGTRSVFGYQMRFDLGKGFPLLTTKKLHLRSIIHELLWFLKGDTNIKYLKDNNVSIWDEWADENGDLGPVYGYQWRSWPAPDGRHIDQIANVVEQIKKNPDSRRLIVSAWNPALVDEMALPPCHALFQFYVADGKLSCQLYQRSADIFLGVPFNIASYALLTMMMAQVCGLEAGEFVHTFGDAHLYRNHFEQAALQLEREPRALPVMKINPEVKDLFAFKFEDFELEGYDPHPHIKAVVSV

SEQ ID NO: 2359 - DNA, 1398 bp, Neisseria gonorrhoeae
atgactgggtcagcctgttttttttcaaccgattttctgtttggacgatatggcccgacagtctgtatcattccgtccgaaaatatacccgataaagcaaacacaatgattcgccctgattttcaagaatatctgccttcttattattttagttcggttaatccgcatactgtttatccgaaactccaatgccgtctgaaagccgaaacctgcattatcggcggcggtttgagcggtttgtgtaccgcattgccgctggcggaacacggacatgaagccgtcgttttggaagccgcacgtatcggcttcggcgcgtccggcaggagtggcgggcaggttatcagcgactacgcctgcggtatgggggaaattgaaaaacaggtcggcttggagcaggcgcaatggttttggcaacagtctttgcaggcggtcgaactggtggacgaacgcgtccgcaaacatgccatcgattgcgattggcagcgcggttatgccacggttgccgtccgtccgcagcattgggaagagttgcagcagtggcatgaacacgcccaacggcattacggtgcgagtcattatcaactttgggataaagccgagttgaaacagcagcttgacagcgatatgtaccaaggcgcacagttcgatcccttgtccgggcatcttcatccgctcaattacacgttgggtgttgccagcgccgctgccgaagccggcgcgcagattttcgagcaatccccgatgacgcgcatcgaaccgtatcaaaacggttggctggtttacacgcccgaaggcagcgtcgagtgtaaaaatgtggtctatgccgtcaatacttatgtcggtttgaacccgatattccggcctttggaacgcaaggcgattgccgtcagcacctttattattgccaccgaacccttgggcgcgcgcacaaaagggcttatccgcaacaatatggcagtatgcgacaaccgccatattttggattattaccgcctcagcgcggacggcaggctgcttttcggcggtaaggataacgaatttatcgacaatcctgcgcgtatgaccgagcttgtccgccaagatatgcttaaagtttttccgcagcttgccgatgttagaatcgaatattcgtggggcggggagtgcgatattaccgccaaccttgtcccgcatttcggacgtttgacctcgaatgttttttatacgcaaggttattccgggcacgggatggcgataacgggcattgcaggcctggcggttgccgaagcaattttaggggacgaatgccgtctgaaaccgtttgaacagttgtgccagccgaatattatcctgcaaccgtttttgcgcaaactcggttctttcctcggctcgaaatattatcagtggaaagacagccgt

SEQ ID NO: 2360 - protein, 466 aa, Neisseria gonorrhoeae
MTGSACFFSTDFLFGRYGPTVCIIPSENIPDKANTMIRPDFQEYLPSYYFSSVNPHTVYPKLQCRLKAETCIIGGGLSGLCTALPLAEHGHEAVVLEAARIGFGASGRSGGQVISDYACGMGEIEKQVGLEQAQWFWQQSLQAVELVDERVRKHAIDCDWQRGYATVAVRPQHWEELQQWHEHAQRHYGASHYQLWDKAELKQQLDSDMYQGAQFDPLSGHLHPLNYTLGVASAAAEAGAQIFEQSPMTRIEPYQNGWLVYTPEGSVECKNVVYAVNTYVGLNPIFRPLERKAIAVSTFIIATEPLGARTKGLIRNNMAVCDNRHILDYYRLSADGRLLFGGKDNEFIDNPARMTELVRQDMLKVFPQLADVRIEYSWGGECDITANLVPHFGRLTSNVFYTQGYSGHGMAITGIAGLAVAEAILGDECRLKPFEQLCQPNIILQPFLRKLGSFLGSKYYQWKDSR

SEQ ID NO: 2361 - DNA, 1464 bp, Neisseria gonorrhoeae
atgcgatatttccatattcaaacaagggatttgtttcacgcacagggcggcacatcggcaaaatccccgcgccggtccggcagggcttgcgcccatcccggacaagccccgaccccgcctttccgaaagacgggcccaaccattaaggaaactttaatcaaaatgaaaaaacacatatgggcggcatctttgctgccggcatccctatcggcagaacctttaaactggtggaaaccttattccgccgtcaattcgggcgataccgcctgggtgatgactgcggctgccttggtactgttgatgacgcttcccgggctggctttattctacggcggtatggtgcggaaaaaaaacctgctctcgacgatgatgcacagcttttccatcgcgacattggtgggcatcctttgggtcgccgtcggctattctttggcgttcacgccgggaaatgcctttatcggcggtttggggcgcgtatttttaagcgggatgcagatagacgctgccgcacggatgctgaccgtgtcgcccaatgcgccgactgttcccgaaccggtatttatgttttttcagatgacgtttgccattatttcgactgccattattaccggcgcgtttgccgaacgaatgaaatattcggcaatgatgctgttttcgggcatatggtttttattggtttatgtgccgggcgcgcattgggtgtggggcggcggctttatgagcaagggcggcgtattggattatgccggcggtacggtggtgcacatcaatgccggtatcgcgggactcgtcgccgccttggttttgggcaggcgcataggctacgggcgcgaggcgatgcctccgcacaatatggcgatgacgctgattggcgcggcaatgttgtggttcggctggttcggctttaacgctggttcggcgcttgcggcagacgcggcggcggggatggcgatggcggtaacgcaggtgtcggccgtattcggcgcggcaggctggcttgcctgcgagaaaatagcgggacacaaaccttctgctttggggctggcttccggcgcagtttccgggctggtcggcatcacccctgccgccggctttaccggtccgtcgggcgcggccgccatcggtatattgactgccgccgcgtgctttgtgtccgtcaccgtcgtcaaacacaaattgcgttacgatgattctttggacgctttcggcatacacggattcggcgggctggtaggcggaatattgaccggcatctttttcgacaaccgcattttcggcggggatgcggcagtttggcagcagttgtggatacaggtaaaagacgggttcattatggcggcatacagcgggctgatgagttgggcgattttgaaggctgtggggaaaatctgcggcggtctgcgcgtcggcaaggatgtcgaacgcgaaggtttggatctgaatatccacggcgaacacgtggaa

SEQ ID NO: 2362 - protein, 488 aa, Neisseria gonorrhoeae
MRYFHIQTRDLFHAQGGTSAKSPRRSGRACAHPGQAPTPPFRKTGPTIKETLIKMKKHIWAASLLPASLSAEPLNWWKPYSAVNSGDTAWVMTAAALVLLMTLPGLALFYGGMVRKKNLLSTMMHSFSIATLVGILWVAVGYSLAFTPGNAFIGGLGRVFLSGMQIDAAARMLTVSPNAPTVPEPVFMFFQMTFAIISTAIITGAFAERMKYSAMMLFSGIWFLLVYVPGAHWVWGGGFMSKGGVLDYAGGTVVHINAGIAGLVAALVLGRRIGYGREAMPPHNMAMTLIGAAMLWFGWFGFNAGSALAADAAAGMAMAVTQVSAVFGAAGWLACEKIAGHKPSALGLASGAVSGLVGITPAAGFTGPSGAAAIGILTAAACFVSVTVVKHKLRYDDSLDAFGIHGFGGLVGGILTGIFFDNRIFGGDAAVWQQLWIQVKDGFIMAAYSGLMSWAILKAVGKICGGLRVGKDVEREGLDLNIHGEHVE

SEQ ID NO: 2363 - DNA, 168 bp, Neisseria gonorrhoeae
ttgaatatggaaatatcgcatcctatcccttgcccccgttgtccggcgggaggatttatccttaggcggcgcatatgcgggcgtatggattgtcaacaatttactgtaggaaaatatacagaggtttgggcgataagtcaaaagattgttgacaatatttttatttta

SEQ ID NO: 2364 - protein, 56 aa, Neisseria gonorrhoeae
LNMEISHPIPCPRCPAGGFILRRRICGRMDCQQFTVGKYTEVWAISQKIVDNIFIL

SEQ ID NO: 2365 - DNA, 126 bp, Neisseria gonorrhoeae
ttgcaaaaccggctcgaacgcatccctaccggcaatgaaaaccgatgcgggaacttgattcaaggttgcgccgaaccgcgcccatttttgtataaattttattttttatttccaattagaaatttt

SEQ ID NO: 2366 - protein, 42 aa, Neisseria gonorrhoeae
LQNRLERIPTGNENRCGNLIQGCAEPRPFLYKFYFLFPIRNF

SEQ ID NO: 2367 - DNA, 1377 bp, Neisseria gonorrhoeae
ttgacacccacgcgccgactgcctacaattcccccctctccgagcaaccggcaacagtcagcttcttctttcagacggcatccacccgtcttttcctttctattctatatatcattgattatgcacgtctccgaattacaaaccctgcacatttccaaactcttagaattggcggaagaacacggcatcgaaaacgccaaccgattccgcaaacaagacctcgtatttgccatcgtccgccagatgatgaaaaaaggcgagggttttacctgctccggcacgctcgaaatcctgcccgacggcttcggcttcctccgcagcgcggacacgtcctatcttgccggccccgacgacatctatgtctcgcccactcaaatccgccgcttcaacctgcatacgggcgacaccatcgaaggcagcgtgcgcgtccccaaagacaacgaacgctattttgccttggtcagactggattccatcaatggcgaccacccggaagtatgccgccataaaatcctgtttgaaaacctgaccccgctgtttccgaccgaacagttgaagctggaacgcgacttaaagtccgaagaaaacctgaccggacgcgccatcgacctgatttcgcccatcggcaaaggtcagcgcgccctcttggttgccccgcccaaaatcggtaaaaccgtgatgctgcaaaacattgcccacgccgttaccgcaaactatcctgaagtcgaactcatcgtcctcttgattgacgaacgccccgaagaagtaaccgaaatgagccgttccgtccgaggtgaagtagtctcctccacctttgacgaaccggcgcaacgccacgtccaagttgccgaaatggtgcttgaaaaagccaagcgtatggtggaacacaaaaaagacgtggtcatcctgctggattcgattacccgccttgcccgcgcctacaataccgtcgtccccgcctcgggcaaaatcctgaccggcggtgtcgatgccaacgcgctgcaccgccccaaacgtttcttcggtgcggcgcgcaacgtggaagaaggcggttcgctgaccattatcgccaccgcattggttgaaaccggcagccgtatggacgatgtgatttacgaagaattcaaaggtaccggcaatatggaattgcacctcgaccgccgtatggcggaaaaacgcctcttccccgccatcaacatcaacaaatccggcacgcgccgcgaagagctgcttgtgccgaacgaccagttgcaacgtatgtggttactgcgcaagttcctgcacccgatggacgaaatcgaagctaccgagttcttaaacggaaaaatcaaagcatctaaaaataatgatgatttctttgaactgatgcgcggaaaa

SEQ ID NO: 2368 - protein, 459 aa, Neisseria gonorrhoeae
LTPTRRLPTIPPSPSNRQQSASSFRRHPPVFSFLFYISLIMHVSELQTLHISKLLELAEEHGIENANRFRKQDLVFAIVRQMMKKGEGFTCSGTLEILPDGFGFLRSADTSYLAGPDDIYVSPTQIRRFNLHTGDTIEGSVRVPKDNERYFALVRLDSINGDHPEVCRHKILFENLTPLFPTEQLKLERDLKSEENLTGRAIDLISPIGKGQRALLVAPPKIGKTVMLQNIAHAVTANYPEVELIVLLIDERPEEVTEMSRSVRGEVVSSTFDEPAQRHVQVAEMVLEKAKRMVEHKKDVVILLDSITRLARAYNTVVPASGKILTGGVDANALHRPKRFFGAARNVEEGGSLTIIATALVETGSRMDDVIYEEFKGTGNMELHLDRRMAEKRLFPAININKSGTRREELLVPNDQLQRMWLLRKFLHPMDEIEATEFLNGKIKASKNNDDFFELMRGK

SEQ ID NO: 2369 - DNA, 90 bp, Neisseria gonorrhoeae
ttgttggcaatttcagccctttttcacagcaaaagcaggcgtgaaaacaaaattatcttgattggaatcaaaaaatctagtttaactact

SEQ ID NO: 2370 - protein, 30 aa, Neisseria gonorrhoeae
LLAISALFHSKSRRENKIILIGIKKSSLTT

SEQ ID NO: 2371 - DNA, 108 bp, Neisseria gonorrhoeae
acggtttgatgctaatattccccctttccccggacaaatacggaacacgacatgaccgacatcctcaataaaatccttgccaccaaggcacaggaagttgccgcccaa

SEQ ID NO: 2372 - protein, 31 aa, Neisseria gonorrhoeae
YSPFPRTNTEHDMTDILNKILATKAQEVAAQ

SEQ ID NO: 2373 - DNA, 108 bp, Neisseria gonorrhoeae
gtgggaatccaggatgcaggggaaaccgttttatccgataagttttcgcaccgaaaggtctggattcccgccttatatgatgcgctctacgcgggaatgacgggattt

SEQ ID NO: 2374 - protein, 36 aa, Neisseria gonorrhoeae
VGIQDAGETVLSDKFSHRKVWIPALYDALYAGMTGF

SEQ ID NO: 2375 - DNA, 2394 bp, Neisseria gonorrhoeae
ttggacacacaaatggccgacaactacgtaatctggtttgaaaacctgcgtatgacagatgttgaacgcgtgggcggtaaaaacgcctcgctgggcgaaatgatcagtcaactgaccgaaaaaggcgttcgcgtccccggtggctttgccaccacagccgatgcctaccgcgcatttctcgcacacaacggtctgaacgaacgcatttccgccgctctggcaaaattggatgtcgaagacgtttccgaactggcacgcgtcggcaaagaaatccgccaatggattttggacacgcccttccccgaacagctcgatgccgaaatcgaagcggcatggaacaaaatgattaccgatgccgacggcgcggacatttccgttgccgtacgctcttccgcaaccgccgaagacctgcccgacgcatcatttgccggccaacaggaaaccttcctgaatatcaatggcttggataacgttaaaaaagcgatgcgccacgttttcgcctccctgtacaacgaccgcgccatttcctaccgcgtccacaaaggcttcgaacacgacatcgtcgccctttccgccggcgttcaacgcatggtgcgttccgacagcggcgcatcaggtgtgatgttcaccctcgacaccgaatccggctacaaccaagtcgtctttgttacctcctcttacggtctgggcgaaaacgtcgtacaaggcgcggtcaacccggacgaattttatgtgttcaaacccacgctcaaagcaggcaaacccgccatcctgcgcaagaccatgggttcgaaacacatcaaaatgattttcaccgacaaagccgaagccggcaaatcggtaaccaacgtcgaagtccccgaagaagaccgcaaccgcttctccattaccgacgaagaaatcaccgagttggcacactacgcgctgaccatcgaaaaacactacggccgcccgatggatatcgaatggggacgcgacggcctggacggcaaactctacatcctgcaagcccgccccgaaaccgtcaaatcccaagaagaaggcagccgcaacctgcgccgctacgccatcaacggcgaaaaaaccgtcttgtgcgaaggtcgtgccatcggtcaaaaagtcggtcagggcaaggtgcgcctgattaaagatgcttccgagatggattccgtcgaagccggcgacgtactggttaccgacatgaccgatccggattgggaacccgtgatgaaacgtgcttccgccatcgtgaccaaccgcggcggacgcacctgccacgccgccatcatcgcgcgcgaactgggtattcctgccgtcgtcggctgcggcaatgcgaccgaactcttggaaaacggtcaggaagttaccgtatcctgtgccgaaggcgataccggctttatctatgccggcctgctggacgtacaaattaccgatgtcgccttggacaatatgccaaaagcacccgtcaaagtcatgatgaacgtcggcaatcccgaactcgcattcagcttcgccaatctgcccagcgaaggcatcggcttggcgcgtatggaatttatcatcaaccgccaaatcggcatccacccgaaagccttgttggaatttgacaaacaagacgacgaactgaaagcggaaattatccgccgcatcgccggttacgcatcccctgtcgacttctacgtcgataaaatcgccgaaggcgtggcaacgcttgccgcatcggtttatccgcgtaaaaccatcgtccgtatgtccgacttcaaatccaacgaatacgccaacctggtcggcggcagcgtatacgaaccgcatgaagaaaacccgatgttgggcttccgtggtgcggcgcgttatgttgccgagagcttcaaagactgtttcgccttggaatgcaaagccttgaaacgcgttcgtgacgaaatgggtctgaccaacgtcgaaatcatgattccgttcgtccgcactttgggcgaagccgaagcagtggttaaggcattgaaagaaaacggcttggaacgcggcaaaaacggcctgcgcctgattatgatgtgcgagctgccgagcaacgcggtattggcggaacaattcctgcaatacttcgacggcttctccatcggctcgaacgacatgacccagctgaccctcggcctcgaccgagacagcggcttggtgtccgaatcgtttgacgaacgcaaccctgccgtcaaagtgatgctgcatcttgccatctccgcctgccgcaagcagaacaaatatgtcggtatctgcggtcaaggtccgtccgaccatccggactttgccaaatggctggttggagaaggcatcgaaagcgtgtctctgaacccggataccgtcatcgaaacttggctgtatttggcgaatgaattgaacaaa

SEQ ID NO: 2376 - protein, 798 aa, Neisseria gonorrhoeae
LDTQMADNYVIWFENLRMTDVERVGGKNASLGEMISQLTEKGVRVPGGFATTADAYRAFLAHNGLNERISAALAKLDVEDVSELARVGKEIRQWILDTPFPEQLDAEIEAAWNKMITDADGADISVAVRSSATAEDLPDASFAGQQETFLNINGLDNVKKAMRHVFASLYNDRAISYRVHKGFEHDIVALSAGVQRMVRSDSGASGVMFTLDTESGYNQVVFVTSSYGLGENVVQGAVNPDEFYVFKPTLKAGKPAILRKTMGSKHIKMIFTDKAEAGKSVTNVEVPEEDRNRFSITDEEITELAHYALTIEKHYGRPMDIEWGRDGLDGKLYILQARPETVKSQEEGSRNLRRYAINGEKTVLCEGRAIGQKVGQGKVRLIKDASEMDSVEAGDVLVTDMTDPDWEPVMKRASAIVTNRGGRTCHAAIIARELGIPAVVGCGNATELLENGQEVTVSCAEGDTGFIYAGLLDVQITDVALDNMPKAPVKVMMNVGNPELAFSFANLPSEGIGLARMEFIINRQIGIHPKALLEFDKQDDELKAEIIRRIAGYASPVDFYVDKIAEGVATLAASVYPRKTIVRMSDFKSNEYANLVGGSVYEPHEENPMLGFRGAARYVAESFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVGEGIESVSLNPDTVIETWLYLANELNK

SEQ ID NO: 2377 - DNA, 276 bp, Neisseria gonorrhoeae
ttgtcggccatttgtgtgtccaatccaaaatatgttaaaaaagaaacaaatccgcttgcttattttaagcgattcgttccgccgctgtcacgtttttatctgtccggacaaccgctgcgccgtctgaaaaatagcgggttccggctgtgtagcggtttgaaaccgatggcaggcatattgtttttttcgggtatttcctttgtaaaacagatggttttgaataggttaatgttttatgccgtatttttcctgtttcttttttttggaattttattt

SEQ ID NO: 2378 - protein, 92 aa, Neisseria gonorrhoeae
LSAICVSNPKYVKKETNPLAYFKRFVPPLSRFYLSGQPLRRLKNSGFRLCSGLKPMAGILFFSGISFVKQMVLNRLMFYAVFFLFLFFGILF

SEQ ID NO: 2379 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttgccaaccatcgtttggccttggctgccgatgaggttttcgagggccccgccgggccgggcgcaagctgtttcggcgtacggcgtaaaggcagacgcggtcgcggcgcggcaggaaaagcggttgtcttcggcattccgaaacgcaacgggcgggcctataccgttgccgcggacgatgccgagcctgaaacgttaccccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaaccttttccgccgttcttgagggaatgcgaatttcgacttaacttcggcacaccgtcccggcagctaaaaatcctgcgggatcggtgtggaatt

SEQ ID NO: 2380 - protein, 217 aa, Neisseria gonorrhoeae
MKITHCKLKKEVQKEPLRSFVPEVTARSAADILGIHPDSAALFYRKIRTVANHRLALAADEVFEGPAGPGASCFGVRRKGRRGRGAAGKAVVFGIPKRNGRAYTVAADDAEPETLPPAVKKKIMPDGIVYADSPGSRGKSDAGGFTRCRINRSKEFADRRNHINGIGNFWNQAKRALRKYNGIDRKPFPPFLRECEFRLNFGTPSRQLKILRDRCGI

SEQ ID NO: 2381 - DNA, 669 bp, Neisseria gonorrhoeae
gtggtggagaaggtcaatcggagccggcaggaaaacggtcagcgtccgattgcgtttgtcagcgtggttgatgacgaaatccgccggattattaaaggggcggatgcttttcagattaatttctttgagacttttttgggactgttggagaaggaactcaataccgaagcaacggtatccgggcaggggcatcacagtatcggcaatacgaagcgttacgatgcgcgtatggaggcggtcaatttttctttgaaccatgatgacggggtcagcgataagaaccttcaggaggcggatgtgattctgatgggcgtgtcccgttcgggcaaaacgccgacctgcctgtatctggcgttgcaatacggtatccgtgcggcaaactatccgctgattcccgacgatttggaatcggccgatctgccgcgtatggtcaagccgtataaagacaaactgttcgggttgactatccagccggaacgtttgcaggccatccgtcaggaacgccgcccgaattcggcttatgcgcgcatcgacacctgccgcagcgaagtggcggacgcgcagagtatgttcagacggcatggcattccgtttgcgaatacgacggacaagtcggttgaggaactggcggtacacatccttcaggcgtgcaagctcaaacgcaggttt

SEQ ID NO: 2382 - protein, 223 aa, Neisseria gonorrhoeae
VVEKVNRSRQENGQRPIAFVSVVDDEIRRIIKGADAFQINFFETFLGLLEKELNTEATVSGQGHHSIGNTKRYDARMEAVNFSLNHDDGVSDKNLQEADVILMGVSRSGKTPTCLYLALQYGIRAANYPLIPDDLESADLPRMVKPYKDKLFGLTIQPERLQAIRQERRPNSAYARIDTCRSEVADAQSMFRRHGIPFANTTDKSVEELAVHILQACKLKRRF

SEQ ID NO: 2383 - DNA, 147 bp, Neisseria gonorrhoeae
atggcgtttgaacgacagattgccaaactggttcagcaaagcctcgccgatattctcggcagtcagaccggtgcggtcggaaatataaaacacttggcgcggactgctcatcaccccctccttaaatacagaataaaaatatcatca

SEQ ID NO: 2384 - protein, 49 aa, Neisseria gonorrhoeae
MAFERQIAKLVQQSLADILGSQTGAVGNIKHLARTAHHPLLKYRIKISS

SEQ ID NO: 2385 - DNA, 708 bp, Neisseria gonorrhoeae
atgccgtctgaaacctttcgtcccgcactttataaaaaaggaaaacacatgatacaagccgtattgttcgacctcgacggcacgctcgccgacaccgccctagacctcggcggcgcactcaacacccaactcgcccgccacggactgcccgaaaaaagcatggacgaaatccgcacccaagccagccacggcgcggcaggattgctcaaactcggcgcgaacatcacgcccgaacaccccgactataccgcatggcgcaccgaatatctggaggaatacgacagccgctacgcccaagacaccactctcttcgacggcgtgaacgaactcatcgccgaactcgacagacgcggcatcaaatggggcatcatcaccaacaaacccatgcgcttcaccgacaaactcgttcccaaactcggattcgccgttccgcccgccaccgtcgtcagcggcgacacctgcggcgaacccaaacccagcatcaaacccatgctgcacgcctgcggaaaaatccacgccgacccgcaacacaccctctacgtcggcgacgcggaacgcgacatccaagccggacgcaacgccggtatgaaaaccgtcctcgccgaatggggctatatttccgatgaagacgataccggctcatggcaggcggatttccacatccgcacgccgctcgatctgctcgaatgtctggacaaaatacagccc

SEQ ID NO: 2386 - protein, 236 aa, Neisseria gonorrhoeae
MPSETFRPALYKKGKHMIQAVLFDLDGTLADTALDLGGALNTQLARHGLPEKSMDEIRTQASHGAAGLLKLGANITPEHPDYTAWRTEYLEEYDSRYAQDTTLFDGVNELIAELDRRGIKWGIITNKPMRFTDKLVPKLGFAVPPATVVSGDTCGEPKPSIKPMLHACGKIHADPQHTLYVGDAERDIQAGRNAGMKTVLAEWGYISDEDDTGSWQADFHIRTPLDLLECLDKIQP

SEQ ID NO: 2387 - DNA, 825 bp, Neisseria gonorrhoeae
atgaaccccgatatttatgctttgccggaacgcgccctgctttcgggcgaccccgatgaaaaaggacggctgacggatgaggcgtttgccgccgttcaaaatgcggacggggcggaggcaaacgcgccgccggcggacttcccccgcgcgggacggccggacacgcctgttttggtcgcgccctcgcaactgaccccgcgcaaaatgaacacggcagaaggctatgcggcgatgctgcacgcgattacgcatatcgagttcaacgccgtcaatctggctttggacgcggcataccgtttccgcacgctgccgtttcagtttgtccgcgactgggtgaaagtggcgaaggaggaggtgtaccacttccgcctggtgcgcgacagattgcgcgctttcggcttcgattacggcagtttcgaggcgcacaaccatttgtgggatatggcgtacaaaaccgcctacgacccgctgttgcgtatggcgttggtaccgcgcgtgttggaggcgcgcggactggacgttatgccggggatacgcgcgaaggtggagcagcgcggcgattcggcaacctgcggcgtgttggacatcatttaccgcgacgaagtgggacacgtcgccatcggcaaccggtggtatcaacacctctgccgcgaacgcggtttggaacctgtcgccctgttccgcagtctgattgcccgttacgatatgtttatcttccgcggctatgtgaacatcgaagcgcgggaaaaagcgggcttcagccgcttcgaattggatatgttggaagatttcgagcagggtttgaaacaaaataaacatgccgtc

SEQ ID NO: 2388 - protein, 275 aa, Neisseria gonorrhoeae
MNPDIYALPERALLSGDPDEKGRLTDEAFAAVQNADGAEANAPPADFPRAGRPDTPVLVAPSQLTPRKMNTAEGYAAMLHAITHIEFNAVNLALDAAYRFRTLPFQFVRDWVKVAKEEVYHFRLVRDRLRAFGFDYGSFEAHNHLWDMAYKTAYDPLLRMALVPRVLEARGLDVMPGIRAKVEQRGDSATCGVLDIIYRDEVGHVAIGNRWYQHLCRERGLEPVALFRSLIARYDMFIFRGYVNIEAREKAGFSRFELDMLEDFEQGLKQNKHAV

SEQ ID NO: 2389 - DNA, 852 bp, Neisseria gonorrhoeae
atgtttattttgtttcaaaccctgctcgaaatcttccaacatatccaattcgaagcggctgaagcccgctttttcccgcgcttcgatgttcacatagccgcggaagataaacatatcgtaacgggcaatcagactgcggaacagggcgacaggttccaaaccgcgttcgcggcagaggtgttgataccaccggttgccgatggcgacgtgtcccacttcgtcgcggtaaatgatgtccaacacgccgcaggttgccgaatcgccgcgctgctccaccttcgcgcgtatccccggcataacgtccagtccgcgcgcctccaacacgcgcggtaccaacgccatacgcaacagcgggtcgtaggcggttttgtacgccatatcccacaaatggttgtgcgcctcgaaactgccgtaatcgaagccgaaagcgcgcaatctgtcgcgcaccaggcggaagtggtacacctcctccttcgccactttcacccagtcgcggacaaactgaaacggcagcgtgcggaaacggtatgccgcgtccaaagccagattgacggcgttgaactcgatatgcgtaatcgcgtgcagcatcgccgcatagccttctgccgtgttcattttgcgcggggtcagttgcgagggcgcgaccaaaacaggcgtgtccggccgtcccgcgcgggggaagtccgccggcggcgcgtttgcctccgccccgtccgcattttgaacggcggcaaacgcctcatccgtcagccgtcctttttcatcggggtcgcccgaaagcagggcgcgttccggcaaagcataaatatcggggttcatctcaagtccgccgtgttcggaaaacgaatatta

SEQ ID NO: 2390 - protein, 284 aa, Neisseria gonorrhoeae
MFILFQTLLEIFQHIQFEAAEARFFPRFDVHIAAEDKHIVTGNQTAEQGDRFQTAFAAEVLIPPVADGDVSHFVAVNDVQHAAGCRIAALLHLRAYPRHNVQSARLQHARYQRHTQQRVVGGFVRHIPQMVVRLETAVIEAESAQSVAHQAEVVHLLLRHFHPVADKLKRQRAETVCRVQSQIDGVELDMRNRVQHRRIAFCRVHFARGQLRGRDQNRRVRPSRAGEVRRRRVCLRPVRILNGGKRLIRQPSFFIGVARKQGAFRQSINIGVHLKSAVFGKRIL

SEQ ID NO: 2391 - DNA, 90 bp, Neisseria gonorrhoeae
ttgaaagggcagcgtggcgcgcctgctttttccgagcggtcaaaaaaatcagccctcggaaaacgcggtttgcaaaatgcaaaccgcccg

SEQ ID NO: 2392 - protein, 30 aa, Neisseria gonorrhoeae
LKGQRGAPAFSERSKKSALGKRGLQNANRP

SEQ ID NO: 2393 - DNA, 510 bp, Neisseria gonorrhoeae
ttgtcggtactgaccgacgaaccctatttccaaggttcgcccgaatacctcaaacaggcgcgcgaagccgtattgctgcccgtgctgcgcaaagacttcatcatcgacgaataccaggtttatcaggcgcgcgcatggggggcggatgccgtcctgctgattgccgccgcactggaacagggacaattggaacgctttgaggcgctggcgcacgaattgggcatgaccgtcctgctcgagctgcacgacgaaaccgaattggaaaaatgccgcaacctgaccacgccgttgtggggcgtaaacaaccgcaacctgcggacttttgaagtctccctcgaccaaaccctgtcgctgctgcccgcgctggaaggcaaaaccgtcgttaccgaaagcggcattacaggcaaggcggatgtggaatttatgcgggcgcgcggcgtgcataccttcctgatcggcgaaacgtttatgcgtgccgacgatattggggcggaagtgggcaaactcttc

SEQ ID NO: 2394 - protein, 170 aa, Neisseria gonorrhoeae
LSVLTDEPYFQGSPEYLKQAREAVLLPVLRKDFIIDEYQVYQARAWGADAVLLIAAALEQGQLERFEALAHELGMTVLLELHDETELEKCRNLTTPLWGVNNRNLRTFEVSLDQTLSLLPALEGKTVVTESGITGKADVEFMRARGVHTFLIGETFMRADDIGAEVGKLF

SEQ ID NO: 2395 - DNA, 96 bp, Neisseria gonorrhoeae
atgccaagcctaattttgcacaaattgttgacattatttttcccatattttcgatatatgatgtttattgccgataatcaaccaataatcataaat

SEQ ID NO: 2396 - protein, 32 aa, Neisseria gonorrhoeae
MPSLILHKLLTLFFPYFRYMMFIADNQPIIIN

SEQ ID NO: 2397 - DNA, 132 bp, Neisseria gonorrhoeae
ttggaaaagcagaaactgctccgccgttattcccgcgaaggcaggaatctgaacacgtccgtagggaaacctatatcccgtcattcccacgaaagtgggaatccaggatgcaggggaaaccgttttatccga

SEQ ID NO: 2398 - protein, 44 aa, Neisseria gonorrhoeae
LEKQKLLRRYSREGRNLNTSVGKPISRHSHESGNPGCRGNRFIR

SEQ ID NO: 2399 - DNA, 705 bp, Neisseria gonorrhoeae
atgcaaaccgcccgtaacgccgcccgtatgattgttttgccgcgccgatactttgcgccacacccatcccgacaaggaaaaataatgatgaaaccgcacaacctgttccaattcctcgccgtttgctccctgaccgtcgccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctcttcaaatgggaatacactttgccctacagacagactattgtcggcgacggtcaaaccgtttggctctacgatgttgatttggcacaagtgaccaagtcgtcccaagaccaggccatcggcggcagccccgccgccatcctgtcgaacaaaaccgccctcgaaagcagttacacgctgaaagaggacggttcgtccaacggcatcgattatgtgcgggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaac

SEQ ID NO: 2400 - protein, 235 aa, Neisseria gonorrhoeae
MQTARNAARMIVLPRRYFAPHPSRQGKIMMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRATPKRNNAGYQYIRIGFKGGNLAAMQLKDSFGNQTSISFGGLNTNPQLSRGAFKFTPPKGVDVLSN

SEQ ID NO: 2401 - DNA, 708 bp, Neisseria gonorrhoeae
ttggttgccgaagctgtctttaagctgcatggcggcgaggttgccgcctttgaagccgatgcggatgtattggtagccggcgttgttgcgtttgggcgttgcccgcacataatcgatgccgttggacgaaccgtcctctttcagcgtgtaactgctttcgagggcggttttgttcgacaggatggcggcggggctgccgccgatggcctggtcttgggacgacttggtcacttgtgccaaatcaacatcgtagagccaaacggtttgaccgtcgccgacaatagtctgtctgtagggcaaagtgtattcccatttgaagaggcccgggcgcaggattttgaacgtgccgtgcgcggtttgggttttctttttgctttggacggtttgggtgaagctgccgctgataccgtcggcatcgttgttgaattgcttgagcgcgtccaccgcgcccgcctgtgcggaagcgacggcgacggtcagggagcaaacggcgaggaattggaacaggttgtgcggtttcatcattatttttccttgtcgggatgggtgtggcgcaaagtatcggcgcggcaaaacaatcatacgggcggcgttacgggcggtttgcattttgcaaaccgcgttttccgagggctgatttttttgaccgctcggaaaaagcaggcgcgccacgctgccctttcaattgtgtgccgcgttatagtggat

SEQ ID NO: 2402 - protein, 236 aa, Neisseria gonorrhoeae
LVAEAVFKLHGGEVAAFEADADVLVAGVVAFGRCPHIIDAVGRTVLFQRVTAFEGGFVRQDGGGAAADGLVLGRLGHLCQINIVEPNGLTVADNSLSVGQSVFPFEEARAQDFERAVRGLGFLFALDGLGEAAADTVGIVVELLERVHRARLCGSDGDGQGANGEELEQVVRFHHYFSLSGWVWRKVSARQNNHTGGVTGGLHFANRVFRGLIFLTARKKQARHAALSIVCRVIVD

SEQ ID NO: 2403 - DNA, 126 bp, Neisseria gonorrhoeae
ttggcccttggtgcagcaaggtttgcattaaacggcaaaaacagccggggcgcaaccgttaattttcacggatttgccgttccgttgcccgatcggccgataatgcgggacattgttccgcctgcg

SEQ ID NO: 2404 - protein, 42 aa, Neisseria gonorrhoeae
LALGAARFALNGKNSRGATVNFHGFAVPLPDRPIMRDIVPPA

SEQ ID NO: 2405 - DNA, 1194 bp, Neisseria gonorrhoeae
atgcaggcggcccgtccgtccctgcaatgttttttatttttgaacgaaaggtcgaaaaccatgaaaaaaacactggtggcggcaatcctgagccttgccttgactgcgtgcggcggcggaagcgataccgccgcccaaaccccctccgccaagcccgaagccgaacaatcgggcaaactcaacatctacaactggtcggattatgtcgatcccgaaaccgtcgccgcctttgaaaaagaaaccggcattaagatgcgttccgactattacgacagcaacgaaacactggaggcaaaagtcctgaccggcaaatccggctacgacctgaccgcgccgtccatcgccaacgtcggccggcaaatcaaagcgggcgcgtatcagaaaatcgacaaggcgcaaatcccccattacggcaacatcgataaagatttgctgaaaatgatggaagccgtcgatccgggcaacgaatacgccgtcccctatttctggggcatcaacaccttggcaatcaacacgcggcaggtgcaaaaggcattgggtacggacaagctgcccgaaaacgagtgggatttggtgttcaaacccgaatacaccgccaaactcaaatcctgcgggatcagctatttcgacagcgcaatcgaacagattcccttggcgttgcactatttgggcaaagaccccaacagtgaaaatcccgaagacatcaaagccgccgtcgatatgatgaaagccgtccgaggcgacgtgaaacgcttcagctcttccggctatatcgacgatatggcggcgggcaacctgtgtgccgccatcggttacggcggcgatttgaacattgccaaaacccgtgccgaagaagccgcaaacggcgtggaaatcaaagtattgaccccgaaaaccggcgtgggcgtgtgggtggattcctttatgattccgcgcgacgcgcaaaacgttgccaacgcccaccgctatatcgattacacgctccggcccgaggtggcggcgaaaaacggcagcttcgttacctacgcgcccgccagccgccccgcgcgcgagctgatggatgaaaaatacacctccgacgcatcgattttcccgaccaaagaactgatggaaaaaagtttcatcgtatcacccaaatccgcagaatccgtcaaactgggcgtgaagctgtggcaagggctcaaagcgggcaaa

SEQ ID NO: 2406 - protein, 398 aa, Neisseria gonorrhoeae
MQAARPSLQCFLFLNERSKTMKKTLVAAILSLALTACGGGSDTAAQTPSAKPEAEQSGKLNIYNWSDYVDPETVAAFEKETGIKMRSDYYDSNETLEAKVLTGKSGYDLTAPSIANVGRQIKAGAYQKIDKAQIPHYGNIDKDLLKMMEAVDPGNEYAVPYFWGINTLAINTRQVQKALGTDKLPENEWDLVFKPEYTAKLKSCGISYFDSAIEQIPLALHYLGKDPNSENPEDIKAAVDMMKAVRGDVKRFSSSGYIDDMAAGNLCAAIGYGGDLNIAKTRAEEAANGVEIKVLTPKTGVGVWVDSFMIPRDAQNVANAHRYIDYTLRPEVAAKNGSFVTYAPASRPARELMDEKYTSDASIFPTKELMEKSFIVSPKSAESVKLGVKLWQGLKAGK

SEQ ID NO: 2407 - DNA, 981 bp, Neisseria gonorrhoeae
atgaatttaagtattgtcgttcctatttataatgtcgaaagttatttggaagcgtgtttaaattctatagaacctatattaagtaatgaaaatgtcgaacttattcttgtgaatgacgggtcaaaagacggaagtgaagatatatgttataaatatatagataaaatatcaaacaccaaacaccaaacaccaaacaccaaatatatatatcaggataaccaaggattgtcggaggcgagaaataccggaataaaaaattcaaatggaaaatatatagcatttattgattcggatgattttattaattgtcaggttttgctggattttcttggtaaagatgatagtgatatgccggatgtggtttttttaaatgcagttaaatatgataagggaagagtttcatattttggcgaagattatcagcctgaaaaaatattaaatcaatccaaagtcgaagttttgaaaggattgtgccgatttagaaaatttccgggttcggcgtggaataagattataaaaagagaattgattattagagaaaaactgttttttgaaaagggaatttattctgaagatattgaatggtcaatgaggttatttaatgcggcaacaactttttcttatttggacggttgttattactattatcggcagggaagaaaagattctattacgggaactgtttcggaaaaaggtataaagtcattattatatattttggaaaaaaatgcgaaaatggaatttaatagggatatatcgagttatctttattcttttctttcctacgaatatctcgttttgctttttataatgacgagtaaaaatatagcgtgtgattctgatataaaaagaagggcatatcatttaaggtttatgctgttaaagtccaataagctgatatataagctgatattcccgataatcacattattcggggtcgatattacaggcaggattttaaaagcaatcagggggaatatt

SEQ ID NO: 2408 - protein, 327 aa, Neisseria gonorrhoeae
MNLSIVVPIYNVESYLEACLNSIEPILSNENVELILVNDGSKDGSEDICYKYIDKISNTKHQTPNTKYIYQDNQGLSEARNTGIKNSNGKYIAFIDSDDFINCQVLLDFLGKDDSDMPDVVFLNAVKYDKGRVSYFGEDYQPEKILNQSKVEVLKGLCRFRKFPGSAWNKIIKRELIIREKLFFEKGIYSEDIEWSMRLFNAATTFSYLDGCYYYYRQGRKDSITGTVSEKGIKSLLYILEKNAKMEFNRDISSYLYSFLSYEYLVLLFIMTSKNIACDSDIKRRAYHLRFMLLKSNKLIYKLIFPIITLFGVDITGRILKAIRGNI

SEQ ID NO: 2409 - DNA, 528 bp, Neisseria gonorrhoeae
atgaacgcaatcagaactttccaaaaccgcacgcccgaaatccacgaaacctgcatgatagacgaggcgtgcgtcgtcatcggcgaagtctcgcttgccgaagatgtttccgtgtggccgtgcgccgtgttgcgcggcgatgtgaacagcatcaccgtcggcgcgcgcagcaatatacaggacggcagcgtcctgcacgtttcccacaaaaccgccgccaaacccgaagggtcgccgctggttatcggcgaagacgttaccgtggggcacaaagtgatgctgcacggctgccgaatcggtaaccgcgtcttggtcggtatgggcagcaccgttttggacgatgccgttattgaagatgacgtgatgatcggcgcgggcagcctcgttccgccgcgcaaacgtttggagggcggctatctttatatcggttcgcctgtgaggcaggttcgtctgctgaccgatgaggaaaaagcctttttgaaatattccgccgcacattatgtgaagctgtcgaaacagtacgggatg

SEQ ID NO: 2410 - protein, 176 aa, Neisseria gonorrhoeae
MNAIRTFQNRTPEIHETCMIDEACVVIGEVSLAEDVSVWPCAVLRGDVNSITVGARSNIQDGSVLHVSHKTAAKPEGSPLVIGEDVTVGHKVMLHGCRIGNRVLVGMGSTVLDDAVIEDDVMIGAGSLVPPRKRLEGGYLYIGSPVRQVRLLTDEEKAFLKYSAAHYVKLSKQYGM

SEQ ID NO: 2411 - DNA, 591 bp, Neisseria gonorrhoeae
gtgatttcacatcccgtactgtttcgacagcttcacataatgtgcggcggaatatttcaaaaaggctttttcctcatcggtcagcagacgaacctgcctcacaggcgaaccgatataaagatagccgccctccaaacgtttgcgcggcggaacgaggctgcccgcgccgatcatcacgtcatcttcaataacggcatcgtccaaaacggtgctgcccataccgaccaagacgcggttaccgattcggcagccgtgcagcatcactttgtgccccacggtaacgtcttcgccgataaccagcggcgacccttcgggtttggcggcggttttgtgggaaacgtgcaggacgctgccgtcctgtatattgctgcgcgcgccgacggtgatgctgttcacatcgccgcgcaacacggcgcacggccacacggaaacatcttcggcaagcgagacttcgccgatgacgacgcacgcctcgtctatcatgcaggtttcgtggatttcgggcgtgcggttttggaaagttctgattgcgttcatttttcctccttcggtaaggtatatattgttaaaggatttattaaatattccccc

SEQ ID NO: 2412 - protein, 197 aa, Neisseria gonorrhoeae
VISHPVLFRQLHIMCGGIFQKGFFLIGQQTNLPHRRTDIKIAALQTFARRNEAARADHHVIFNNGIVQNGAAHTDQDAVTDSAAVQHHFVPHGNVFADNQRRPFGFGGGFVGNVQDAAVLYIAARADGDAVHIAAQHGARPHGNIFGKRDFADDDARLVYHAGFVDFGRAVLESSDCVHFSSFGKVYIVKGFIKYSP

SEQ ID NO: 2413 - DNA, 1332 bp, Neisseria gonorrhoeae
atgactgacctgaacaccctgtttgccaacctcaaacaacgcaaccccaatcaggagccgttccatcaggcggttgaagaagtcttcatgagccttgatccgtttttggcaaaaaatccgaaatacacccagcaaagcctgctggaacgcatcgtcgaacccgaacgcgtcgtgatgttccgcgtaacctggcaggacgacaaaggacaagtccaagtcaaccgcggctaccgcgtgcaaatgagttccgccatcggcccttacaaaggcggcctgcgcttccacccgaccgtcgatttgggcgtgttgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcggacgcgaaatcggctacctgttcggacaatacaaaaaaatccgcaatgaattcacttccgtcctgaccggcaaaggtttggaatggggtggcagcctcatccgccccgaggcgaccggctacggctgcgtctatttcgcccaagcgatgctgcaaacccgcaacgatagttttgaaggcaaacgcgttctgatttccggttccggcaacgtggcgcaatacgccgctgaaaaagccatccaactgggtgcgaaagtgctgaccgtctccgactccgacggcttcgtcctcttccccgacatcggtatgaccgaagcgcaactcgccgccttgatcgaattgaaagaagtccgccgcgaacgcgttgccacctacgccaaagagcaaggtttgcaatactttgaaaaccaaaaaccgtggggcgttgccgccgaaatcgccctgccctgcgcgacccagaacgaattggacgaagaagccgccaaaaccctgttggcaaacggctgctacgtcgttgccgaaggcgcgaatatgccgtcgactttgggcgcggtcgagcaatttatcaaagccggcatcctctacgctccgggcaaagcctccaacgccggcggcgtggcaacttcgggcttggaaatgagccaaaacgccatccgcctgtcttgggcgcgcgaagaagtggacagccgactgttcggcatcatgcaaagcatccacgagtcctgcctgaaatacggcaaagtcggcgacaaagtgaactacgtcaacggtgcgaacatcgccggcttcgtcaaagttgccgatgcgatgctggcgcaaggcttc

SEQ ID NO: 2414 - protein, 444 aa, Neisseria gonorrhoeae
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFTSVLTGKGLEWGGSLIRPEATGYGCVYFAQAMLQTRNDSFEGKRVLISGSGNVAQYAAEKAIQLGAKVLTVSDSDGFVLFPDIGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWAREEVDSRLFGIMQSIHESCLKYGKVGDKVNYVNGANIAGFVKVADAMLAQGF

SEQ ID NO: 2415 - DNA, 141 bp, Neisseria gonorrhoeae
atgccgtctgagggcttgagcatttcagacggcatttttgacggtaaacgtagggagggcttcagcctgccaattaataatcgaaaaagaagaaacagtaaccgcagggtgggcttcagtccactaattgacaagcaaaaa

SEQ ID NO: 2416 - protein, 47 aa, Neisseria gonorrhoeae
MPSEGLSISDGIFDGKRREGFSLPINNRKRRNSNRRVGFSPLIDKQK

SEQ ID NO: 2417 - DNA, 1569 bp, Neisseria gonorrhoeae
gtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactc

SEQ ID NO: 2418 - protein, 523 aa, Neisseria gonorrhoeae
VRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 2419 - DNA, 465 bp, Neisseria gonorrhoeae
atgatggcaaacgtgcggcggcggcgcacttggtcgaggatttcttgggacatggttttctttgcaaaaaggttcaggccgcttttcagacggcccggacagtgtttgagacggcgaaattgtacaaaaaaatgcctgataattcaatgttggaggcggtcagtgcgtgctgccgtaaatctctttttcgtctttcaggacggcatcggcggtttcccacgcaccgccgttccattttttgtaaaagcagctttcgcgcccggtgtggcaggcgatgccgccgttttgggcgatgagcatcacaatggtatcgccgtcgcagtcgaggcgcagttcgcggactttttgcgtgtgtcccgactcttcgcccttcatccattgtttttggcgcgaacggctgtaatagtgggcaaagccggtttcgacggttttttgcagggcttcggcgttcatccacgccaccat

SEQ ID NO: 2420 - protein, 155 aa, Neisseria gonorrhoeae
MMANVRRRRTWSRISWDMVFFAKRFRPLFRRPGQCLRRRNCTKKCLIIQCWRRSVRAAVNLFFVFQDGIGGFPRTAVPFFVKAAFAPGVAGDAAVLGDEHHNGIAVAVEAQFADFLRVSRLFALHPLFLARTAVIVGKAGFDGFLQGFGVHPRHH

SEQ ID NO: 2421 - DNA, 348 bp, Neisseria gonorrhoeae
ttggtttgcgccatcgcccaagatgccgaaaccaaacgtgttttaatggtggcgtggatgaacgccgaagccctgcaaaaaaccgtcgaaaccggctttgcccactattacagccgttcgcgccaaaaacaatggatgaagggcgaagagtcgggacacacgcaaaaagtccgcgaactgcgcctcgactgcgacggcgataccattgtgatgctcatcgcccaaaacggcggcatcgcctgccacaccgggcgcgaaagctgcttttacaaaaaatggaacggcggtgcgtgggaaaccgccgatgccgtcctgaaagacgaaaaagagatttacggcagcacgcac

SEQ ID NO: 2422 - protein, 116 aa, Neisseria gonorrhoeae
LVCAIAQDAETKRVLMVAWMNAEALQKTVETGFAHYYSRSRQKQWMKGEESGHTQKVRELRLDCDGDTIVMLIAQNGGIACHTGRESCFYKKWNGGAWETADAVLKDEKEIYGSTH

SEQ ID NO: 2423 - DNA, 738 bp, Neisseria gonorrhoeae
atggcgcaaaccaaacctttttcgtcaaatttgacggcttcaagcaggtttttatccatatttcctttcagacggcatagtcggggcggtcagaggcgcacttcgatgccggcttcgcgcatagtgcgtttggcttcgcggatggcgatttccccgaaatggaaaatgccggcggcaagtacggcatcggctttgccttcggttatgccttcaatcaggtgccggacattgccgaccccgccggaggcgatgacggggatgtcgacggcttcggcaacggcgcgggtcagcggcaggttgaaaccctgtttcgtcccgtccctgtccataccggtgagcaggatttcgcccgcgccgcgtttttgcatttcgaccgcccattccaccgcatccaaaccggtcggattgcgcccgccgtgggtaaagatttcccagcgtgtgttttcggggttgacggctttggcatcgacggcggcgacgatggcttgcgaaccgaaaaatccggcggcttcgttaattaaatcgggacgggtaacggcggcggtgttgatgctgactttgtccgcgccggcattgagcaggcggcggatgtcggcaacggtgcgtacgccgccgccgacggtcagcgggatgaagacttgtccggcaacctcttcgatgatgtgcaggatggtgtcgcggttgtcggatgaggcggtgatgtcgaggaaggtcaattcgtccgcgccttcgccgttg

SEQ ID NO: 2424 - protein, 246 aa, Neisseria gonorrhoeae
MAQTKPFSSNLTASSRFLSIFPFRRHSRGGQRRTSMPASRIVRLASRMAISPKWKMPAASTASALPSVMPSIRCRTLPTPPEAMTGMSTASATARVSGRLKPCFVPSLSIPVSRISPAPRFCISTAHSTASKPVGLRPPWVKISQRVFSGLTALASTAATMACEPKNPAASLIKSGRVTAAVLMLTLSAPALSRRRMSATVRTPPPTVSGMKTCPATSSMMCRMVSRLSDEAVMSRKVNSSAPSPL

SEQ ID NO: 2425 - DNA, 765 bp, Neisseria gonorrhoeae
atggcactggcaaaacgcatcatcccctgtctcgacgtaaaagacgggcgcgtcgtcaaaggcgtgaacttcatcggtttgcgcgacgcgggcgaccccgtcgaagccgccaaacgctacaacggcgaaggcgcggacgaattgaccttcctcgacatcaccgcctcatccgacaaccgcgacaccatcctgcacatcatcgaagaggttgccggacaagtcttcatcccgctgaccgtcggcggcggcgtacgcaccgttgccgacatccgccgcctgctcaatgccggcgcggacaaagtcagcatcaacaccgccgccgttacccgtcccgatttaattaacgaagccgccggatttttcggttcgcaagccatcgtcgccgccgtcgatgccaaagccgtcaaccccgaaaacacacgctgggaaatctttacccacggcgggcgcaatccgaccggtttggatgcggtggaatgggcggtcgaaatgcaaaaacgcggcgcgggcgaaatcctgctcaccggtatggacagggacgggacgaaacagggtttcaacctgccgctgacccgcgccgttgccgaagccgtcgacatccccgtcatcgcctccggcggggtcggcaatgtccggcacctgattgaaggcataaccgaaggcaaagccgatgccgtacttgccgccggcattttccatttcggggaaatcgccatccgcgaagccaaacgcactatgcgcgaagccggcatcgaagtgcgcctc

SEQ ID NO: 2426 - protein, 255 aa, Neisseria gonorrhoeae
MALAKRIIPCLDVKDGRVVKGVNFIGLRDAGDPVEAAKRYNGEGADELTFLDITASSDNRDTILHIIEEVAGQVFIPLTVGGGVRTVADIRRLLNAGADKVSINTAAVTRPDLINEAAGFFGSQAIVAAVDAKAVNPENTRWEIFTHGGRNPTGLDAVEWAVEMQKRGAGEILLTGMDRDGTKQGFNLPLTRAVAEAVDIPVIASGGVGNVRHLIEGITEGKADAVLAAGIFHFGEIAIREAKRTMREAGIEVRL

SEQ ID NO: 2427 - DNA, 678 bp, Neisseria gonorrhoeae
ttgttaaaatcgcagccatattgcaaaaaagaggaggaagccatgcaaaccgccattatcgattacggtatgggcaacctgcattccgtattgaaatccgtccggacggcggggcagcttgccggaaaaaataccaaaatctttttaagcggcgaccccgaccgcgtgtcccgcgccgacaaagtcatttttcccgggcagggcgcgatgcccgactgtatggcggcactgacgcgcggcggcttggacgaggcagtcaaagacgccttaaaaaacaaaccgtttttcggaatctgcgtcggtgcgcaacttttattcgaccacagcgaagaaggaaacaccgacggcttgggctggttcggcggcaaagtcagacgctttgcccgcgacctccgcgacccgcagggatgccgtctgaaagtcccgcatatgggctggaacaccgtgcgccaaacccaaaaccacccgctttttcaaggcatcccccaaaacacgcgtttttatttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactgg

SEQ ID NO: 2428 - protein, 226 aa, Neisseria gonorrhoeae
LLKSQPYCKKEEEAMQTAIIDYGMGNLHSVLKSVRTAGQLAGKNTKIFLSGDPDRVSRADKVIFPGQGAMPDCMAALTRGGLDEAVKDALKNKPFFGICVGAQLLFDHSEEGNTDGLGWFGGKVRRFARDLRDPQGCRLKVPHMGWNTVRQTQNHPLFQGIPQNTRFYFVHSYYFAPENPETILGESDYPSPFACIVGKDNVFATQFHTEKSHDAGLTMLKNFLNW

SEQ ID NO: 2429 - DNA, 2301 bp, Neisseria gonorrhoeae
atgacgcaccgacccaccgccagacagattttgcacgaagtattcggctatcccgaatttcgcggcaggcaggaggatgtcatcaatactttggcaggcggcggcagtttgacggtgctgatgccgacgggcgggggcaagtctttgtgttaccagattccggcgctgatgcgcgaaggcgtggcggttgtcgtatcgccgctgattgcgctgatgaacgaccaagtggccagcctgcatgtggccgggattgaagcggcggcagtcaacagcggcacatcggcagatgaggcgcgcgagattgccgacaagcttgcccaaggccgtctgaagctgctttatgtcgcgccggaacgcttggttaccgaccgctttttacgttttctcgaccaacaaaccgtcagcctgttcgccattgacgaagcgcactgcgtcagccggtggggacacgatttccgccccgaatatcaacagctcggtatgcttgccgaacgctatccgaacatcccgcgcatcgccctgaccgccaccgccgatgccgccacgcgcgccgacatcaagcattatctgcacttggacgacgcgtccgaatttgtctccagctttgaccgcacgaatatttattatcaggttatcgaaaaaaacaacggcaaaaaacaattgctggatttcatccgcaaagaaatgacggggcaaagcggcattgtgtattgcctaagccgcaaaaaggttgaagatgcggcgcagtttttgcgtgaaaacggattaaacgcgattccgtatcatgccggtttgagcatggacgtgcgcgaggaaaaccaacgccgctttacgcatgaagacaatattatcgtggtggcgaccgtggcgttcggcatgggcatagacaaacccgacgtgcgctttgtcgcccatctcgatatgccccagagtgtcgaacatttctatcaggaatcagggcgcgccggccgggacgggctgcctgccgtgagttggctgtgttacggcttgaacgattgggtgttgctgcgcgaacggattgccgaaggcaacagcgacgaggtgcaaaagcaaatcgaaatgcaaaaactcgatgccatgctttccgtctgcgaaaccgccgcctgccgccgcgtactgctgctcaaacatttcggcgaagcatccgaaccctgcggacattgtgacaactgcctgcatccgcccgtacggtttgacggcacggtgttggtgcaaaaattactcagctgcgtgtaccgcgccggacaacgctttgccgccggttacatcaccaaccttttgcgcggcaaaagcgacgattggatacgcggcaaccggcacgagcaactgtccacattcggcatcggcgcggaattgtccgacaaagaatggcgcagcgtcatccgccagtgcatcagcctcggctacctcaccgtcaacattgcccgatatcaggcattgcaactgaccgaagccgccaaaaaagtcctcaaaggcgaaaccgaagtgatgctgcgcccgctcaagcgcgacaagcccgccacccgcaccctcaaagacaactggctgcgtaccgaacgcgaagaacgcctgtggcaggcattgcgcgtttggcgcatgaaacaggctgaagccgaaggcatccccgcctatatgattttcggcgacaaaaccctgcgcgaccttgtcgaaaaaatgccgcaaaacctcaacgggctgcacgacatctacggcttgggcgaagccaaaaccgaacgtttcggacacggcatactcaaagtctgccaaaacgctgccgactttagccacgatgccgtcatccgtccgcaaaccgaacgcgaacaacaactgcgtcaaaaactcgaagcctggcggtatgaacaggcaagggcggaaaactgcgccctgcataccgtcctctccgacgaaagccttgccgatatgcttgccgccacgcccgaaaccgaaaccgacctcgaagccgtacacggcttgggcagcgtacgcgccgccaaatacggacgggacatcctcgccgtctgccgtccgttttcagacggcatcgatgaaaccgccaaacacaaacgctgcctgatgcgcgccctgattcaatggtgcaacgaaaccgcaaaacacgaacagtccgaaccctaccgcattctcagcaaagccgccctgcgcgccattgccgccaaacagccggaaggtttggcggagcttgccgccgtatacggcgtaggcgaagaaaaagccgcacgttacggtgcggcggtgttggcggtgttggaacgggatgccgtc

SEQ ID NO: 2430 - protein, 767 aa, Neisseria gonorrhoeae
MTHRPTARQILHEVFGYPEFRGRQEDVINTLAGGGSLTVLMPTGGGKSLCYQIPALMREGVAVVVSPLIALMNDQVASLHVAGIEAAAVNSGTSADEAREIADKLAQGRLKLLYVAPERLVTDRFLRFLDQQTVSLFAIDEAHCVSRWGHDFRPEYQQLGMLAERYPNIPRIALTATADAATRADIKHYLHLDDASEFVSSFDRTNIYYQVIEKNNGKKQLLDFIRKEMTGQSGIVYCLSRKKVEDAAQFLRENGLNAIPYHAGLSMDVREENQRRFTHEDNIIVVATVAFGMGIDKPDVRFVAHLDMPQSVEHFYQESGRAGRDGLPAVSWLCYGLNDWVLLRERIAEGNSDEVQKQIEMQKLDAMLSVCETAACRRVLLLKHFGEASEPCGHCDNCLHPPVRFDGTVLVQKLLSCVYRAGQRFAAGYITNLLRGKSDDWIRGNRHEQLSTFGIGAELSDKEWRSVIRQCISLGYLTVNIARYQALQLTEAAKKVLKGETEVMLRPLKRDKPATRTLKDNWLRTEREERLWQALRVWRMKQAEAEGIPAYMIFGDKTLRDLVEKMPQNLNGLHDIYGLGEAKTERFGHGILKVCQNAADFSHDAVIRPQTEREQQLRQKLEAWRYEQARAENCALHTVLSDESLADMLAATPETETDLEAVHGLGSVRAAKYGRDILAVCRPFSDGIDETAKHKRCLMRALIQWCNETAKHEQSEPYRILSKAALRAIAAKQPEGLAELAAVYGVGEEKAARYGAAVLAVLERDAV

SEQ ID NO: 2431 - DNA, 1242 bp, Neisseria gonorrhoeae
gtggatgctttgcatgatgccgaacagtcggctgtccacttcttcgcgcgcccaagacaggcggatggcgttttggctcatttccaagcccgaagttgccacgccgccggcgttggaggctttgcccggagcgtagaggatgccggctttgataaattgctcgaccgcgcccaaagtcgacggcatattcgcgccttcggcaacgacgtagcagccgtttgccaacagggttttggcggcttcttcgtccaattcgttctgggtcgcgcagggcagggcgatttcggcggcaacgccccacggtttttggttttcaaagtattgcaaaccttgctctttggcgtaggtggcaacgcgttcgcggcggacttctttcaattcgatcaaggcggcgagttgcgcttcggtcataccgatgtcggggaagaggacgaagccgtcggagtcggagacggtcagcactttcgcacccagttggatggctttttcagcggcgtattgcgccacgttgccggaaccggaaatcagaacgcgtttgccttcaaaactatcgttgcgggtttgcagcatcgcttgggcgaaatagacgcagccgtagccggtcgcctcggggcggatgaggctgccaccccattccaaacctttgccggtcaggacggaagtgaattcattgcggatttttttgtattgtccgaacaggtagccgatttcgcgtccgcctacgccgatgtcgccggccggaacatcggtgtccgcgccgatgtggcggtagagttcggtcataaaggcttggcagaagcgcattacttcggcatcggatttgcctttggggtcgaagtcggaaccgcctttgccgccgcccataggcagggtggtcaaggcgtttttgaacacttgttcaaaagcgaggaatttcaacacgcccaaatcgacggtcgggtggaagcgcaggccgcctttgtaagggccgatggcggaactcatttgcacgcggtagccgcggttgacttggacttgtcctttgtcgtcctgccaggttacgcggaacatcacgacgcgttcgggttcgacgatgcgttccagcaggctttgctgggtgtatttcggattttttgccaaaaacggatcaaggctcatgaagacttcttcaaccgcctgatggaacggctcctgattggggttgcgttgtttgaggttggcaaacagggtgttcaggtcagtcattcggatactccttttggt

SEQ ID NO: 2432 - protein, 414 aa, Neisseria gonorrhoeae
VDALHDAEQSAVHFFARPRQADGVLAHFQARSCHAAGVGGFARSVEDAGFDKLLDRAQSRRHIRAFGNDVAAVCQQGFGGFFVQFVLGRAGQGDFGGNAPRFLVFKVLQTLLFGVGGNAFAADFFQFDQGGELRFGHTDVGEEDEAVGVGDGQHFRTQLDGFFSGVLRHVAGTGNQNAFAFKTIVAGLQHRLGEIDAAVAGRLGADEAATPFQTFAGQDGSEFIADFFVLSEQVADFASAYADVAGRNIGVRADVAVEFGHKGLAEAHYFGIGFAFGVEVGTAFAAAHRQGGQGVFEHLFKSEEFQHAQIDGRVEAQAAFVRADGGTHLHAVAAVDLDLSFVVLPGYAEHHDAFGFDDAFQQALLGVFRIFCQKRIKAHEDFFNRLMERLLIGVALFEVGKQGVQVSHSDTPFG

SEQ ID NO: 2433 - DNA, 1518 bp, Neisseria gonorrhoeae
ttgaaccctatgccgtctgaagacagattcccgttttcagacggcatttttatcagcccggcacatttgtttgttaaaatcgcagccatattgcaaaaaagaggaggaagccatgcaaaccgccattatcgattacggtatgggcaacctgcattccgtattgaaatccgtccggacggcggggcagcttgccggaaaaaataccaaaatctttttaagcggcgaccccgaccgcgtgtcccgcgccgacaaagtcatttttcccgggcagggcgcgatgcccgactgtatggcggcactgacgcgcggcggcttggacgaggcagtcaaagacgccttaaaaaacaaaccgtttttcggaatctgcgtcggtgcgcaacttttattcgaccacagcgaagaaggaaacaccgacggcttgggctggttcggcggcaaagtcagacgctttgcccgcgacctccgcgacccgcagggatgccgtctgaaagtcccgcatatgggctggaacaccgtgcgccaaacccaaaaccacccgctttttcaaggcatcccccaaaacacgcgtttttatttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactggtaagccggacacggccccgcacaaggagaaaaactatgctgctgatacccgccatcgatttgaaagaaggacgttgcgtccgcttgaaacaagggctgatggaagaggcgaccgtcttttccgattcgcccgccgacaccgcgctgcactggttcgaacaaggcgcgcgccgcctgcacctggtagatttgaacggcgcatttgccggcgttccgcaaaacctgcccgccatcaaagacatcctcgccgccgtcgccaaagacatccccgtgcagctcggcggcggcatgcgcgatttgaaaaccatcggacaatatttggatttgggactgaacgacgtgattatcggcacggcggcagtcaaaaaccccgacttggtgcgcgaagcgtgcaaagccttccccggcaggattatcgtcggactggatgccaaagacggtatggccgccatcgacggctgggcaaccgtaaccgggcatcatgtaattgatttggcaaaacgctttgaagacgacggtgtcaacagcatcatctacaccgacatcgggcgcgacggtatgatgagcggcgtgaacatcgacgcgacggtcaaactcgcccaatccgtccgcattcccgtcatcgcctccggcggactgaccggcttggacgacatccgcgccctgtgtgccgccgaaaaacatggcgtagcaggcgcgattaccggccgcgcgatttacgagggcagcatcgattttgcccaagcgcagcaactggcagattccctcgac

SEQ ID NO: 2434 - protein, 506 aa, Neisseria gonorrhoeae
LNPMPSEDRFPFSDGIFISPAHLFVKIAAILQKRGGSHANRHYRLRYGQPAFRIEIRPDGGAACRKKYQNLFKRRPRPRVPRRQSHFSRAGRDARLYGGTDARRLGRGSQRRLKKQTVFRNLRRCATFIRPQRRRKHRRLGLVRRQSQTLCPRPPRPAGMPSESPAYGLEHRAPNPKPPAFSRHPPKHAFLFRPQLLFRPRKSRNHIGRKRLPVPVCLHRRQRQRIRHAISHRKKPRCRADDVEKLFKLVSRTRPRTRRKTMLLIPAIDLKEGRCVRLKQGLMEEATVFSDSPADTALHWFEQGARRLHLVDLNGAFAGVPQNLPAIKDILAAVAKDIPVQLGGGMRDLKTIGQYLDLGLNDVIIGTAAVKNPDLVREACKAFPGRIIVGLDAKDGMAAIDGWATVTGHHVIDLAKRFEDDGVNSIIYTDIGRDGMMSGVNIDATVKLAQSVRIPVIASGGLTGLDDIRALCAAEKHGVAGAITGRAIYEGSIDFAQAQQLADSLD

SEQ ID NO: 2435 - DNA, 1632 bp, Neisseria gonorrhoeae
ttgtttgctatattcaacctgcgcgccccaagccaaacacggcacgcacggcacgcaggcagccgtttctgcccatatgccgccccttccaaccacatatgccgcacaccgcagcatacgaaaggatatattatggcaaaagtactcgtcgtacccgtatctgccggactgaacacctccgccgccgcacaagcctttgcaaaagcactggacgcacaagttttccaagccgttgacgcaaccgccgaaaccctgctcgcgcaaggcaaaagcgacgactggttcgacgcactggtcggcaaagttgccgcactcgatgccgccaacctcgtcatcgaaggcatcgcgcccgatgccgacaaaatctatctcgcaggcaaaaacgtcgaactggcattgtcccttgacgcggcagccgtcttcgccgtccgttccgacaataccgatgccgacgcgctggcacaccaattgaaccttgccaaacagttcttcgccgccgcgccgggcgtattggaaggttttgtcgtggacggtgcggcagcctccgttgccgaagcggcagccgagaaaaccggcctgaccttcttcggttcgagcgacgcgctgaaagacgtatccgtattggcaggccgcgaagcaaaacgcctgtcgccggcgcaattccgctacaacctgatcgacttcgcccgccaagccggcaaacgcatcgtcctgcctgaaggcgcagaaccccgcaccgtccaagccgccgccatctgccacgaaaaaggcattgcccgctgcgtcctgcttgccaaacgcgaagaagtcgaagccgttgccaaagaacgcggcatcagcctgcccgactctttggaaatcatcgatcccgcctcattggtcgaacaatacgtcgagccgatgtgcgaactgcgcaaatccaaaggcctgacacccgaagacgcgcgcaagcaactgcaagacaccgtggtactcggtacgatgatgatggcgcaaaatgatgtggacggtttggtatccggtgcggttcacaccaccgccaacaccatccgccccgctttgcaactgattaaaaccgcaccgggcgcaagcctcgtatccagcgtattctttatgctgctaccaaatcaggttctggtgttcggcgactgcgcggttaatccgaacccgaccgcgcaacagcttgccgacatcgccatccagtctgccgattccgcaaaagccttcggcatcgacccgaaagtggcgatgatttcctactccaccgtcaactccggcagcggccccgatgtcgataccgtcatcgaagccaccaaacttgcccgggaaaaacgccccgacctcgccatcgacggcccgctgcaatatgacgcggcaaccgtgccgggcgtaggcaaatccaaagccccgggcagcccggtggcaggacaggcaaccgttttggtcttccccgacctgaacaccggcaactgcacctataaagccgtccaacgcagtgccaacgtcttgagcgtcggcccgctgctgcaaggcctgcgcaaaccggtcaacgacctgtctcgcggcgcgctggtggaagacatcgtgttcaccatcgccctgactgccgttcaggcaaaacaaatggaaggc

SEQ ID NO: 2436 - protein, 544 aa, Neisseria gonorrhoeae
LFAIFNLRAPSQTRHARHAGSRFCPYAAPSNHICRTPQHTKGYIMAKVLVVPVSAGLNTSAAAQAFAKALDAQVFQAVDATAETLLAQGKSDDWFDALVGKVAALDAANLVIEGIAPDADKIYLAGKNVELALSLDAAAVFAVRSDNTDADALAHQLNLAKQFFAAAPGVLEGFVVDGAAASVAEAAAEKTGLTFFGSSDALKDVSVLAGREAKRLSPAQFRYNLIDFARQAGKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSPVAGQATVLVFPDLNTGNCTYKAVQRSANVLSVGPLLQGLRKPVNDLSRGALVEDIVFTIALTAVQAKQMEG

SEQ ID NO: 2437 - DNA, 1056 bp, Neisseria gonorrhoeae
atgaccgccgccctgcacatcggacacctgtccaaaagttttcaaaacaccccggttttaaacgacatttcgctcagcctcgacccgggcgaaattctctttatcatcggcgcgtccggctgcggcaaaaccacccttttacgctgccttgccggtttcgaacaacccgattccggcgaaatttcgctttccggcaaaaccatcttctcgaaaaataccaaccttcccgtccgcgaacgccgtttgggttacctcgtacaggaaggcgtgctgttcccccacctgaccgtttaccgcaatatcgcctacggtctcggcaacggcaaaggcaggacggcgcaagagcgacagcgcatcgaagccatgttggaattgaccggcatttccgaacttgccggacgctatccgcacgaactttcgggcggacaacaacagcgcgtcgccctcgcccgcgccctcgcccccgaccccgaactgattttgttggacgaacccttcagcgcgctggacgaacagttgcgccgccagattcgcgaagacatgattgccgccctgcgcgccaacggcaaatccgccgtttttgtcagccacgaccgcgaagaagccctgcaatacgccgaccggattgccgtgatgaaacaggggcgcatcctccaaaccgcaagccctcacgaattgtaccgacaacctgccgaccttgatgccgccctgtttatcggcgaaggcatcgtgttccccgccgcgctcaacgccgacggcaccgccgattgcagattgggccgcctgcccgtccaaagcggcgcacccgcaggcacgcgcggtacactgctcatccgtccggaacagttcagccttcacccccattccgcacccgccgcctccattcacgccgtggttctcaaaaccacgcccaaagcgcggcataccgaaatcagcctcagggccggacaaaccgtcctcacgctcaacctcccttccgcccccaccctgtcagacggcatttccgccgtcctccatttggacggtcccgccctgttcttccccggaaataccctc

SEQ ID NO: 2438 - protein, 352 aa, Neisseria gonorrhoeae
MTAALHIGHLSKSFQNTPVLNDISLSLDPGEILFIIGASGCGKTTLLRCLAGFEQPDSGEISLSGKTIFSKNTNLPVRERRLGYLVQEGVLFPHLTVYRNIAYGLGNGKGRTAQERQRIEAMLELTGISELAGRYPHELSGGQQQRVALARALAPDPELILLDEPFSALDEQLRRQIREDMIAALRANGKSAVFVSHDREEALQYADRIAVMKQGRILQTASPHELYRQPADLDAALFIGEGIVFPAALNADGTADCRLGRLPVQSGAPAGTRGTLLIRPEQFSLHPHSAPAASIHAVVLKTTPKARHTEISLRAGQTVLTLNLPSAPTLSDGISAVLHLDGPALFFPGNTL

SEQ ID NO: 2439 - DNA, 1515 bp, Neisseria gonorrhoeae
atgtctcctaaaaaaatacccatttggcttaccggcctcatcctactgatcgccctgccgcttaccctgccttttttatatgtcgctatgcgttcgtggcaggtcggcatcaaccgcgccgtcgaactgttgttccgcccgcgtatgtgggatttgctctccaacaccttgacgatgatggcgggcgttaccctgatttccattgttttgggcattgcctgcgcccttttgttccaacgttaccgcttcttcggcaaaaccttttttcagacggcaatcaccctgcctttgtgcatccccgcatttgtcagctgtttcacctggatcagcctgaccttccgcgtcgaaggattttgggggacagtgatgattatgagcctgtcctcgtttccgctcgcctacctgcccgtcgaggcggcactcaaacgcatcagcctgtcttacgaagaagtcagcctgtccttgggcaaaagccgcctgcaaacctttttttccgccatcctcccacagctcaaacccgccatcggcagcagcgtgttactgatcgccctgcatatgctggtcgaatttggcgcggtatccattttgaactaccccacttttaccactgccattttccaagaatacgaaatgtcctacaacaacaataccgccgccctgctttccgctgttttgacggcggtgtgcggcatcgtcgtatttggagaaagcatatttcgcggcaaagccaagatttaccacagcggcaaaggcgttgcccgtccttatcccgtcaaaaccctcaaactgcccggtcagatcggcgcgattgtttttttaagcagcttgttgattttgggcattattatcccctttggcgtattgatacattggatgatggtcggcacttccggcacattcgcgctcgtatccgtatttgatgcctttatccgttccttaagcgtatcggctttaggtgcgattttgactatattatgtgccttgccccttgtttgggcatcggttcgctatcgcaattttttaaccgtttggatagacaggctgccgtttttactgcacgccgtccccggtttggttatcgccctatccttggtttatttcagcatcaactacacccctgccgtttaccaaacctttatcgtcgtcatccttgcctatttcatgctttacctgccgatggcgcaaaccaccctgaggacttccttggaacaactccccaaagggatggaacaggtcggcgcaacattggggcgcggacacttctttattttcaggacgttggtactgccgtccatcctgcccggcattaccgccgcattcgcactcgtcttcctcaagctgatgaaagagttgaccgccaccctgctgctgaccgccgacgatgtccacacgctctccaccgccgtttgggaatacacatcggacgcacaatacgccgccgccaccccttacgcgctgatgctggtattattttccggcatacccgtattcctgctgaagaaatacgccttcaaa

SEQ ID NO: 2440 - protein, 505 aa, Neisseria gonorrhoeae
MSPKKIPIWLTGLILLIALPLTLPFLYVAMRSWQVGINRAVELLFRPRMWDLLSNTLTMMAGVTLISIVLGIACALLFQRYRFFGKTFFQTAITLPLCIPAFVSCFTWISLTFRVEGFWGTVMIMSLSSFPLAYLPVEAALKRISLSYEEVSLSLGKSRLQTFFSAILPQLKPAIGSSVLLIALHMLVEFGAVSILNYPTFTTAIFQEYEMSYNNNTAALLSAVLTAVCGIVVFGESIFRGKAKIYHSGKGVARPYPVKTLKLPGQIGAIVFLSSLLILGIIIPFGVLIHWMMVGTSGTFALVSVFDAFIRSLSVSALGAILTILCALPLVWASVRYRNFLTVWIDRLPFLLHAVPGLVIALSLVYFSINYTPAVYQTFIVVILAYFMLYLPMAQTTLRTSLEQLPKGMEQVGATLGRGHFFIFRTLVLPSILPGITAAFALVFLKLMKELTATLLLTADDVHTLSTAVWEYTSDAQYAAATPYALMLVLFSGIPVFLLKKYAFK

SEQ ID NO: 2441 - DNA, 993 bp, Neisseria gonorrhoeae
atgaaaacatctatccgatacgcactgcttgccgcagccctgaccgccgccacccccgcgctggcagacattaccgtgtacaacggccaacacaaagaagcggcacaagccgttgcagatgcctttacccgggctaccggcatcaaagtcaaactcaacagtgccaaaggcgaccagcttgccggccaaatcaaagaagaaggcagccgaagccccgccgacgtattctattccgaacaaatcccggcactcgccaccctttccgcagccaacctcctagagcccctgcccgcctccaccatcaacgaaacacgcggcaaaggcgtgccggttgccgccaaaaaagactgggtggcactgagcggacgttcgcgcgtcgtcgtttacgacacccgcaaactgtctgaaaaagatttggaaaaatccgtcctgaattacgccacgccgaaatggaaaaaccgcatcggttacgtccccacttccggcgcgttcttggaacagattgtcgccatcgtcaaactgaaaggcgaagcggccgcattgaaatggctcaaaggcctgaaagaatacggcaagccttacgctaaaaactccgtcgcccttcaagcggttgaaaacggcgaaatcgatgccgccctcatcaacaactactactggcacgctttcgcgcgtgaaaaaggcgtacaaaatgtccacacccgcctgaatttcgtccgccacagagatcccggcgcactcgttacctattccggcgcagccgtgttaaaatcctcccaaaacaaggatgaggcgaaaaaattcgtcgccttcctcgccggcaaggaaggacagcgcgccctgaccgccgtccgtgccgaatatcctttgaatccgcacgtggtatccaccttcaatttggaacccatcgccaagttggaagcaccccaagtgtccgccaccactgtttccgaaaaagaacacgccacccggctgcttgagcaagccggtatgaaa

SEQ ID NO: 2442 - protein, 331 aa, Neisseria gonorrhoeae
MKTSIRYALLAAALTAATPALADITVYNGQHKEAAQAVADAFTRATGIKVKLNSAKGDQLAGQIKEEGSRSPADVFYSEQIPALATLSAANLLEPLPASTINETRGKGVPVAAKKDWVALSGRSRVVVYDTRKLSEKDLEKSVLNYATPKWKNRIGYVPTSGAFLEQIVAIVKLKGEAAALKWLKGLKEYGKPYAKNSVALQAVENGEIDAALINNYYWHAFAREKGVQNVHTRLNFVRHRDPGALVTYSGAAVLKSSQNKDEAKKFVAFLAGKEGQRALTAVRAEYPLNPHVVSTFNLEPIAKLEAPQVSATTVSEKEHATRLLEQAGMK

SEQ ID NO: 2443 - DNA, 108 bp, Neisseria gonorrhoeae
gtgtattccttcttttttataaatgcaaataattattttttaaatttgttattatccgatccggttattgtttgttctgacttgtattttttccgtgcatcgcgcccg

SEQ ID NO: 2444 - protein, 36 aa, Neisseria gonorrhoeae
VYSFFFINANNYFLNLLLSDPVIVCSDLYFFRASRP

SEQ ID NO: 2445 - DNA, 537 bp, Neisseria gonorrhoeae
ttgtcggaatgctggagaacctctccctttaaaacgccgtctgaacaaggttgccggaatagtattgccatcccggcagatacagtttgtcgggatcttgccaatattgttcatccagactgttcggcagcgaggcggttttgttgtcgagatgttttgttaatccactatatatcccacatttcttttaggtttttaccttccgattggaggtggcggatttcttttcccaatgcgtctgccgcccgatggatcagcattgcgctgtgtaccgcgccgatttttttcagaacggaacaagtcttttcggcggcgggaaaaccccagttgcagacaaattgcagtatgccgccgttgccgatgtcggcttccgcccgccaaatcaaaaccagctcctgttcccgtccgtccatgctttcgagtttgccgtcatgctgttcaaaaagtttgtccaccgcctgccgcatcatctgctcgaagcggtcggcttgggtatccgtatcggtcataatattcttgccttttaaaaatgccgtc

SEQ ID NO: 2446 - protein, 179 aa, Neisseria gonorrhoeae
LSECWRTSPFKTPSEQGCRNSIAIPADTVCRDLANIVHPDCSAARRFCCRDVLLIHYISHISFRFLPSDWRWRISFPNASAARWISIALCTAPIFFRTEQVFSAAGKPQLQTNCSMPPLPMSASARQIKTSSCSRPSMLSSLPSCCSKSLSTACRIICSKRSAWVSVSVIIFLPFKNAV

SEQ ID NO: 2447 - DNA, 339 bp, Neisseria gonorrhoeae
atgaccgatacggatacccaagccgaccgcttcgagcagatgatgcggcaggcggtggacaaactttttgaacagcatgacggcaaactcgaaagcatggacggacgggaacaggagctggttttgatttggcgggcggaagccgacatcggcaacggcggcatactgcaatttgtctgcaactggggttttcccgccgccgaaaagacttgttccgttctgaaaaaaatcggcgcggtacacagcgcaatgctgatccatcgggcggcagacgcattgggaaaagaaatccgccacctccaatcggaaggtaaaaacctaaaagaaatgtgggatata

SEQ ID NO: 2448 - protein, 113 aa, Neisseria gonorrhoeae
MTDTDTQADRFEQMMRQAVDKLFEQHDGKLESMDGREQELVLIWRAEADIGNGGILQFVCNWGFPAAEKTCSVLKKIGAVHSAMLIHRAADALGKEIRHLQSEGKNLKEMWDI

SEQ ID NO: 2449 - DNA, 1374 bp, Neisseria gonorrhoeae
atgcacgacaaaacctggtccggacgtttcaacgaacccgtttccgaactcgtcaaacaatacaccgcctccatcggtttcgaccaacgccttgccgaatgggacatccaaggctcgctcgcccacgcgcagatgctgacccggtcgggtgtgctgagtgaaaacgatctgaccgacatccgtcggggcatgtcggaaatcctcgaagaaatccgcagcggcaaaatcgaatggccgctcgatttggaagatgtccacatgaacatcgaacgccgcctgaccgacaaaatcggcgacgcgggcaaacgcctgcacaccggccgcagccgcaacgaccaagtcgccaccgacatccgcctttggctgcgcgaccagattaccgttatccaaaacctgattcaaaaccttcagacggcattattggatttggcggaacaaaacgccgaagccgtcatgcccggttttacccatctgcaagtcgcccagccggtcagcttcggacaccacatgctcgcctacgtcgaaatgctcggacgcgatttcgaacgcatgaccgactgtcgcaaacgcgtcaaccgtatgccgctcggcgctgccgcccttgccggtacgacctatccgattcagcgcgaaatcaccgccgaattgttgggtttcgaacaaatctgccagaactcgctcgatgccgtatccgaccgcgattttgccattgagttcaccgccgccgcctcgctggttatggttcacttgagccgcctgtctgaagaattgattttgtggatgagtccgcgtttcggctttatcgacatcgccgaccgcttctgtacgggttcgtccatcatgccgcaaaagaaaaaccccgacgtacccgaactcgtgcgcggtaaatccggccgagtcatcggacaccttatcggcctgattaccctgatgaaatcgcagcccttggcatacaacaaagacaatcaggaagacaaagaaccgctgtttgacaccgccgacacgctcatcgacacgctgcggatttacgccgatatgatgcgcggcgtaaccgtcaaacccggcaatatgcgcgccgccgtgatgcagggttttgccaccgccaccgacttggcggattatctggtcaaaaaaggtatgcccttccgcgatgcccacgaagtcgttgcccaagccgtgcgccacgccgatgaagccggcgttgatttgagcgaattgccgctcgaagccctgcaaggcttcagcaagctgatttcagacgacgtgtacggcgttctgacacccgaaggcagcctcaacgcgcgcaaccacttgggcggcaccgcgcccgaacaggtacgcctccaagtcaaacgctggcgggaaatgtcagct

SEQ ID NO: 2450 - protein, 458 aa, Neisseria gonorrhoeae
MHDKTWSGRFNEPVSELVKQYTASIGFDQRLAEWDIQGSLAHAQMLTRSGVLSENDLTDIRRGMSEILEEIRSGKIEWPLDLEDVHMNIERRLTDKIGDAGKRLHTGRSRNDQVATDIRLWLRDQITVIQNLIQNLQTALLDLAEQNAEAVMPGFTHLQVAQPVSFGHHMLAYVEMLGRDFERMTDCRKRVNRMPLGAAALAGTTYPIQREITAELLGFEQICQNSLDAVSDRDFAIEFTAAASLVMVHLSRLSEELILWMSPRFGFIDIADRFCTGSSIMPQKKNPDVPELVRGKSGRVIGHLIGLITLMKSQPLAYNKDNQEDKEPLFDTADTLIDTLRIYADMMRGVTVKPGNMRAAVMQGFATATDLADYLVKKGMPFRDAHEVVAQAVRHADEAGVDLSELPLEALQGFSKLISDDVYGVLTPEGSLNARNHLGGTAPEQVRLQVKRWREMSA

SEQ ID NO: 2451 - DNA, 867 bp, Neisseria gonorrhoeae
atgaaaccgataaaaaaagccgtcttccccgttgcagggatgggaacccgcttcctgcccgccaccaaggccaacccgaaagaaatgctgcccatcgtcgacaagccgctgatccaatacgccgtagaagaagccgtggaagccggctgcacggaaatggtgtttgttaccgggcgcaacaagcgcagcatcgaagaccatttcgacaaggcatacgaactcgaaactaagttggaaatgcgccataaagacaaattgttggaacacgtccgcaacatcctgccgccgaacattacctgcctctacatccgtcaggcggaagcactgggattgggacacgccgtcttgtgcgcccgcgccgccatcggcgacgaacccttcgccgtcatccttgccgacgacttaatcgatgcgcccaaaggcgcgctcaaacaaatggtcgaagtgtacgggcgcagcggtaacagcattttgggcgtagaaaccgtcgaaccgtcgcaaaccggctcatacggcatcgtcgaaaccgaacagctcaaacagttccaacgcattaccggcattgtcgaaaaacccaagcccgaagacgcgccctccaaccttgccgttgtcggacgctacatcctcaccccgcgcattttcgaccttttaaccggcctgccgcgcggcgcgggcaacgaaatccagcttacagacggcatcgccaagctgctcgatcacgaatttgtcttggcgcacccctttgaaggcacgcgctacgactgcggcagcaaactcggctatctcgaagccaccgtcgcctacggtttaaaacaccccgaaaccggcgaacccttccgccgccttttggaaaaataccgcaccgaa

SEQ ID NO: 2452 - protein, 289 aa, Neisseria gonorrhoeae
MKPIKKAVFPVAGMGTRFLPATKANPKEMLPIVDKPLIQYAVEEAVEAGCTEMVFVTGRNKRSIEDHFDKAYELETKLEMRHKDKLLEHVRNILPPNITCLYIRQAEALGLGHAVLCARAAIGDEPFAVILADDLIDAPKGALKQMVEVYGRSGNSILGVETVEPSQTGSYGIVETEQLKQFQRITGIVEKPKPEDAPSNLAVVGRYILTPRIFDLLTGLPRGAGNEIQLTDGIAKLLDHEFVLAHPFEGTRYDCGSKLGYLEATVAYGLKHPETGEPFRRLLEKYRTE

SEQ ID NO: 2453 - DNA, 1254 bp, Neisseria gonorrhoeae
aaaattcctgtttttatcaaatatttcaaacagtttttccttgtcggcacaagacccatccggtatcaggtccaatatcgtttccaacgcctcggcaatatcttcccgctctaccgtgtcgataaagtgttttttgtccattttgttgaaacctccggtataggctttgaccgcctctgccagcccctcccctatgttttcaggcggattgccgagcagtttgaccacgccggcacgggttttccggtacagctccgccgcttttttggcatggcttttcgggatatgctccgcgccgtcccaatcgcggaaggggttgtcgaaattttgcgccagccattcgggttttcgggctttttctatccacgggtccagcccgtcttccttccgtttcttataaagtttcttcactgccttcgccgcctcttcgggcaggctgctcatccacagcctgtgcagcttcggcagccggtcgggatgagggatgtcgtccgcgccgaaaccgaacaaatctacggcagtgaacacttccaaatcctcaaatcccgatacggcggaaaaattggcgatattgcccggtttgccccacagccgtatggttttgagcttgggatacgtttccgacaggttttgcatatcgaaatcggcaatgcccatgacgttgacggcggtcaggttttccaaaccccgcactttgggaacgcttttgcccacttccaaaatcagacccgcgccctttccggcggtacagaccttgcagttttccttgatttcgcctttcaggttcaggctgtccaagccttcgttcaaataaagcgattccacgccggtcatatcgacagaaaggtcggttatgcgcgtattgctgaaatccagcacggtctgaccgtggttttccagacacaatcgggtgataaacggatattcctccagatattcatatagatttttatgccacttggtcagaaacagcgaagacaggcagggaaacgccttcagttccatcgcgtcttcaaaatcatcccaaacatcgctcaaattctgtttggatatgccgtattcccgtccggcaaacatcacggtatttttgcttttggcggcttttttgaatgcctttctctgtttttcgggtatctgccgccatctcaactgacggtacacgtcgtagccgtcgccccaaaaagaggcataccgctgcgtgtcttcgccgcacagcggcgcggtattcccaacccgtacatatcccgtcggcac

SEQ ID NO: 2454 - protein, 314 aa, Neisseria gonorrhoeae
KIPVFIKYFKQFFLVGTRPIRYQVQYRFQRLGNIFPLYRVDKVFFVHFVETSGIGFDRLCQPLPYVFRRIAEQFDHAGTGFPVQLRRFFGMAFRDMLRAVPIAEGVVEILRQPFGFSGFFYPRVQPVFLPFLIKFLHCLRRLFGQAAHPQPVQLRQPVGMRDVVRAETEQIYGSEHFQILKSRYGGKIGDIARFAPQPYGFELGIRFRQVLHIEIGNAHDVDGGQVFQTPHFGNAFAHFQNQTRALSGGTDLAVFLDFAFQVQAVQAFVQIKRFHAGHIDRKVGYARIAEIQHGLTVVFQTQSGDKRIFLQIFI

SEQ ID NO: 2455 - DNA, 252 bp, Neisseria gonorrhoeae
ttgggaggtatgaataccgttcagacggtctggcatattcggatgtatcggtatagtgaactaaatttaaaccagtacggcgttgcctcgccttgccgtactatttgtactgtctgcggctcgccgccttgtcctgatttaaatttaattcactatagtattacccgattcgaacgggcggataatgaaatgccgtctgaacagcatttgcggttcggacggcattttgtttgcggggcggaggcgtttgct

SEQ ID NO: 2456 - protein, 84 aa, Neisseria gonorrhoeae
LGGMNTVQTVWHIRMYRYSELNLNQYGVASPCRTICTVCGSPPCPDLNLIHYSITRFERADNEMPSEQHLRFGRHFVCGAEAFA

SEQ ID NO: 2457 - DNA, 681 bp, Neisseria gonorrhoeae
atggaattggtatttatccgccacggacaaagcgaatggaacgcgaaaaacctgtttacaggctggcgcgacgtgaagctgagcgagcaggggcttgccgaggccgccgccgccggtaaaaaactgaaagaaaacggctatgagttcgacatcgccttcacatccgtcctgacccgcgcgattaagacctgcaacatcgttttggaagaatccgaccaactgttcgtaccgcaaatcaaaacatggaggctgaacgaacgccactacggccgactgcaaggtttggacaaaaaacaaaccgccgaaaaatacggcgacgagcaagtccgcatctggcggcgcagctacgacaccctgccgccgcttttggacaaagacgacgcgttttccgcacacaaagaccgtcgctatgcccatctgcctgccgatgtcgtacccgacggcgaaaacctgaaagtaacgctggagcgcgtattaccgttttgggaagaccaaatcgcccccgcgattttgagcggcaaacgcgtcttggtagcggcgcacggcaactccctgcgcgcgctggcaaaacacatcgagggcatttccgacgaagacatcatgggcttggaaatcccgaccggccagccgctggtgtacaaattagacgacaacctgaaagtcatcgagaaattttacctg

SEQ ID NO: 2458 - protein, 227 aa, Neisseria gonorrhoeae
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEKYGDEQVRIWRRSYDTLPPLLDKDDAFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 2459 - DNA, 597 bp, Neisseria gonorrhoeae
atgtctgaaaaaccggaaaaaatcgttttggcaagcggcaatgccggcaagctcaaagaattcggcaacttattcaaaccttacggcatcaccgtattgccgcaatccgcattcggcatacccgaatgccccgaaccctatcccacctttgtcgaaaacgcgctggcaaaagcccggcacgccgccggacacagcgggctgcccgcactcgccgacgacagcggcatctgtgccgccgccctaaacggcgcgccgggcatccattccgcacgttacgccggcagcaatcccaaatccgataccgccaacaacctgaaacttgccgccgaacttgccggcaaggccgacaaaagttgttcttatgtctgcgtattggtttttgtccgtcataaagacgacccgcgcccgattatcgccgagggcatatggcacggacaatggcacgacacgccgctcgggcaaaacggtttcggttacgacccgtatttttatctgcccgaacacggcaaaaccgccgccgaattggattcggaggtcaaaaaccgcgaaagccaccgcgcgcaggcactcgccgatttaatccgcaaactcgccctt

SEQ ID NO: 2460 - protein, 199 aa, Neisseria gonorrhoeae
MSEKPEKIVLASGNAGKLKEFGNLFKPYGITVLPQSAFGIPECPEPYPTFVENALAKARHAAGHSGLPALADDSGICAAALNGAPGIHSARYAGSNPKSDTANNLKLAAELAGKADKSCSYVCVLVFVRHKDDPRPIIAEGIWHGQWHDTPLGQNGFGYDPYFYLPEHGKTAAELDSEVKNRESHRAQALADLIRKLAL

SEQ ID NO: 2461 - DNA, 231 bp, Neisseria gonorrhoeae
atgaaccgccgaaaaatctatctgttgtctgttgccttgttcacactggcatttatgctgcccgtcctcttgggtgcttatctgctgaccgccggcagcaaaaccttcgccgtcgcgtccttccttttcgcattcggcgcgctgttcgggcaaatcggcgcactcgccctctacctgcggcacaaatccctacgcgccgccccatcttcatcacagggaaaccgctatgtc

SEQ ID NO: 2462 - protein, 77 aa, Neisseria gonorrhoeae
MNRRKIYLLSVALFTLAFMLPVLLGAYLLTAGSKTFAVASFLFAFGALFGQIGALALYLRHKSLRAAPSSSQGNRYV

SEQ ID NO: 2463 - DNA, 579 bp, Neisseria gonorrhoeae
ttgtgctatactttcaaacttcaaaccttcccaaataaaggaaaccaaatggcagacttcaaccaaatcctgaccccgggcgacgtggacggcggcatcatcaacgtcgtcaacgaaatccccgccggcagcaaccacaaaatcgagtggaaccgcaaactcgccgcattccaactcgaccgcatcgaacccgccatcttcgccaaaccgaccaactacggcttcatcccccaaactttggacgaagacggcgatgaattggacgtgttgctcgttaccgaacaacctctggcaaccggcgtattcttggaagcgcgcgttatcggcgtgatgaaattcgtcgacgacggcgaagtggacgacaaaatcgtctgcgtacctgccgacgaccgcaataacggcaacgcctacaaaactttgtccgatttgccgcaacagctcatcaaacaaatcgagttccacttcaaccactacaaagacctgaaaaaagcgggtacgaccaaagtcgaatcctggggcggtgcggaagaagcgaaaaaagtcatcaaagaatccatcgaacgttggaacaaacaggca

SEQ ID NO: 2464 - protein, 193 aa, Neisseria gonorrhoeae
LCYTFKLQTFPNKGNQMADFNQILTPGDVDGGIINVVNEIPAGSNHKIEWNRKLAAFQLDRIEPAIFAKPTNYGFIPQTLDEDGDELDVLLVTEQPLATGVFLEARVIGVMKFVDDGEVDDKIVCVPADDRNNGNAYKTLSDLPQQLIKQIEFHFNHYKDLKKAGTTKVESWGGAEEAKKVIKESIERWNKQA

SEQ ID NO: 2465 - DNA, 456 bp, Neisseria gonorrhoeae
atgccgatggcaaaaccgctcaaataccccgtttccgcactggtcgtcctttatagcggggacggcggcatcctgctcatcgaacgcacgcatccgaaaggattttggcagtcggtaaccggcagcctcgaaccgggcgaaaccgtcgcccaaacggcaaggcgcgaagtttgggaagaaaccggcatcctgctggaggacgggcagctccaagaccggcacgacagcacggtttacgaaatctaccaccactggcggcaccgctaccccaaaggcgtgtttgaaaaccgcgaacacgtcttccgggccgaaatcccgcgcgatacgcccgtcgtcctgcaacccgaggaacacgtctcctacggctggttcggcttggaagaagcggcggaaaaagtgttttccccgtccaacaggcgcgcgattttggaactgggcaggtttttgggcaaacgg

SEQ ID NO: 2466 - protein, 152 aa, Neisseria gonorrhoeae
MPMAKPLKYPVSALVVLYSGDGGILLIERTHPKGFWQSVTGSLEPGETVAQTARREVWEETGILLEDGQLQDRHDSTVYEIYHHWRHRYPKGVFENREHVFRAEIPRDTPVVLQPEEHVSYGWFGLEEAAEKVFSPSNRRAILELGRFLGKR

SEQ ID NO: 2467 - DNA, 639 bp, Neisseria gonorrhoeae
atgcgtccgatgccgtctgaaagggaaaccgggcgcgtgttaccgtttgcccaaaaacctgcccagttccaaaatcgcgcgcctgttggacggggaaaacactttttccgccgcttcttccaagccgaaccagccgtaggagacgtgttcctcgggttgcaggacgacgggcgtatcgcgcgggatttcggcccggaagacgtgttcgcggttttcaaacacgcctttggggtagcggtgccgccagtggtggtagatttcgtaaaccgtgctgtcgtgccggtcttggagctgcccgtcctccagcaggatgccggtttcttcccaaacttcgcgccttgccgtttgggcgacggtttcgcccggttcgaggctgccggttaccgactgccaaaatcctttcggatgcgtgcgttcgatgagcaggatgccgccgtccccgctataaaggacgaccagtgcggaaacggggtatttgagcggttttgccatcggcatctttcggcgggctgcggtaatgaaggggcggattatagcaaacgccgcacgttatggcgtttatccttttccgtatccttttttctgcacggatgggacgcgccggtgtttgccggtaaattttcctttgtgtcaaaaaga

SEQ ID NO: 2468 - protein, 213 aa, Neisseria gonorrhoeae
MRPMPSERETGRVLPFAQKPAQFQNRAPVGRGKHFFRRFFQAEPAVGDVFLGLQDDGRIARDFGPEDVFAVFKHAFGVAVPPVVVDFVNRAVVPVLELPVLQQDAGFFPNFAPCRLGDGFARFEAAGYRLPKSFRMRAFDEQDAAVPAIKDDQCGNGVFERFCHRHLSAGCGNEGADYSKRRTLWRLSFSVSFFLHGWDAPVFAGKFSFVSKR

SEQ ID NO: 2469 - DNA, 213 bp, Neisseria gonorrhoeae
ttgagcggttttgccatcggcatctttcggcgggctgcggtaatgaaggggcggattatagcaaacgccgcacgttatggcgtttatccttttccgtatccttttttctgcacggatgggacgcgccggtgtttgccggtaaattttcctttgtgtcaaaaagataagggcggttgtgattttaatgcttgccaaagtgacgggcggaaacta

SEQ ID NO: 2470 - protein, 71 aa, Neisseria gonorrhoeae
LSGFAIGIFRRAAVMKGRIIANAARYGVYPFPYPFFCTDGTRRCLPVNFPLCQKDKGGCDFNACQSDGRKL

SEQ ID NO: 2471 - DNA, 195 bp, Neisseria gonorrhoeae
gtgtggcgcagtctggtagcgcacttgcatggggtgcaaggggtcgaaggttcgaatcctttcactccgaccaaaaattccgaaagccgctttcaaaagcggcttttttgccgtccgtatgattatgatgtagagtacgcggcgacagacattcaaatgccgtccgaaaaccgttcagacggcatctctttatct

SEQ ID NO: 2472 - protein, 65 aa, Neisseria gonorrhoeae
VWRSLVAHLHGVQGVEGSNPFTPTKNSESRFQKRLFCRPYDYDVEYAATDIQMPSENRSDGISLS

SEQ ID NO: 2473 - DNA, 2331 bp, Neisseria gonorrhoeae
atgtcctttgctttacattccgcatacacaatgaatacgcaaccgcacgcttcccataccgattccaacacgctgatgctcggccgatacgccgaacgcgcctatctcgaatacgccatgagcgtggtcaaaggccgcgcgctgcctgaagtttcagacggccaaaagcccgtgcagcggcgcattttgtttgccatgcgcgatatgggtttgacggcgggggcgaagccggtgaaatcggcgcgcgtggtcggcgagattttgggtaaataccatccgcacggcgacagttccgcctatgaggcgatggtgcgcatggctcaggattttaccttgcgctaccccttaatcgacggcatcggcaacttcggttcgcgcgacggcgacggggcggcggcgatgcgttacaccgaagcgcggctgacgccgattgcggaattgctgttgtccgaaatcaatcaggggacggtggattttatgccgaactacgacggcgcgtttgacgagccgctgcaccttcccgcccgcttgcctatggtgttgctcaacggcgcgtcgggcatcgcggtgggtatggcgaccgagattccgtcgcacaatttgaacgaagtcacgcaggcggcgattgcactgttgaagaaaccgacgctggaaaccgccgacctgatgcaatatattcctgctcccgattttgccggcggcggtcaaatcatcacgccggcggacgaattgcgccgtatttacgaaaccggcaagggcagcgtgcgcgtgcgtgcgcgttatgaaatcgagaaattggcgcgcggacagtggcgcgtcatcgtaaccgaactgccgccgaacgccaactccgccaaaatccttgccgaaatcgaagagcaaaccaacccgaaaccgaaagcgggtaaaaagcagctcaaccaagaccggctcaataccaaaaagctgatgctggatttaatcgaccgcgtgcgcgacgagtccgacggcgaacatcccgtgcgccttgtatttgaaccgaaatccagccgcatcgataccgataccttcatcaacacgctgatggcgcaaacttcgctggaaggcaatgtgtccatgaacttggtgatgatgggtttggacaaccgccccgcgcagaaaaacctgaaaacgattttgcaggaatggctggatttccgcgtcgttaccgtaacacgccgtctgaaattccgtttaaaccaagtggaaaaacggctgcacatcctcgaaggccgtctgaaagtctttctgcacatcgacgaagtgattaaagtcatccgcgaatcggacgacccgaaagccgatttgatggcggtgttcgggctgaccgaaatccaagccgaagacattttggaaatccgcctgcgtcagctggcgcgtttggaaggtttcaaactcgaaaaagaattgaacgaattgcgcgaagaacaaggccgtctgaatatctttttgggcgacgaaaacgaaaaacgcaagctgattatcaaagagatgcaggcggacatgaagcagttcggcgacgcgcgccgcacgctggtggaagaggccggacgcgccgtgctgacacaaaccgccgccgacgaacccatcacgctgattttgtcggaaaaaggctggatacgcagccgtgccggacataatctcgatttgagccaaaccgcgttcaaagaaggcgaccgcctcaaacaaacccttgaaggccgcactgttttacccgtcgtcatcctcgattcatcgggcagaacctactcgatcgatgccgccgaaatccccggcggacgcggcgacggcgtaccggtttcctccttaatcgagttgcaaaacggcgcgaaacccgtcgcgatgttgacaggattgccggaacaacattatttattatcaagcagcggcggctacggctttatcgccaagctgggcgatatggtcggacgcgtgaaagcgggcaaagtggtgatgaccgcagacagcggcgaaaccgtcctgccgccggttgccgtctatgcctcctcgttcatcaaccccgactgcaaaatcattgcagccaccagtcaaaaccgcgccctcgccttccccatcggcgaattgaaaattatggcgaaaggcaaaggactgcaaatcatcggattaaacgccggcgaatcgatgacgcataccgccgtttcttccgagccggaaatcctgattgaaagcgaaggcaggcgcggcgcggcgcacaaagaccgcctccccgtcgccctgattgaggcaaaacgcggcaaaaaaggcagactgttgcccatatcgggcagcctgaaacagctttcttcccccaaa

SEQ ID NO: 2474 - protein, 777 aa, Neisseria gonorrhoeae
MSFALHSAYTMNTQPHASHTDSNTLMLGRYAERAYLEYAMSVVKGRALPEVSDGQKPVQRRILFAMRDMGLTAGAKPVKSARVVGEILGKYHPHGDSSAYEAMVRMAQDFTLRYPLIDGIGNFGSRDGDGAAAMRYTEARLTPIAELLLSEINQGTVDFMPNYDGAFDEPLHLPARLPMVLLNGASGIAVGMATEIPSHNLNEVTQAAIALLKKPTLETADLMQYIPAPDFAGGGQIITPADELRRIYETGKGSVRVRARYEIEKLARGQWRVIVTELPPNANSAKILAEIEEQTNPKPKAGKKQLNQDRLNTKKLMLDLIDRVRDESDGEHPVRLVFEPKSSRIDTDTFINTLMAQTSLEGNVSMNLVMMGLDNRPAQKNLKTILQEWLDFRVVTVTRRLKFRLNQVEKRLHILEGRLKVFLHIDEVIKVIRESDDPKADLMAVFGLTEIQAEDILEIRLRQLARLEGFKLEKELNELREEQGRLNIFLGDENEKRKLIIKEMQADMKQFGDARRTLVEEAGRAVLTQTAADEPITLILSEKGWIRSRAGHNLDLSQTAFKEGDRLKQTLEGRTVLPVVILDSSGRTYSIDAAEIPGGRGDGVPVSSLIELQNGAKPVAMLTGLPEQHYLLSSSGGYGFIAKLGDMVGRVKAGKVVMTADSGETVLPPVAVYASSFINPDCKIIAATSQNRALAFPIGELKIMAKGKGLQIIGLNAGESMTHTAVSSEPEILIESEGRRGAAHKDRLPVALIEAKRGKKGRLLPISGSLKQLSSPK

SEQ ID NO: 2475 - DNA, 918 bp, Neisseria gonorrhoeae
gtgtttcgggggcggtgcgaggtaagtgccgttgacggcgggaacggcgtgtcattagaatccgccctgattggccagtccaatttgatgtttgatgtatttcggaagggttttgcagggaatctttataaaggaggagtgatgaaactggtaaggcctcagaaaatcagcgatcaggtattgtcggtattggaaggccgtatcgtggaaggggtttacgcggaagggggcaagattccgcccgaacgcgttttggcggaagagttcggcgtttcgcgtccgtcggtccggtcggcattgaatattttggttgcccgtcagattttggaagcgaggcagggcgatggttattatgtttcggtcaagccgcagcaggattttttgcaaagttggcaggagcttttgggcaaacattccaattgggaacaggatgtttttgatttcagctgccacatcgagggctgtatggcggcattggcggcagaacgccggacggatgccgatttgaagcggattcggttttggcttgaaaagtttgaggaagcgtgcggaagcggcaatctggaacatcagggcgaagccgatgtcagcttccatcagacgattgcggatgcggcgcacaatttgttgttcagccatttgtcgggcggtttgttgaaaatgctgtaccggcagacgcgcagcagccttatttatctgaatcaggaagaagatccgcgtccgaaactgatggcgcagcaccgcgtgctgtatgaggcgatatcgaaccgccggccgggcgaggcttcggaggcggcaaaggctcatttgaattatgtggcgagcagcatattgaaagacagggaatatcagagccgtaaccgccacgcggatactttggcgcaaaacgatttgaagcgcgtgcaggattgggaggta

SEQ ID NO: 2476 - protein, 306 aa, Neisseria gonorrhoeae
VFRGRCEVSAVDGGNGVSLESALIGQSNLMFDVFRKGFAGNLYKGGVMKLVRPQKISDQVLSVLEGRIVEGVYAEGGKIPPERVLAEEFGVSRPSVRSALNILVARQILEARQGDGYYVSVKPQQDFLQSWQELLGKHSNWEQDVFDFSCHIEGCMAALAAERRTDADLKRIRFWLEKFEEACGSGNLEHQGEADVSFHQTIADAAHNLLFSHLSGGLLKMLYRQTRSSLIYLNQEEDPRPKLMAQHRVLYEAISNRRPGEASEAAKAHLNYVASSILKDREYQSRNRHADTLAQNDLKRVQDWEV

SEQ ID NO: 2477 - DNA, 117 bp, Neisseria gonorrhoeae
atgggcagccgcgcacgggcgacaggcgatgacaagccgtccgtgcgtgtgatggggcgcggaatgcgccccttgtcgtatctgcaaacgcctacaaatccccaatcatcccttcaa

SEQ ID NO: 2478 - protein, 39 aa, Neisseria gonorrhoeae
MGSRARATGDDKPSVRVMGRGMRPLSYLQTPTNPQSSLQ

SEQ ID NO: 2479 - DNA, 270 bp, Neisseria gonorrhoeae
ttgcaggctggtgcggatgccgtagcggaggaaggcggcatagttggacgagtcgctcgccccgacagatgcgccgctgcaaaacatttgcgcgttggcattgccggaagaaagcaggctgctgttgaaatcttccgtccattcccaaatcagcccgtgcatatcataaacaccccagtagttcgggcggtctttgccgacatcgtgcaggcctttccgtccgccgtcggcataccaatcgagaatagtgcggttgtagccgggttcgtt

SEQ ID NO: 2480 - protein, 90 aa, Neisseria gonorrhoeae
LQAGADAVAEEGGIVGRVARPDRCAAAKHLRVGIAGRKQAAVEIFRPFPNQPVHIINTPVVRAVFADIVQAFPSAVGIPIENSAVVAGFV

SEQ ID NO: 2481 - DNA, 180 bp, Neisseria gonorrhoeae
ttggtagagcacctgctttgcaagcagggggtcatcggttcgatcccgtttgcctccaccaaaactttacaaatgaaagcaagtttgctgtttttagcagcttattttgatttgcgaagtagaataacgacgcatcgatctttaacaaattggaaagccgaaatcaacaaacaaagacaa

SEQ ID NO: 2482 - protein, 60 aa, Neisseria gonorrhoeae
LVEHLLCKQGVIGSIPFASTKTLQMKASLLFLAAYFDLRSRITTHRSLTNWKAEINKQRQ

SEQ ID NO: 2483 - DNA, 1884 bp, Neisseria gonorrhoeae
ttgggcatttcccgcaaaatatcccttattctgtccatactggcagtgtgcctgccgatgcatgcacacgcctcagatttggcaaacgatccctttatccggcaggttctcgaccgtcagcatttcgaacccgacgggaaataccacctattcggcagcaggggggagcttgccgagcgcagcggccatatcggattgggaaacatacaaagccatcagttgggcaacctgatgattcaacaggcggccattaaaggaaatatcggctacattgtccgcttttccgatcacgggcacgaagtccattcccccttcgacaaccatgcctcacattccgattctgacgaagccggtagtcccgttgacggattcagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggcgctatgctgacgcaaggagtaggcgacggattcaaacgcgccacccgatacagccccgagctggacagatcgggcaatgccgccgaagccttcaacggcactgcagatatcgtcaaaaacatcatcggcgcggcaggagaaattgtcggcgcaggcgatgccgtgcagggtataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgtccggggaaaatacggcttgggcggcatcacggcacatcctgtcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaa

SEQ ID NO: 2484 - protein, 628 aa, Neisseria gonorrhoeae
LGISRKISLILSILAVCLPMHAHASDLANDPFIRQVLDRQHFEPDGKYHLFGSRGELAERSGHIGLGNIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPVKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGVYQATVEIKKPDGSWEVKTKKGGKVMTKHTMFPKDWDEARIRAEVTSAWESRIMLKDNKWQGTSKSGIKIEGFTEPNRTAYPIYE

SEQ ID NO: 2485 - DNA, 420 bp, Neisseria gonorrhoeae
atgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttatcacaatgaatttgatgaagaagatggttatccagtattaagctgttcgctgcatacttttaaaactgctttaattgcttggaatgcttttttgcaattgcctaaaagtattcattcggtggtggagactgtgattgaggaa

SEQ ID NO: 2486 - protein, 140 aa, Neisseria gonorrhoeae
MMKRIKCFCDKFPSGDTFRMCIILDDYDNRVDYYVGIYDYITSTLMSDIYYRSTIDEHFKIIELIENNPNEIYDDGGGQQFCLEFHHDKVIFYHNEFDEEDGYPVLSCSLHTFKTALIAWNAFLQLPKSIHSVVETVIEE

SEQ ID NO: 2487 - DNA, 240 bp, Neisseria gonorrhoeae
atgactaatttaaaattagatttctactctgaagttattataaaagattcttgccctaatgatttgttagaaaatggtgagactattaaaggaaaaaaaggagtggtattaggtataagcgaagaagatggtataatctatggctatactattttactttttgatataaaatattgtatatatatagataagaaatatattataccgactggaaaaaaattctctcgcgatgatttttat

SEQ ID NO: 2488 - protein, 80 aa, Neisseria gonorrhoeae
MTNLKLDFYSEVIIKDSCPNDLLENGETIKGKKGVVLGISEEDGIIYGYTILLFDIKYCIYIDKKYIIPTGKKFSRDDFY

SEQ ID NO: 2489 - DNA, 243 bp, Neisseria gonorrhoeae
ttgaaggattctacagggcaaatgaggctggcaaccaaggatttggcggaagccattaaacgaggagaagtacgtagttctgcttttacaacaaagcaactaaaggcaatcgaaaaaggcaaagacaaaatccctagctacacttggcatcatcatcaagatacagggagaatgcagcttgtgcctgaatgggaacattctaaaaccggtcacataggagggacggcaatggggaagggtaaa

SEQ ID NO: 2490 - protein, 81 aa, Neisseria gonorrhoeae
LKDSTGQMRLATKDLAEAIKRGEVRSSAFTTKQLKAIEKGKDKIPSYTWHHHQDTGRMQLVPEWEHSKTGHIGGTAMGKGK

SEQ ID NO: 2491 - DNA, 384 bp, Neisseria gonorrhoeae
atgtggaaaatttataaagaaaatagcaccgacttaaattttgccataggcagtatatattgccaagcaatcaatcttaccgaatttaaaatgtgggtcgaaaaaatcataagggaagtggatttacatgaaattccaaattatttttttgatttgatagattttcaatcactatacgatctgattgatattataggatttgttcccgaaaataacttatcaaaaaatcaggataatgcattaaccggtattgcttttttaagggggatagatgtctacgatcctcccatttcaaaagaaaaagcattaaaagccttagaaaaacatcctgaaatttatcagaagtttcagcatttctttccgtttgtagagctgcctccgctt

SEQ ID NO: 2492 - protein, 128 aa, Neisseria gonorrhoeae
MWKIYKENSTDLNFAIGSIYCQAINLTEFKMWVEKIIREVDLHEIPNYFFDLIDFQSLYDLIDIIGFVPENNLSKNQDNALTGIAFLRGIDVYDPPISKEKALKALEKHPEIYQKFQHFFPFVELPPL

SEQ ID NO: 2493 - DNA, 141 bp, Neisseria gonorrhoeae
atgtttgacggcaaaggaacatctgaaataccaaattacacttggcatcatcatcaagatacaggaaggatgcaattgattcgtgaagactcgcatcatgataccgaccatatcggttggagagcgatgagtaaaggaaag

SEQ ID NO: 2494 - protein, 47 aa, Neisseria gonorrhoeae
MFDGKGTSEIPNYTWHHHQDTGRMQLIREDSHHDTDHIGWRAMSKGK

SEQ ID NO: 2495 - DNA, 387 bp, Neisseria gonorrhoeae
atgtggaaaatcataaaagaggatagtgatgatttaggatttgcaattaaatgcttattctctcaatctattgatttaaatgaattcaagttatggattgaacaagtaatacgcgatatgcccatcgaggacatccctttttatatttttgacttggcggatttcaatgggggaattggagacattgacaatattgtaggttttgtttcgagttacagcctatcaaaatcgaaaaaaaatgccttgacaggcattgccttcttaagggggatagatgtctatgatccgcctatttcaaaagaaaaagcattaaaagccttaaaaaaacatcctgaaatttatcataaatttaaacggttctttccttttgtagagcttccgcttctt

SEQ ID NO: 2496 - protein, 129 aa, Neisseria gonorrhoeae
MWKIIKEDSDDLGFAIKCLFSQSIDLNEFKLWIEQVIRDMPIEDIPFYIFDLADFNGGIGDIDNIVGFVSSYSLSKSKKNALTGIAFLRGIDVYDPPISKEKALKALKKHPEIYHKFKRFFPFVELPLL

SEQ ID NO: 2497 - DNA, 1455 bp, Neisseria gonorrhoeae
atgcacaaaatcctgcccatcgcccacgtcctctcccgcctgggtatgctgttttcctttatcctgctgatacccgccgccctctcctacgccttttcggacggtgcgtacaccgccttcgccaccaccgcgaccgttaccctttccggctcgtgcatcgtccggctcgccaccctccggttcaggcgcgaactgcgcccgcgcgacggcttcaccctcgtcctgatgttgtggctggcgtttgccgctatggctgcgatgccgatgtacctgtatttcccgaatatgggctttaccgacgcattttttgaatcgatgtcgggactgaccaccaccggcgcgaccgtcatcccccacgtcgacgggctcgccccctccgtcaacttttggcggcatatgctcaactggctgggcgggatgggcatcatcgtccttgccgtcgccatcctgcctatgctcggcgtaggcggcacgcagttattcaaagccgaaatccccggcattgacaaagaaagcaaaatgtcgccgcgcatttcccaagtggcgaaaaaactctggttcggctacaccctgatcaccatcctcgcggcagcctgcctgcattttgccgggatgggttggttcgatgccgtctgtcacgcgctggcaaccctctcgctgggcgggttttccacccacgatgccagcatcggttattacaactcccccctcatcgaagcagtcatcatcgttttcactattttcggcggcatcaattttgccagccatttcgccgccctcaacagccgcagcctcaaaacctattggaaagacgaagaatgccggacgatgctgctgctgctctccggcagcatccttgcctccgccctgtacctgtggcacaccggccattacgccggcttcggcgaatccctgcgctacaccgccttcaacttcgtctccatcggattggcaaacgggctgtccaacaccgacttcgcacaatggccgctcctgatttccctgtggatgtttttcctcgccaacatcctcgccagctccggctcgaccggcggcggcatcaaaaccatacgcgccctcgtcctgttcaaattcagcctgcgcgaaatgatggtgctgctgcaccccaaagccgtccgcaccgtcaaaatcagcggcaaagccatacccgaccgcctcgcgctgaccgttatgtccttcatcttcatctactttatgaccgtcgtcctcttcagcttcctgctgatggcgagcggtatggaatttaccaccgcctttaccgccgtcatcgcctgcattaccaacgccggccccggactgggcgaagtcgggcccgccggcaattacgccggtttggacgtgatgcagaaatggatctgcgttaccgcaatgctcttgggcaggctggaaatcttcaccgtcttcatcctcttcacccccgcctactggaagaaa

SEQ ID NO: 2498 - protein, 485 aa, Neisseria gonorrhoeae
MHKILPIAHVLSRLGMLFSFILLIPAALSYAFSDGAYTAFATTATVTLSGSCIVRLATLRFRRELRPRDGFTLVLMLWLAFAAMAAMPMYLYFPNMGFTDAFFESMSGLTTTGATVIPHVDGLAPSVNFWRHMLNWLGGMGIIVLAVAILPMLGVGGTQLFKAEIPGIDKESKMSPRISQVAKKLWFGYTLITILAAACLHFAGMGWFDAVCHALATLSLGGFSTHDASIGYYNSPLIEAVIIVFTIFGGINFASHFAALNSRSLKTYWKDEECRTMLLLLSGSILASALYLWHTGHYAGFGESLRYTAFNFVSIGLANGLSNTDFAQWPLLISLWMFFLANILASSGSTGGGIKTIRALVLFKFSLREMMVLLHPKAVRTVKISGKAIPDRLALTVMSFIFIYFMTVVLFSFLLMASGMEFTTAFTAVIACITNAGPGLGEVGPAGNYAGLDVMQKWICVTAMLLGRLEIFTVFILFTPAYWKK

SEQ ID NO: 2499 - DNA, 1071 bp, Neisseria gonorrhoeae
ttggaaacggcttcagacgtcatctgcacatcatctcttcggaaaaaaacgcaccacgttctccccctgcggcagcaccagttttttcacggcgtgtccgtacaccgtttccagcgtaatgcccaaaccgccttcccgttcaaatatcgccccggcacacgaacgcgcggcgttttcgtcgtcccacgccaccgcccgccaaacgcccagcgtgtccatatccgcccaaaacgtttccgcctttttgtagtccaacaccagcttcgccgtatcggtaactggatcgtaaaagccgttttcggcgagcatatcgcccaagtcgtgcatatcgggaaacatcacgctgcggctttcaatgccgttttctttcagacgggatttcagttccgccaaggtatcgcgcccgaagcaggtgaaaaacagcagcccgtccgtcttcagcgcgcgcgcccagttgtgcagcacgggaaggatttgttccgccgccaacagtccgaggttcgaccacaacatatcggcacacgcttcgggcagcggcacggtcggggattggcagtgctgcaccacgcccctgcccgtcagtttttgccagaaaccgcccttgcgcgcggctgcggcagccgccaaaaaatccgcacgggaatcgtattcttcaaataccgccagcggatagcgcttcgccaacaggctgcggctgatgtccgcatccgcaccggcaagcaggatatgcccgggcgcgttgcggacgagtgtcaggcgttggtcggtatgttcggcaagatggcggtgaacctgccagcatttgtcctgcggattcatgtcaaacccccttcgacaaagtcgcggcacagcgcggcaaacgcttccgcatggctcaaaaacggcgcgtgtgccgccttttccatcacaaccagcctgcttcctttcaaatgccgatgcagatactcgcccatacgcagcggtgtaatcgcgtctttgccgccgaacaccagcagtaccggaacatctatcttgtccaacaaatgccgcgcatccgccctttccgccgcgtccaaagcttcctgtaaggct

SEQ ID NO: 2500 - protein, 357 aa, Neisseria gonorrhoeae
LETASDVICTSSLRKKTHHVLPLRQHQFFHGVSVHRFQRNAQTAFPFKYRPGTRTRGVFVVPRHRPPNAQRVHIRPKRFRLFVVQHQLRRIGNWIVKAVFGEHIAQVVHIGKHHAAAFNAVFFQTGFQFRQGIAPEAGEKQQPVRLQRARPVVQHGKDLFRRQQSEVRPQHIGTRFGQRHGRGLAVLHHAPARQFLPETALARGCGSRQKIRTGIVFFKYRQRIALRQQAAADVRIRTGKQDMPGRVADECQALVGMFGKMAVNLPAFVLRIHVKPPSTKSRHSAANASAWLKNGACAAFSITTSLLPFKCRCRYSPIRSGVIASLPPNTSSTGTSILSNKCRASALSAASKASCKA

SEQ ID NO: 2501 - DNA, 828 bp, Neisseria gonorrhoeae
atggcacattacgcaatcggcgacatccaaggctgtttcgacgaactgaccgcgctgctcggcaaaatcggcttcaaccacggcacggacaccctctggctgacgggcgacatcgtcaaccgcggcccgaaatccctcgaaacgctgcaattctgcatccggcacgaaaacagcgtgcaaatcgtcctcggcaaccacgacctgtacctgctcgccgtcggctgcggcgaaggcgcgctcaaacgcagcgacacaatcgaacccatactcaaacaccccgacggcggaaaaatgctcgactggctgcgcgcgcaaccgcttttgatacgcgagggcggccgcgtgatgatacacgccggcatcctgccgcaatggcgcatagccaaagccgaatcgctcgccggagaagccgaagccgaactgcgcggcaaaaaatacgtcaaattcttctccaaaatgtacggcaacaaaccggccgcatgggacgaaggtttggaaggctatgcccgcctgcgcttcatcgtcaacgccttcacgcggatgcgcgccctgacctttaaaaacgaactggatttcgactacaaatccacagtgaaaaaaatgccgccttacctgcgcccgtggttcaaagcccccgatcggcaaaacctcgaccacaccatcatcttcggacactggtcctcgctgggctacacgaatgccgacaacgtcatctcgctggacaccggcgcgctgtggggcgggcagctgaccgccgtcaacctcgaaacggaagaaattacccaagtccaagccgccggcggcatagactggaaaagcttcgcaaaa

SEQ ID NO: 2502 - protein, 276 aa, Neisseria gonorrhoeae
MAHYAIGDIQGCFDELTALLGKIGFNHGTDTLWLTGDIVNRGPKSLETLQFCIRHENSVQIVLGNHDLYLLAVGCGEGALKRSDTIEPILKHPDGGKMLDWLRAQPLLIREGGRVMIHAGILPQWRIAKAESLAGEAEAELRGKKYVKFFSKMYGNKPAAWDEGLEGYARLRFIVNAFTRMRALTFKNELDFDYKSTVKKMPPYLRPWFKAPDRQNLDHTIIFGHWSSLGYTNADNVISLDTGALWGGQLTAVNLETEEITQVQAAGGIDWKSFAK

SEQ ID NO: 2503 - DNA, 963 bp, Neisseria gonorrhoeae
ttggacttgggtaatttcttccgtttcgaggttgacggcggtcagctgcccgccccacagcgcgccggtgtccagcgagatgacgttgtcggcattcgtgtagcccagcgaggaccagtgtccgaagatgatggtgtggtcgaggttttgccgatcgggggctttgaaccacgggcgcaggtaaggcggcatttttttcactgtggatttgtagtcgaaatccagttcgtttttaaaggtcagggcgcgcatccgcgtgaaggcgttgacgatgaagcgcaggcgggcatagccttccaaaccttcgtcccatgcggccggtttgttgccgtacattttggagaagaatttgacgtattttttgccgcgcagttcggcttcggcttctccggcgagcgattcggctttggctatgcgccattgcggcaggatgccggcgtgtatcatcacgcggccgccctcgcgtatcaaaagcggttgcgcgcgcagccagtcgagcatttttccgccgtcggggtgtttgagtatgggttcgattgtgtcgctgcgtttgagcgcgccttcgccgcagccgacggcgagcaggtacaggtcgtggttgccgaggacgatttgcacgctgttttcgtgccggatgcagaattgcagcgtttcgagggatttcgggccgcggttgacgatgtcgcccgtcagccagagggtgtccgtgccgtggttgaagccgattttgccgagcagcgcggtcagttcgtcgaaacagccttggatgtcgccgattgcgtaatgtgccattgcgggtgttgtgaagtgggaaagtgttgcggttcggacggcacggttggaaatcttatgccgtccgaacgtggaattatgcgttcaaaacgaggacggcttccgcttcgacctgcacgcctttgggcagcgaggcaacgccgacggcggcgcgggcggggaacggctcgg

SEQ ID NO: 2504 - protein, 321 aa, Neisseria gonorrhoeae
LDLGNFFRFEVDGGQLPAPQRAGVQRDDVVGIRVAQRGPVSEDDGVVEVLPIGGFEPRAQVRRHFFHCGFVVEIQFVFKGQGAHPREGVDDEAQAGIAFQTFVPCGRFVAVHFGEEFDVFFAAQFGFGFSGERFGFGYAPLRQDAGVYHHAAALAYQKRLRAQPVEHFSAVGVFEYGFDCVAAFERAFAAADGEQVQVVVAEDDLHAVFVPDAELQRFEGFRAAVDDVARQPEGVRAVVEADFAEQRGQFVETALDVADCVMCHCGCCEVGKCCGSDGTVGNLMPSERGIMRSKRGRLPLRPARLWAARQRRRRRGRGTAR

SEQ ID NO: 2505 - DNA, 414 bp, Neisseria gonorrhoeae
gtggaattatgcgttcaaaacgaggacggcttccgcttcgacctgcacgcctttgggcagcgaggcaacgccgacggcggcgcgggcggggaacggctcggtgataaattccgccatcacttcgttgaagacggcaaaattgcccaagtcggtcaggtaggcgttgagtttgacgatgtcgtccagcgaaccgcctgccgcttcggcgacggcctgcaggttttggaacacttggcgcgcttcggtgtggaaatcgccgttgccgaccacagtcatcgtggcgggatcgagcggaatctgaccgctcatgtaaacggtgccgccggcgcgcacggcctggctgtatgcgccgatggcggcgggggctttgtcggtatggatgacggttttggacatttcggattcctcaaaaaa

SEQ ID NO: 2506 - protein, 138 aa, Neisseria gonorrhoeae
VELCVQNEDGFRFDLHAFGQRGNADGGAGGERLGDKFRHHFVEDGKIAQVGQVGVEFDDVVQRTACRFGDGLQVLEHLARFGVEIAVADHSHRGGIERNLTAHVNGAAGAHGLAVCADGGGGFVGMDDGFGHFGFLKK

SEQ ID NO: 2507 - DNA, 387 bp, Neisseria gonorrhoeae
atgtccaaaaccgtcatccataccgacaaagcccccgccgccatcggcgcatacagccaggccgtgcgcgccggcggcaccgtttacatgagcggtcagattccgctcgatcccgccacgatgactgtggtcggcaacggcgatttccacaccgaagcgcgccaagtgttccaaaacctgcaggccgtcgccgaagcggcaggcggttcgctggacgacatcgtcaaactcaacgcctacctgaccgacttgggcaattttgccgtcttcaacgaagtgatggcggaatttatcaccgagccgttccccgcccgcgccgccgtcggcgttgcctcgctgcccaaaggcgtgcaggtcgaagcggaagccgtcctcgttttgaacgca

SEQ ID NO: 2508 - protein, 129 aa, Neisseria gonorrhoeae
MSKTVIHTDKAPAAIGAYSQAVRAGGTVYMSGQIPLDPATMTVVGNGDFHTEARQVFQNLQAVAEAAGGSLDDIVKLNAYLTDLGNFAVFNEVMAEFITEPFPARAAVGVASLPKGVQVEAEAVLVLNA

SEQ ID NO: 2509 - DNA, 486 bp, Neisseria gonorrhoeae
ttgtgtagttttaggcggtatatgtgccggaaacaaaaaaccgccgaaggctcggcggtttgcggaataacgcgtatatcagaatttgacgcgcacgccggcggacagttcgccggaacggacgtttttgacattgttgactttgccgacgtagttgtagcggtagccggcatccagatcgacattgggtgtaacggcatagcttacgcccgccaatacgccgaggccggcggaggttttgctgaagctgtcgctgccgcccaagtgggcggaagcgcggttgaggctcaagcgcgcgccgaaatacggtttgacgggcgattgggtgtcgaagtcgtaaatgacggacgcgccgatgctgtaaagtttgaaatcggtggatggggcttgtttatagtttttgtagcgcgtgtaatcgacggcgaagcggaggtcgttgatgcggtagcctgcggagatgcgcgggctgaagcctttggcagaacc

SEQ ID NO: 2510 - protein, 162 aa, Neisseria gonorrhoeae
LCSFRRYMCRKQKTAEGSAVCGITRISEFDAHAGGQFAGTDVFDIVDFADVVVAVAGIQIDIGCNGIAYARQYAEAGGGFAEAVAAAQVGGSAVEAQARAEIRFDGRLGVEVVNDGRADAVKFEIGGWGLFIVFVARVIDGEAEVVDAVACGDARAEAFGRT

SEQ ID NO: 2511 - DNA, 525 bp, Neisseria gonorrhoeae
atgaaaaaagcacttgccgcactgattgccctcgcactcccggccgccgcactggcggaaggcgcatccggcttttacgtccaagccgatgccgcacacgccaaagcctcaagctctttaggttctgccaaaggcttcagcccgcgcatctccgcaggctaccgcatcaacgacctccgcttcgccgtcgattacacgcgctacaaaaactataaacaagccccatccaccgatttcaaactttacagcatcggcgcgtccgtcatttacgacttcgacacccaatcgcccgtcaaaccgtatttcggcgcgcgcttgagcctcaaccgcgcttccgcccacttgggcggcagcgacagcttcagcaaaacctccgccggcctcggcgtattggcgggcgtaagctatgccgttacacccaatgtcgatctggatgccggctaccgctacaactacgtcggcaaagtcaacaatgtcaaaaacgtccgttccggcgaactgtccgccggcgtgcgcgtcaaattc

SEQ ID NO: 2512 - protein, 175 aa, Neisseria gonorrhoeae
MKKALAALIALALPAAALAEGASGFYVQADAAHAKASSSLGSAKGFSPRISAGYRINDLRFAVDYTRYKNYKQAPSTDFKLYSIGASVIYDFDTQSPVKPYFGARLSLNRASAHLGGSDSFSKTSAGLGVLAGVSYAVTPNVDLDAGYRYNYVGKVNNVKNVRSGELSAGVRVKF

SEQ ID NO: 2513 - DNA, 123 bp, Neisseria gonorrhoeae
ttgcggttttttccaaaccgtttgcaagtttcacccatccgccgcgtgatgccgccgtttaagggcaacgcgcgggttaacggctttgccgtcggcaaagcagccggatgccgccgcgtatct

SEQ ID NO: 2514 - protein, 41 aa, Neisseria gonorrhoeae
LRFFPNRLQVSPIRRVMPPFKGNARVNGFAVGKAAGCRRVS

SEQ ID NO: 2515 - DNA, 201 bp, Neisseria gonorrhoeae
atgcctcaagatacgcggcggcatccggctgctttgccgacggcaaagccgttaacccgcgcgttgcccttaaacggcggcatcacgcggcggatgggtgaaacttgcaaacggtttggaaaaaaccgcaaaggcggggcggcggcatttgtcagattgttgcaggcgcaggcgtacggttttttgtgtgcggcgttacct

SEQ ID NO: 2516 - protein, 67 aa, Neisseria gonorrhoeae
MPQDTRRHPAALPTAKPLTRALPLNGGITRRMGETCKRFGKNRKGGAAAFVRLLQAQAYGFLCAALP

SEQ ID NO: 2517 - DNA, 285 bp, Neisseria gonorrhoeae
atgcaacgttgctttaattggtttgaccactattgccgacgattagaaaaatattttcggagatgttcaattatggaaacttgggttcaaaactacacggcaatcggcggcagcctgtatctgactgccgccgccgcactcttacccatcgtctttttctttgccgcgctgaccgtcctgaagctgaaaggctatcaggcggggctgattgcgcttgccgttgccgtattcggcttcgggatgccgacgggtatggcggtttcttccctgtcgccgcagccggat

SEQ ID NO: 2518 - protein, 95 aa, Neisseria gonorrhoeae
MQRCFNWFDHYCRRLEKYFRRCSIMETWVQNYTAIGGSLYLTAAAALLPIVFFFAALTVLKLKGYQAGLIALAVAVFGFGMPTGMAVSSLSPQPD

SEQ ID NO: 2519 - DNA, 816 bp, Neisseria gonorrhoeae
tctcttcggaaaaaaacgcaccacgttctccccctgcggcagcaccagttttttcacggcgtgtccgtacaccgtttccagcgtaatgcccaaaccgccttcccgttcaaatatcgccccggcacacgaacgcgcggcgttttcgtcgtcccacgccaccgcccgccaaacgcccagcgtgtccatatccgcccaaaacgtttccgcctttttgtagtccaacaccagcttcgccgtatcggtaactggatcgtaaaagccgttttcggcgagcatatcgcccaagtcgtgcatatcgggaaacatcacgctgcggctttcaatgccgttttctttcagacgggatttcagttccgccaaggtatcgcgcccgaagcaggtgaaaaacagcagcccgtccgtcttcagcgcgcgcgcccagttgtgcagcacgggaaggatttgttccgccgccaacagtccgaggttcgaccacaacatatcggcacacgcttcgggcagcggcacggtcggggattggcagtgctgcaccacgcccctgcccgtcagtttttgccagaaaccgcccttgcgcgcggctgcggcagccgccaaaaaatccgcacgggaatcgtattcttcaaataccgccagcggatagcgcttcgccaacaggctgcggctgatgtccgcatccgcaccggcaagcaggatatgcccgggcgcgttgcggacgagtgtcaggcgttggtcggtatgttcggcaagatggcggtgaacctgccagcatttgtcctgcggattcatgtcaaacccccttcgacaaagtcgcggcac

SEQ ID NO: 2520 - protein, 272 aa, Neisseria gonorrhoeae
SLRKKTHHVLPLRQHQFFHGVSVHRFQRNAQTAFPFKYRPGTRTRGVFVVPRHRPPNAQRVHIRPKRFRLFVVQHQLRRIGNWIVKAVFGEHIAQVVHIGKHHAAAFNAVFFQTGFQFRQGIAPEAGEKQQPVRLQRARPVVQHGKDLFRRQQSEVRPQHIGTRFGQRHGRGLAVLHHAPARQFLPETALARGCGSRQKIRTGIVFFKYRQRIALRQQAAADVRIRTGKQDMPGRVADECQALVGMFGKMAVNLPAFVLRIHVKPPSTKSRH

SEQ ID NO: 2521 - DNA, 240 bp, Neisseria gonorrhoeae
ttgcaaacggtttggaaaaaaccgcaaaggcggggcggcggcatttgtcagattgttgcaggcgcaggcgtacggttttttgtgtgcggcgttaccttaggcgtcggacatttccggcggcggctgtgccgtctgaaacgcccggcgggggatgcggctgcgtttcccatcgataggcatatttgccggccgcgttcggggcgggttttacccgggcggccgccgatttgtttgcgctta

SEQ ID NO: 2522 - protein, 80 aa, Neisseria gonorrhoeae
LQTVWKKPQRRGGGICQIVAGAGVRFFVCGVTLGVGHFRRRLCRLKRPAGDAAAFPIDRHICRPRSGRVLPGRPPICLRL

SEQ ID NO: 2523 - DNA, 1173 bp, Neisseria gonorrhoeae
atgcacaccatttcctttccaaaccgcacccgactcaccgccctgccgcccctgtcgctctatatccacatcccgtggtgcatcaaaaaatgcccgtattgcgacttcaattcccacagcctgaaaaacggattgcccgaagccgcctatatcgacgcgctgctgaccgacttgcagcttgaattgcccaatatttggggcaggccggtggaaacgatatttttcggcggcggtacgcccagcctgtttcaggcggaatcgattgaccgtttgttaagcggcgtgcgttcgctgttgcgcttgcagcccgaagcggaaattacgttggaagccaatccgggtacagttgaaatcgagaagtttcaaggatttaaagacgcaggcatcacgcggctttctattggtgtacaaagcttcaacgacgatatgctctcaaggctggggcgcgtccacaacggcaaggaagccttaaccgccatagctaccgccctgaaattatttgataaagtcaatatcgacttgatgtatgccctgccgaaccaaaccgttcagacggcattagacgacgtgcaaaccgccatcgccacagacgcaacccacatcagcgcatatcatctgacgatggagccgaacacgccgttcggtcatacgccgccgaaaggtttaccgcaagacgaagcggcgctcgacatcgaagacgcggtacacggcacactggaaggcgcgggttttatccactacgaaacatcggcttttgcgaaacccaccatgcagtgccgccacaatttgaactactggcagttcggcgattatttgggcataggcgcgggcgcgcacggcaaaatctcctatcccgaccgcatcgagcgcaccgtccgccgccgccaccccaacgactacctcgccttaatgcaaagtcagccgggcgaagccgtcgaacgcaaaaccgtcgccgccgaagatttgccgttcgaattcatgatgaacgccctgcgcctgaccgacggcgtacccgccgcgatgttgcaggagcgcacgggcgtacccgccgccaaaatcatggtgcaaatcgaaacggcaaggcaaaaaggcctgctggaaaccgacccgaccgtattccgcccgaccgaaaaaggacgcttgtttttaaacgatttgttgcagtgtttttta

SEQ ID NO: 2524 - protein, 391 aa, Neisseria gonorrhoeae
MHTISFPNRTRLTALPPLSLYIHIPWCIKKCPYCDFNSHSLKNGLPEAAYIDALLTDLQLELPNIWGRPVETIFFGGGTPSLFQAESIDRLLSGVRSLLRLQPEAEITLEANPGTVEIEKFQGFKDAGITRLSIGVQSFNDDMLSRLGRVHNGKEALTAIATALKLFDKVNIDLMYALPNQTVQTALDDVQTAIATDATHISAYHLTMEPNTPFGHTPPKGLPQDEAALDIEDAVHGTLEGAGFIHYETSAFAKPTMQCRHNLNYWQFGDYLGIGAGAHGKISYPDRIERTVRRRHPNDYLALMQSQPGEAVERKTVAAEDLPFEFMMNALRLTDGVPAAMLQERTGVPAAKIMVQIETARQKGLLETDPTVFRPTEKGRLFLNDLLQCFL

SEQ ID NO: 2525 - DNA, 2469 bp, Neisseria gonorrhoeae
atgaacccgaccgcacaacgcatacacgaactcaccgacctcctcaaccgctacgcctacgaatactacaccctcgacgcgcccagcatacccgatgccgaatacgaccgcctgttccgcgaactcgaagcgttggaacgaaaccatcccgagctcaagctgcccgacagcccgacccagcgcgtcggcggcgagcctttggcaggctttgccgaagtgcgccacgaagtgccgatgctgtcgctgaccaacgccttttccccgcaagatgaaaacggcgtgttcgaccatgccgaaatgtacgccttcgaccaacgcgtgcgcgacggcttggacggcggcaatcccgaatacgttatcgaacccaaattcgacggcctcgccatcagcctgctctaccgcgacggcgtattggtgcaggcggcaacgcgcggcgacggcacgacgggcgaagacgttacccgaaacgtcaaaaccgtatccaacatccccctgcggctgcacggcgaaaacgtgcccgaactcatcgaagtacgcggcgaagtgctgatgctcaaagccgattttgccgctttaaaccaacgtcagaccgaaaacgggcaaaaacctttcgccaatccgcgcaatgccgccgccggcagcctgcgccaactcgattcgcgcatcaccgcgcaacgcaaactgcactttttcccctactccgtcgcccgccagcaaggcggtttgattgcggaagaacacatccaagaactcgcctatttccaagcactcggcttcagtctgcccaatggcaatttcggctgtttcaaaaatatcggcgaagtattggcgttttacgaacacatgcagcaaaaacgccccgaactgccctacgaaatcgacggcacggtcgtcaaagtcaacagcttggcgcaacagcacgaactcggcttcatctcccgcgcgccgcgctgggcggttgcccacaaattccctgccgaagaagccctgaccattgtcgaagcgattgacgtgcaaatcggcaggacgggcgcggtaacgccggttgcccgcctgcaacccgtattcgtcggcggcgtaaccgttaccaacgccaccctgcacaatcaggacgaagtatcgcgcaaagacgtgcgcgtcggcgataccgtcgtcgtgcgccgcgccggagacgtgattcccgaagtcgtgcgcgtgattttcgaacgccgcccgatgcaggaaaccgccgttgccgtttcagacggcatcgggcatcagcaggacgacctgtttgccgaaacaccgtccgccaagcaaaccgaatccgttccgctccataagccctaccgcctgccggcccgctgccccatctgccgcagcgaaatcgaacgcgaagaaggcgaagccgtcgcccgatgcagcggcggtatgctttgtcaggcacaacgcgcgcaaggcttaatccacttcgcctcgcgcaaagcgatggacatcgacggcttgggtgaaaaacaaatcgaacagctggtcgcccaagacctcgtccgccatttcgccgacctctaccgcatcgatattccgaccctgcaaaaaatgaaggaaacggcggataaagggtcatctgaaaacgaaaacggcgacgcagaaacggtttcaggcgacctgtctaaatacaatacccaaaacggcaaaaaacaaccgaccaagtgggcgcaaaacatcctcgcaggcatagaatccggcaaaacgcccgaacttgcccgcttcctgttcgcgctcggcatccgccacgtcggcgaacgcaccgccaaaacgctggcgcaggcattcggcacattggaacgcgtccgccgcgcccccgaacccgtcctcgcctgcctgcccgacatcggcacggtagtggcgcgttccattgcccacttcttcgcccaagccgaacagcaggcgatgatagacgagctgctcgccgcaggcgttgccccgcaagcccaagccgtcagcctgcctgccgcacaatatgccgggccgcaacgctggattacccgcctgcccggtttcaaaatcagcgaaaacaaagcccaagccttatgggaactcgccggacaaagtatagaaggactgcaaaacgacaaagccctccctgccgactggcaggcgtggcgcagcaaagcgcaaaacaccgccctgctcgaaaacctaaaaaccttcttcgcgcaaatgccgtctgaagacgaggcggcgcaaggttcagacggcatcaataaagccgtggcaggcaaaacctttgtgttaaccggcaccctgcccaccttcaaacgcgaccaagcccaagccctaatcgaagccgcaggcggcaaagtgtccggcagcgtgtccaaaaaaaccgactacgtcgtcgccggagaaaccgcgggcagcaagctggaaaaagccaatgccttgggcgtttccgtcctcagcgaagccgaactgcttaccctgctctgc

SEQ ID NO: 2526 - protein, 823 aa, Neisseria gonorrhoeae
MNPTAQRIHELTDLLNRYAYEYYTLDAPSIPDAEYDRLFRELEALERNHPELKLPDSPTQRVGGEPLAGFAEVRHEVPMLSLTNAFSPQDENGVFDHAEMYAFDQRVRDGLDGGNPEYVIEPKFDGLAISLLYRDGVLVQAATRGDGTTGEDVTRNVKTVSNIPLRLHGENVPELIEVRGEVLMLKADFAALNQRQTENGQKPFANPRNAAAGSLRQLDSRITAQRKLHFFPYSVARQQGGLIAEEHIQELAYFQALGFSLPNGNFGCFKNIGEVLAFYEHMQQKRPELPYEIDGTVVKVNSLAQQHELGFISRAPRWAVAHKFPAEEALTIVEAIDVQIGRTGAVTPVARLQPVFVGGVTVTNATLHNQDEVSRKDVRVGDTVVVRRAGDVIPEVVRVIFERRPMQETAVAVSDGIGHQQDDLFAETPSAKQTESVPLHKPYRLPARCPICRSEIEREEGEAVARCSGGMLCQAQRAQGLIHFASRKAMDIDGLGEKQIEQLVAQDLVRHFADLYRIDIPTLQKMKETADKGSSENENGDAETVSGDLSKYNTQNGKKQPTKWAQNILAGIESGKTPELARFLFALGIRHVGERTAKTLAQAFGTLERVRRAPEPVLACLPDIGTVVARSIAHFFAQAEQQAMIDELLAAGVAPQAQAVSLPAAQYAGPQRWITRLPGFKISENKAQALWELAGQSIEGLQNDKALPADWQAWRSKAQNTALLENLKTFFAQMPSEDEAAQGSDGINKAVAGKTFVLTGTLPTFKRDQAQALIEAAGGKVSGSVSKKTDYVVAGETAGSKLEKANALGVSVLSEAELLTLLC

SEQ ID NO: 2527 - DNA, 93 bp, Neisseria gonorrhoeae
gtgcggtcgggttcatggattcgtacaggttcagacggcatggacaaatgccgtctgaacggtaaaacgtgttggaaatggtcggattttacc

SEQ ID NO: 2528 - protein, 31 aa, Neisseria gonorrhoeae
VRSGSWIRTGSDGMDKCRLNGKTCWKWSDFT

SEQ ID NO: 2529 - DNA, 789 bp, Neisseria gonorrhoeae
tgtcaaacccccttcgacaaagtcgcggcacagcgcggcaaacgcttccgcatggctcaaaaacggcgcgtgtgccgccttttccatcacaaccagcctgcttcctttcaaatgccgatgcagatactcgcccatacgcagcggtgtaatcgcgtctttgccgccgaacaccagcagtaccggaacatctatcttgtccaacaaatgccgcgcatccgccctttccgccgcgtccaaagcttcctgtaaggcttgaggcgtgccgcagcgcgccaaatcgggcaggattctgccgatgatttcggcggcatcaggcgtgtgcagaagctggagttgtagaaactgtttgatatgtttggcataatccgttcggaacgcgccgaccattttgcccagtgcaggcgcggcaagcccttcgggatagtcttcggcagccgtcagccgtgcgaaactcgccgtcaggcagagcgaacggactttgtcgggatggcgcgccgccagatacagcgcgaccaatccgccgagtgaccagccgagaatgtcggccgacgtatcgatttgagcggcaatgccgtcggcagctgcctcaatatcgaagggttgcgcgaagggcgcgtccccgtgtccgggcaaatcgacggcggacaccggccacgttgcgggcaggcgcggcatcaaatcgtcgaacgcgtggcggttcgccccccaaccgtgtatcaggtaaacttttttggcagcatcaggcatgaattttctctcttgttggcggcgcatcgcagacgcgcccac

SEQ ID NO: 2530 - protein, 82 aa, Neisseria gonorrhoeae
CQTPFDKVAAQRGKRFRMAQKRRVCRLFHHNQPASFQMPMQILAHTQRCNRVFAAEHQQYRNIYLVQQMPRIRPFRRVQSFL

SEQ ID NO: 2531 - DNA, 1293 bp, Neisseria gonorrhoeae
gtgattgccatgatttacatcgtactgttcctcgccgccgtcctcgccgttgtcgcctacaatatgtatcaggaaaaccaataccgcaaaaaagtgcgcgaccagttcggacactccgacaaagatgccctgctcaacagcaaaaccagccatgtccgcgacggcaaaccgtccggcgggccagtcatgatgccgaaaccccaaccggcggtcaaaaaaccggccaaaccccaagactccgccatgcgcaacctgcaagaacaggatgccgtctacatcgccaagcagaaacaggcaaaagcctccccgttcaaaaccgaaatcgaaaccgccttggaagaaatcggcattatcggcaactccgcccacaccgtttccgaaccccaaaccggacattccgcaccgaaacctgccgacgcgccggcaaaacccgttcccgttccgcaaacgccggcaaaaccgctgattacgctcaaagagctgtcgaaggtcgagctgccctggtttgacgtgcgcttcgacttcatctcctatatcgcgctgaccgaagccaaagaactgcacgcactgccgcgcctttccaaccgctgccgctaccagattgtcggctgcaccatggacgaccatttccagattgccgaacccatcccgggcatccgctatcaggcatttatcgtgggtatccaggcagtcagccgcaacggacttgcctcgcaggaagaactctccgcattcaaccgccaggcggacgcattcgcacaaagcatgggcggtcagacgctgcacaccgaccttgccgcctttatcgaagtggcttccgcactggacgcattctgcgcgcgcgtcgaccagaccatcgccatccatttggtttcgccgaccagcatcagcggcgtagaactgcgttccgccgtaacgggcgtgggtttcgttttggaagacgacggcgcgttccactataccgacacgtcgggctcgaccatgttctccatctgctcgctcaacaacgagccgtttaccaatgcccttttggacaaccagtcctacaaaggcttcagtatgctgctcgacatcccgcactctccggcaggcgaaaaaaccttcgacgatttgtttatggatttggcggtacgcctgtccggtcagttgaacctgaatctggtcaacgacaaaatggaagaagtttcgacccaatggctcaaagacgtacgcacttatgtattggcgcgtcagtccgagatgctcaaagtcggtatcgaaccgggcggcaaaaccgccctgcgcctgttttca

SEQ ID NO: 2532 - protein, 431 aa, Neisseria gonorrhoeae
VIAMIYIVLFLAAVLAVVAYNMYQENQYRKKVRDQFGHSDKDALLNSKTSHVRDGKPSGGPVMMPKPQPAVKKPAKPQDSAMRNLQEQDAVYIAKQKQAKASPFKTEIETALEEIGIIGNSAHTVSEPQTGHSAPKPADAPAKPVPVPQTPAKPLITLKELSKVELPWFDVRFDFISYIALTEAKELHALPRLSNRCRYQIVGCTMDDHFQIAEPIPGIRYQAFIVGIQAVSRNGLASQEELSAFNRQADAFAQSMGGQTLHTDLAAFIEVASALDAFCARVDQTIAIHLVSPTSISGVELRSAVTGVGFVLEDDGAFHYTDTSGSTMFSICSLNNEPFTNALLDNQSYKGFSMLLDIPHSPAGEKTFDDLFMDLAVRLSGQLNLNLVNDKMEEVSTQWLKDVRTYVLARQSEMLKVGIEPGGKTALRLFS

SEQ ID NO: 2533 - DNA, 108 bp, Neisseria gonorrhoeae
atggcaatcactttaaatttcgggatgcaggatgcgcaaagtgcgggtactgcggttaaatcgggcttgcgtttccggcagtctgacggaacggccggttataacgtt

SEQ ID NO: 2534 - protein, 36 aa, Neisseria gonorrhoeae
MAITLNFGMQDAQSAGTAVKSGLRFRQSDGTAGYNV

SEQ ID NO: 2535 - DNA, 105 bp, Neisseria gonorrhoeae
atgccgtctgaaaaccacagatttcagacggcatttcggaaaatttccgcttatttcgacacactgctgtcagaccctgcaattttcgttataattcaaacgtta

SEQ ID NO: 2536 - protein, 35 aa, Neisseria gonorrhoeae
MPSENHRFQTAFRKISAYFDTLLSDPAIFVIIQTL

SEQ ID NO: 2537 - DNA, 678 bp, Neisseria gonorrhoeae
ttgcccgccggacaggaagaacatcatggacaatcacgccggagcacactggcaaaacggctggcttcaaagcatacgccataccccgtcgcccaatttcagcccgagggaaacgggagaaacggtttccctgatcgtgctgcacaacatttcgctgccgccgttcgaatacggcacggatgcggtggaaaagctgtttgccaaccggctcgaccccgacggacatccgttcttcagcctgatacacactttgcacgtgtccagccatttcctgattgcacgcgacggcgaaacggtgcagttcgtatcatgcggcgacatggcgtaccacgccggcgcatcctcgtttcgggggcgggagaagtgcaacgcgttttccatcggcatcgaactggaaggctgcgatttcgaaccgtttgccgaagcgcaataccgttcgctcgaaacactgttggcagccctctgccgccgctaccccatcacggcggtaacgggacaccaagacatcgcacccggccgcaaaaccgaccccggccattttttcgactggcggcggatacgggaaaaagggtttcccgtggacagaaatgccgtctgaaaaccacagatttcagacggcatttcggaaaatttccgcttatttcgacacactgctgtcagaccctgcaattttcgtta

SEQ ID NO: 2538 - protein, 226 aa, Neisseria gonorrhoeae
LPAGQEEHHGQSRRSTLAKRLASKHTPYPVAQFQPEGNGRNGFPDRAAQHFAAAVRIRHGCGGKAVCQPARPRRTSVLQPDTHFARVQPFPDCTRRRNGAVRIMRRHGVPRRRILVSGAGEVQRVFHRHRTGRLRFRTVCRSAIPFARNTVGSPLPPLPHHGGNGTPRHRTRPQNRPRPFFRLAADTGKRVSRGQKCRLKTTDFRRHFGKFPLISTHCCQTLQFSL

SEQ ID NO: 2539 - DNA, 570 bp, Neisseria gonorrhoeae
atggacaatcacgccggagcacactggcaaaacggctggcttcaaagcatacgccataccccgtcgcccaatttcagcccgagggaaacgggagaaacggtttccctgatcgtgctgcacaacatttcgctgccgccgttcgaatacggcacggatgcggtggaaaagctgtttgccaaccggctcgaccccgacggacatccgttcttcagcctgatacacactttgcacgtgtccagccatttcctgattgcacgcgacggcgaaacggtgcagttcgtatcatgcggcgacatggcgtaccacgccggcgcatcctcgtttcgggggcgggagaagtgcaacgcgttttccatcggcatcgaactggaaggctgcgatttcgaaccgtttgccgaagcgcaataccgttcgctcgaaacactgttggcagccctctgccgccgctaccccatcacggcggtaacgggacaccaagacatcgcacccggccgcaaaaccgaccccggccattttttcgactggcggcggatacgggaaaaagggtttcccgtggacagaaatgccgtc

SEQ ID NO: 2540 - protein, 190 aa, Neisseria gonorrhoeae
MDNHAGAHWQNGWLQSIRHTPSPNFSPRETGETVSLIVLHNISLPPFEYGTDAVEKLFANRLDPDGHPFFSLIHTLHVSSHFLIARDGETVQFVSCGDMAYHAGASSFRGREKCNAFSIGIELEGCDFEPFAEAQYRSLETLLAALCRRYPITAVTGHQDIAPGRKTDPGHFFDWRRIREKGFPVDRNAV

SEQ ID NO: 2541 - DNA, 1002 bp, Neisseria gonorrhoeae
ttgggttatactgtcgcccgaattttaagacgtattccgaatgctgggaatcctaccatgttgaaaaaaatgttgaaatggactgccgtttttttgaccgtatcggcagccgttttcgccgcgctgctttttgtccctaaagacaacggcagggcataccgaatcaagattgccaaaaatcagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagttttttcccgacagctacgaaatcgatgcgggcggcagcgatttgcagatttaccaaaccgcctacaaggcgatgcaacgccgcctgaacgaggcatgggcaggcaggcaggacgggctgccttataaaaacccttatgaaatgctgattatggcgagcctgatcgaaaaggaaacggggcatgaggccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctatacgcgcgggggcttgccgccaaccccgattgcgctgcccggcaaggcggcaatggatgccgccgcccaccgttccggcggaaaaatacctgtatttcgtgtccaaaatggacggcacgggcttgagccagttcagcca

SEQ ID NO: 2542 - protein, 334 aa, Neisseria gonorrhoeae
LGYTVARILRRIPNAGNPTMLKKMLKWTAVFLTVSAAVFAALLFVPKDNGRAYRIKIAKNQGISSVGRKLAEDRIVFSRHVLTAAAYVLGVHNRLHTGTYRLPSEVSAWDILQKMRGGRPDSVTVQIIEGSRFSHMRKVIDATPDIGHDTKGWSNEKLMAEVAPDAFSGNPEGQFFPDSYEIDAGGSDLQIYQTAYKAMQRRLNEAWAGRQDGLPYKNPYEMLIMASLIEKETGHEADRDHVASVFVNRLKIGMRLQTDPSVIYGMGAAYKGKIRKADLRRDTPYNTYTRGGLPPTPIALPGKAAMDAAAHRSGGKIPVFRVQNGRHGLEPVQP

SEQ ID NO: 2543 - DNA, 1098 bp, Neisseria gonorrhoeae
ttgcggtttcatgcttgcagttccggtaagggtatgccgtctgaaaacacaaacttttcagacggcatggtttattttttcaaaatatatttgcggacggcggcgttgtgttcggtcaaatcatggctgaactggctcaagcccgtgccgtccattttggacacgaaatacaggtatttttccgccggaacggtgggcggcggcatccattgccgccttgccgggcagcgcaatcggggttggcggcaagcccccgcgcgtataggtgttgtacggcgtgtcgcggcgcaggtcggctttacggattttgcccttgtatgccgcacccatgccgtaaatcacggacgggtcggtttgcaggcgcataccgattttcaggcggttgacgaagacggaagcgacatggtcgcggtcggcctcatgccccgtttccttttcgatcaggctcgccataatcagcatttcataagggtttttataaggcagcccgtcctgcctgcctgcccatgcctcgttcaggcggcgttgcatcgccttgtaggcggtttggtaaatctgcaaatcgctgccgcccgcatcgatttcgtagctgtcgggaaaaaactgcccttcaggattgccgctgaaggcatcgggcgcaacttccgccatcagtttttcattgctccagcctttggtgtcgtgtccgatgtcgggcgttgcgtcgatgactttcctcatatgcgaaaaacgcgaaccttcgataatctgcacggtaacggaatccggcctgccgccgcgcattttctgcaagatatcccaagcagacacttccgaaggcaatctgtacgtccccgtatgcagcctgttgtgcacacccaaaacgtaggccgccgccgtcaaaacatgcctgctgaacacgatgcggtcttcggcaagtttcctgccgaccgacgaaataccctgatttttggcaatcttgattcggtatgccctgccgttgtctttagggacaaaaagcagcgcggcgaaaacggctgccgatacggtcaaaaaaacggcagtccatttcaacatttttttcaacatggtaggattcccagcattcggaatacgtct

SEQ ID NO: 2544 - protein, 366 aa, Neisseria gonorrhoeae
LRFHACSSGKGMPSENTNFSDGMVYFFKIYLRTAALCSVKSWLNWLKPVPSILDTKYRYFSAGTVGGGIHCRLAGQRNRGWRQAPARIGVVRRVAAQVGFTDFALVCRTHAVNHGRVGLQAHTDFQAVDEDGSDMVAVGLMPRFLFDQARHNQHFIRVFIRQPVLPACPCLVQAALHRLVGGLVNLQIAAARIDFVAVGKKLPFRIAAEGIGRNFRHQFFIAPAFGVVSDVGRCVDDFPHMRKTRTFDNLHGNGIRPAAAHFLQDIPSRHFRRQSVRPRMQPVVHTQNVGRRRQNMPAEHDAVFGKFPADRRNTLIFGNLDSVCPAVVFRDKKQRGENGCRYGQKNGSPFQHFFQHGRIPSIRNTS

SEQ ID NO: 2545 - DNA, 147 bp, Neisseria gonorrhoeae
ttgaccgcgcattacaaaatcggcaaatccacccgcatcggtttggactttgaaaacgtctttaacaaacgctgccgcacgatgcccgacattcacgtttacggcacgccgcgcagcctgaccgcaaccgtcaaacatatagtggat

SEQ ID NO: 2546 - protein, 49 aa, Neisseria gonorrhoeae
LTAHYKIGKSTRIGLDFENVFNKRCRTMPDIHVYGTPRSLTATVKHIVD

SEQ ID NO: 2547 - DNA, 1722 bp, Neisseria gonorrhoeae
atggtgatttccaacccccgcgaacttgaaaaactcaaagaccggattcccaatctgatcaacatcatccgcgtcgccatcgttttcccgctgatgattatgcacatcctcgggctggaaaccggcagccgtgcgaacctgcacgcctcatggacggcgtgggcgttttacttgtggcttgccattgcctgctggctgattttcttttccaccctcaacccgcaatggcaatggcaatggcaggctttgagaataccgagtttcagcgccgtggccgacatcacgatgatcggcgtgctgacctacctgttcggcggcatcgattcggggttcggcatcctgatcctgcccttcgtgggcagctcctgcctactcagttacgggcgttatcccctgctctatgccagctatgcatccatcctgctgatattcaacgcccttgcagacagcaatatcaatatgtatccgctgattctggatgcaaaaaccgtcaccaataccttcgtcgtcgtagccggctcctatttcgtcgctatgattgcctcgctgtcggtcagatacatcgaccgtgccggcaaacttgcccatgaaaaccacgtcgcctaccgccgtatcaggggcttgaaccaaatcgtgctcaaccgcgttcaggaagcggtcgtcgtcatcaacgtcgagcatcagaccatactgttcaataaaaaggcaaaagatctgctccccatgcttgaaatcggacagcatacctccctgttcgaccctgtcgccatcttatgggataaaacatcctcacgcaccttcgaacaccatatcgacacgcccgaactgaccgcccgcatccgcgccgtgccgatgaacaaaaagcagaacaagctgctcatcctctatatccgcccgcaaagcgaaattcaggcggaagccctgtccgtcaaacttgccgcgctcggacaactgaccgccaaccttgcccacgaaatccgcaacccgatgtccgccatccgccacgccgacggcggcactttatttttggacgaagtggccgacctgcccctttccatgcaggtcaaactcttgcgcgcgattcaagaaaaagccgtgcgccgtatcggcgacgcgaccgagcagcccgtcgatgtccgcatcgtctgcgccacccacaaaaacctcgaagcccttgtcgaaagcggcgcattccgccaagacctgtattaccgtctcaatgtcgtcagcctcaatatgccgtccctgcgtgaaatgcgcgaaaatttgaagctgcccaccccctacctcctgtacaaacacagccacaacaaccggccctacacactctcccccgccgcgcaacagatgctcctgaattacagttatccgggcaatttccgcgaactcgaaaacatcctcgaacgcgccgtcgccctgtgcgtcggatatacagtgcaaatcgacgacctgcaaatccaagatgtgcaccacaaacccgtccggacggaaaccgccgtccccgttgccgataccttgccgtctgaaatagccgccgcaccgtcccgccttctcccgttcgaccccgataccatgcagatacaggactatctcgacaaaatcgaacgcgacatcatcggacaagtcctcaaacaaaccgaaggcaaccgcacgcaagccgccaaacgcttgggcatcagcttccgctctatgcgctaccgtatggaacgcctcaacatagac

SEQ ID NO: 2548 - protein, 574 aa, Neisseria gonorrhoeae
MVISNPRELEKLKDRIPNLINIIRVAIVFPLMIMHILGLETGSRANLHASWTAWAFYLWLAIACWLIFFSTLNPQWQWQWQALRIPSFSAVADITMIGVLTYLFGGIDSGFGILILPFVGSSCLLSYGRYPLLYASYASILLIFNALADSNINMYPLILDAKTVTNTFVVVAGSYFVAMIASLSVRYIDRAGKLAHENHVAYRRIRGLNQIVLNRVQEAVVVINVEHQTILFNKKAKDLLPMLEIGQHTSLFDPVAILWDKTSSRTFEHHIDTPELTARIRAVPMNKKQNKLLILYIRPQSEIQAEALSVKLAALGQLTANLAHEIRNPMSAIRHADGGTLFLDEVADLPLSMQVKLLRAIQEKAVRRIGDATEQPVDVRIVCATHKNLEALVESGAFRQDLYYRLNVVSLNMPSLREMRENLKLPTPYLLYKHSHNNRPYTLSPAAQQMLLNYSYPGNFRELENILERAVALCVGYTVQIDDLQIQDVHHKPVRTETAVPVADTLPSEIAAAPSRLLPFDPDTMQIQDYLDKIERDIIGQVLKQTEGNRTQAAKRLGISFRSMRYRMERLNID

SEQ ID NO: 2549 - DNA, 618 bp, Neisseria gonorrhoeae
atgaaaccgcaattcatcactttggacggcatagacggtgccggaaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaacactgatgatgttcgccgcgcgtatgcagcacatcgaggaagtcatcctgcccgcgctttcagacggcatccatgtcgtgtccgaccgttttaccgatgcgaccttcgcctatcagggcggcgggcgggggatgccgtctgaagacattgaaattttggaacattgggtgcagggcggtttgcgccccgatttgaccctgctgttggatgtgccgctggaagtatcgatggcgcgtatcggacaggcgcgcgagaaagaccggttcgagcaggagcaggcggatttctttatgcgtgtgcgcggcgtttatctcgaccgagccgccgcctgtcccgaacggtacgccgttatcgacagtaaccgcagcttggatgaagtcagaaacagcatagaaaaagtgttggacggacatttcggctgt

SEQ ID NO: 2550 - protein, 206 aa, Neisseria gonorrhoeae
MKPQFITLDGIDGAGKSTNLAVIKAWFERRGLPVLFTREPGGTPVGEALREILLNPETKAGLRAETLMMFAARMQHIEEVILPALSDGIHVVSDRFTDATFAYQGGGRGMPSEDIEILEHWVQGGLRPDLTLLLDVPLEVSMARIGQAREKDRFEQEQADFFMRVRGVYLDRAAACPERYAVIDSNRSLDEVRNSIEKVLDGHFGC

SEQ ID NO: 2551 - DNA, 1278 bp, Neisseria gonorrhoeae
atggaaaactcattgaaagaagccgccctcaagttccacgaattacccgttccgggcaaaatttccgttaccccgaccaaatctctggcgaccgacaaagatttggcgttggcgtactctccgggcgtagccgccccctgtatggaaatccatgccgatccgcaaaatgcctacaaatacaccggcaaaggcaacttggtcgccgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgacgaaaaagacccgcaaaaactggtggacatcatcgccgctttggagccgactttcggcggcatcaacctcgaagacatcaaagcacccgagtgtttttacatcgaacgcgaattacgcaaacgctgcaaaatccccgtatttcatgatgaccagcacggcacggccatcattaccgccgccgccgtattgaacgccctgcgttataccggccgtaaaatcgaagaagcgactttggtgtgctccggcgcaggtgccgccgcgattgcctgcctgaaccaactgctggatttgggcttgaaacgtgaaaacgtaaccgtttgcgactccaaaggcgtgatttaccaaacccgcgaagacaaagaccgcatggacgaatccaaaaaattctacgccgttgaagacaacggccggcgcgtacttgccgatgcggttaaaggcaaagacatcttcttgggcctctccggcgcaaacctgctgacgcctgaaatgttgaacacgatgaacgaaaaacccatcgtgttcgccatggccaacccgaatccggaaatcctgccgccgctggcgaaagaaacccgtccggacgtggttatcggtaccggccgctccgacttcccgaaccaagtgaacaacgtattgtgcttcccgttcatcttccggggcgcgttggatgtcggcgcaaccaccatcaacgaagaaatgaaacgcgcctgcgtgtatgctttggcagatttggcgatggaagaagtaaccgaagaagtggttgccgcttacggtaagaaattcgaattcggcgcggaatacctgattcctactccgttcgattcccgcctgctgcctcgcgtcgctacggctgccgccaaagcagcgatggaaagcggcgtggcaacccgtccgattgcagatttggaagcttacgctgccaagttgggcgaatggaagctg

SEQ ID NO: 2552 - protein, 426 aa, Neisseria gonorrhoeae
MENSLKEAALKFHELPVPGKISVTPTKSLATDKDLALAYSPGVAAPCMEIHADPQNAYKYTGKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRYTGRKIEEATLVCSGAGAAAIACLNQLLDLGLKRENVTVCDSKGVIYQTREDKDRMDESKKFYAVEDNGRRVLADAVKGKDIFLGLSGANLLTPEMLNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLGEWKL

SEQ ID NO: 2553 - DNA, 201 bp, Neisseria gonorrhoeae
ttggcgatatacccgaaacttcaaaacaaaccgcccccggtcatgacgacagggcagtgggtgttgacgatgattgttttcatgattcctttggtcaatatcgttatgttttttgtttgggcgttcggcagaggcaaccccaaccgtgccaatttctgtaaagcactgttcttatttaccttgttggttcgcttatcggtt

SEQ ID NO: 2554 - protein, 67 aa, Neisseria gonorrhoeae
LAIYPKLQNKPPPVMTTGQWVLTMIVFMIPLVNIVMFFVWAFGRGNPNRANFCKALFLFTLLVRLSV

SEQ ID NO: 2555 - DNA, 273 bp, Neisseria gonorrhoeae
ttggcatattcgatacaaatcttcgaagcagaatcagccggcacattaataatgcgtacccgatgcagacccacctataagcaatatgaaaatcaaaccgataagcgaaccaacaaggtaaataagaacagtgctttacagaaattggcacggttggggttgcctctgccgaacgcccaaacaaaaaacataacgatattgaccaaaggaatcatgaaaacaatcatcgtcaacacccactgccctgtcgtcatgaccgggggcggtttgttt

SEQ ID NO: 2556 - protein, 91 aa, Neisseria gonorrhoeae
LAYSIQIFEAESAGTLIMRTRCRPTYKQYENQTDKRTNKVNKNSALQKLARLGLPLPNAQTKNITILTKGIMKTIIVNTHCPVVMTGGGLF

SEQ ID NO: 2557 - DNA, 738 bp, Neisseria gonorrhoeae
ttggcagcatcaggcatgaattttctctcttgttggcggcgcatcgcagacgcgcccactatcaggcgttgcgtattatgccacggttcgtccggcgtttcagacggcatctgcgccggctgcaataccgatttggcaagtttccgcaccgacgcggcaaacagctgtcccctgtgtttcaggcacgttcaaggcggcgcggtgtgcggcggatgtcagaaaaaaccgcccgcattcgaccggatgtgggcatcgctgcattacgaaccgcccgtcagcaatatgatacgcgcgctgaagcacttggctgatttgggcatggcgcagccgctggcagacctgacgatgcagaatccgcccgaccggctttcagacgaatgtttcaatttcgtcctacccgttccgctaagcagggagcggctgctgcaacgcgggttcaaccaaagcgagagcatcgtcgggttgttggcgcaacgctacggctggcagatactgccccgacacaccgtattccgacaccaccgcccgccgcaaagcacgctcaaaggcggcgaacggcggcgaaacatcaaaaacgcctttgaaatccgcacaccgataccggaaaactgtaatattttgttaatcgacgatgtctttaccaccggcgcgacgctggacgaattggcaaagacgctgaaaaaatcgggcgcaaaccgaatctgctgctggacgctggcacgcacgccaatgaaaaaa

SEQ ID NO: 2558 - protein, 246 aa, Neisseria gonorrhoeae
LAASGMNFLSCWRRIADAPTIRRCVLCHGSSGVSDGICAGCNTDLASFRTDAANSCPLCFRHVQGGAVCGGCQKKPPAFDRMWASLHYEPPVSNMIRALKHLADLGMAQPLADLTMQNPPDRLSDECFNFVLPVPLSRERLLQRGFNQSESIVGLLAQRYGWQILPRHTVFRHHRPPQSTLKGGERRRNIKNAFEIRTPIPENCNILLIDDVFTTGATLDELAKTLKKSGANRICCWTLARTPMKK

SEQ ID NO: 2559 - DNA, 324 bp, Neisseria gonorrhoeae
ttgttaatccactatatgtttgacggttgcggtcaggctgcgcggcgtgccgtaaacgtgaatgtcgggcatcgtgcggcagcgtttgttaaagacgttttcaaagtccaaaccgatgcgggtggatttgccgattttgtaatgcgcggtcaagtccagtgtagcgtatggggcgttgggtcaatccggctgcggcgacagggaagaaaccgccatacccgtcggcatcccgaagccgaatacggcaacggcaagcgcaatcagccccgcctgatagcctttcagcttcaggacggtcagcgcggcaaagaaaaagacgatggg

SEQ ID NO: 2560 - protein, 108 aa, Neisseria gonorrhoeae
LLIHYMFDGCGQAARRAVNVNVGHRAAAFVKDVFKVQTDAGGFADFVMRGQVQCSVWGVGSIRLRRQGRNRHTRRHPEAEYGNGKRNQPRLIAFQLQDGQRGKEKDDG

SEQ ID NO: 2561 - DNA, 108 bp, Neisseria gonorrhoeae
atggtcgggcagagcaaccgtttggtcaaggcggatgcccatgtgtgtcagagtatcgaagaaacgctgcggcctggcgataccggcaaccgctgcgacgcgcttccc

SEQ ID NO: 2562 - protein, 36 aa, Neisseria gonorrhoeae
MVGQSNRLVKADAHVCQSIEETLRPGDTGNRCDALP

SEQ ID NO: 2563 - DNA, 1029 bp, Neisseria gonorrhoeae
atgccaaatttttttaaatttcataccgttatcgaacggcattggcaaaaaccttatccggttttgtcttttctgctcaagccgctttccgggctgtttgccaaaattgcggcaaaatggcgggcggattttttatcgggaaaacggcaaagcgaaaagctgtccgtgcctgtggtcgtggtcggcaacatccacgcgggcgggacgggcaaaacgccgattgccgccgcgctggtgtcgggcttgcaggaaaaaggtgtcaaggtcggcatcatcagccgaggctacgggcgcaagagcaaggcggtttatgtattgaatgccgcgagccgtgcggaagatgcgggcgacgagcctttgctgctgttccgtaaaacaggtgcgccgacggcagtgggcagcagccgtgtggaggcaggcagggcgttgctggcagcgcatccggagcttgaattgattgtggcggacgacggtttgcagcattacgccctgcaacgcgatgtggaaatcgcggtgtttccggcggcggatacggggcgtacggatttggacttgctgcccaacggcaatttgcgcgaacctttgtcgagattggaaagcgtggatgcggtggtggtcggcggcagggcggcggatggttttatgccgtctgaacatttgttcggcagccgtattgaggcgggtgcggtttaccgtttgaaccgtccgtctgaaaaactggatatttcgacattgtcagggaagcgcgtcgcagcggttgccggtatcgccaggccgcagcgtttcttcgatactctgacacacatgggcatccgccttgaccaaacggttgctctgcccgaccatgccgatattttcaatcgggatttgccgcctgccgatgtggtgctggtaactgaaaaagatgcggtcaaattttcagacggcatttgcaccgataatgtttgggtgctgccggtttgtgcgataatcgaacctgatttggcggagtttgtgctggagcggttggagggtgtaccgaaggccgtc

SEQ ID NO: 2564 - protein, 343 aa, Neisseria gonorrhoeae
MPNFFKFHTVIERHWQKPYPVLSFLLKPLSGLFAKIAAKWRADFLSGKRQSEKLSVPVVVVGNIHAGGTGKTPIAAALVSGLQEKGVKVGIISRGYGRKSKAVYVLNAASRAEDAGDEPLLLFRKTGAPTAVGSSRVEAGRALLAAHPELELIVADDGLQHYALQRDVEIAVFPAADTGRTDLDLLPNGNLREPLSRLESVDAVVVGGRAADGFMPSEHLFGSRIEAGAVYRLNRPSEKLDISTLSGKRVAAVAGIARPQRFFDTLTHMGIRLDQTVALPDHADIFNRDLPPADVVLVTEKDAVKFSDGICTDNVWVLPVCAIIEPDLAEFVLERLEGVPKAV

SEQ ID NO: 2565 - DNA, 537 bp, Neisseria gonorrhoeae
gtggatatgaagctgaaaaccttgttattgcccttcgccgcactggcattgtgtgccaacgcatttgccgccccgcccggcgacgcgtcgttggcacgttggctggatacgcagaatttcgaccgggatatagaaaaaaatatgattgaaggctttaatgccggatttaaaccgtatgcggacaaagcccttgccgaaatgccggaagcgaaaaaagatcaggcggcagaagcctttaatcgttatcgtgagaatgttttgaaagatttgattacgcccgaagtgaaacaggctgtccgcaataccttattgaagaatgcccgtgaaatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcgacatcatctgcccgagtttacggaagagttacggcgcatcatctgcggcggtatagtggat

SEQ ID NO: 2566 - protein, 179 aa, Neisseria gonorrhoeae
VDMKLKTLLLPFAALALCANAFAAPPGDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIARHHLPEFTEELRRIICGGIVD

SEQ ID NO: 2567 - DNA, 96 bp, Neisseria gonorrhoeae
ttgcctcgccttgccgtactatttgtacggtctgcggcttcgccgccttgtcctgatttaaatttaatccactataccgccgcagatgatgcgccg

SEQ ID NO: 2568 - protein, 32 aa, Neisseria gonorrhoeae
LPRLAVLFVRSAASPPCPDLNLIHYTAADDAP

SEQ ID NO: 2569 - DNA, 180 bp, Neisseria gonorrhoeae
atggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcacgagcgttgagcgaagaggaactcaaagca

SEQ ID NO: 2570 - protein, 60 aa, Neisseria gonorrhoeae
MEKKFLDILVCPVTKGRLEYHQDKQELWSRQAKLAYPIKDGIPYMLENEARALSEEELKA

SEQ ID NO: 2571 - DNA, 759 bp, Neisseria gonorrhoeae
atgaccgaattcgtcgtattgattccggcgcggctggattcgtcgcgcctgcccggaaaagccttggcggacattcacggcaaaccgatggtcgtgcgcgttgccgaacaggcggcaaaaagcaaagccgcgcgcgtcgtcgtcgccaccgatcatcccgacattcagacggcctgtcaggcgcacggtatcgaagtcgtcatgacttcaaaccggcacgaaagcggcacgacgcgccttgccgaagccgccgccgcgctgaagctgccgccgcatttgattgttgtgaacgtacagggcgacgagccgctgattgcccccgaactcatcgaccgcaccgccgaagtactcgtcgaaaacaacgtccaaatggcgaccgccggccacgaattgcacgatttcgacgaattgatgaatcccaatgccgtcaaagtcgtcctcgacaaaaacggcaacgccatctacttcagccgtgccccgattccctatccgcgcgatgcgatgcgtgccggaaaacgcgaaatgccgtctgaaaccgccgtcctacgccatatcggcatttacgcctaccgcgtcggcttcctgcaacgctatgccgaaatgagcgtctcgccgctggaaaccatcgaatcgctggaacaactgcgcgtcctgtggcacggctaccccatcgccgtcgaaaccgccaaagaagcccccgccgccggtgtggatacgcaggaagatttggacagggttcgcgctgtatttcagaccgta

SEQ ID NO: 2572 - protein, 253 aa, Neisseria gonorrhoeae
MTEFVVLIPARLDSSRLPGKALADIHGKPMVVRVAEQAAKSKAARVVVATDHPDIQTACQAHGIEVVMTSNRHESGTTRLAEAAAALKLPPHLIVVNVQGDEPLIAPELIDRTAEVLVENNVQMATAGHELHDFDELMNPNAVKVVLDKNGNAIYFSRAPIPYPRDAMRAGKREMPSETAVLRHIGIYAYRVGFLQRYAEMSVSPLETIESLEQLRVLWHGYPIAVETAKEAPAAGVDTQEDLDRVRAVFQTV

SEQ ID NO: 2573 - DNA, 294 bp, Neisseria gonorrhoeae
atgcagcaacatattgaaaagtggcaacacttgagccgtgaagaacagaaaatccttgccgaagtatggggtctcgtgcaaaacgatgatcaggaggttcactatgaaatgctcaaattgaacgcacctgatgaagtcagcggtgaattttggttcagaatggcagaaacactcagcaccctgccgcccaatcgttccctcgaccttagaatgaacggcggcaggctgtcgaccgccgtatccatcctttccgtcatgattgaagacaatcccgacataccgcagctttgggcg

SEQ ID NO: 2574 - protein, 98 aa, Neisseria gonorrhoeae
MQQHIEKWQHLSREEQKILAEVWGLVQNDDQEVHYEMLKLNAPDEVSGEFWFRMAETLSTLPPNRSLDLRMNGGRLSTAVSILSVMIEDNPDIPQLWA

SEQ ID NO: 2575 - DNA, 345 bp, Neisseria gonorrhoeae
gtgtccgtgtaccaaataattgagggcggtaattttttacgcccaaagctgcggtatgtcgggattgtcttcaatcatgacggaaaggatggatacggcggtcgacagcctgccgccgttcattctaaggtcgagggaacgattgggcggcagggtgctgagtgtttctgccattctgaaccaaaattcaccgctgacttcatcaggtgcgttcaatttgagcatttcatagtgaacctcctgatcatcgttttgcacgagaccccatacttcggcaaggattttctgttcttcacggctcaagtgttgccacttttcaatatgttgctgcatatcttttccctt

SEQ ID NO: 2576 - protein, 115 aa, Neisseria gonorrhoeae
VSVYQIIEGGNFLRPKLRYVGIVFNHDGKDGYGGRQPAAVHSKVEGTIGRQGAECFCHSEPKFTADFIRCVQFEHFIVNLLIIVLHETPYFGKDFLFFTAQVLPLFNMLLHIFSL

SEQ ID NO: 2577 - DNA, 471 bp, Neisseria gonorrhoeae
ttgatatttatgcttaccatcgttttatatcagccggaaatccccccgaacacgggcaacatcatccgcctgtgcgccaataccggcgcggatttgcaccttgtcaaaccgctcggcttcccattggattccgccaaaatgaaacgcgccgggctcgactaccacgaattcgccagcctgacggtgcacgaaaacttcgacgactgcctcaagtcgctggcaggccgacgtattttcgccctgaccaccaaaggcacggcgcgccccgatgaaaccgcgtttcaaaaaggcgacgttttactgttcgggccggaaacgcgcgggctgcctgccgacatcctcgacagcctgcccgccgcgcaaaaaatccgcctgccgatgcggcccggcagccggagtatgaacctttccaacaccgtctccgtgattctctttgaagcgtggcggcaacacggttacgcaggcggcgtt

SEQ ID NO: 2578 - protein, 157 aa, Neisseria gonorrhoeae
LIFMLTIVLYQPEIPPNTGNIIRLCANTGADLHLVKPLGFPLDSAKMKRAGLDYHEFASLTVHENFDDCLKSLAGRRIFALTTKGTARPDETAFQKGDVLLFGPETRGLPADILDSLPAAQKIRLPMRPGSRSMNLSNTVSVILFEAWRQHGYAGGV

SEQ ID NO: 2579 - DNA, 750 bp, Neisseria gonorrhoeae
atgaccgacatcctcattgacgataccgccaccgaagccgtccgcaccctgatacgggcattccccctcgtgcccgtttcccaaccgcccgaacaaggcagttacctccttgctgaacacgataccgtcagcctcaggcttgtcggggaaaaaagcaacgtcatcgtcgattttacctccggcgcggcacaataccggcgcacaaaaggcggaggagaactcatcgccaaagccgtcaaccacaccgcgcaccccaccgtatgggatgcaaccgcaggattggggcgcgacagcttcgtcctcgcctcgctcggactgaccgttaccgccttcgagcaacatcccgccgtcgcctgcctgctttcagacggcatccgccgcgccctcctcaatcccgaaacgcaagacaccgccgcgcgcatcaacctccatttcggcaatgccgccgaacaaatgcctgcccttgttaaaacacaaggcaaacccgacatcgtttatctcgacccgatgtatcccgaacgccgcaaaagtgccgccgtcaaaaaagaaatggcttatttccaccggcttgtcggcgaagcgcaagatgaggtcgtcctccttcataccgcacgccaaacggcaaaaaaacgcgtcgtcgtcaaacgcccgcgcctcggcgaacaccttgccggacaagcccccgcctaccaatacaccggcaaaagcacccgcttcgacgtttacctgccctacggagcggacaaggga

SEQ ID NO: 2580 - protein, 250 aa, Neisseria gonorrhoeae
MTDILIDDTATEAVRTLIRAFPLVPVSQPPEQGSYLLAEHDTVSLRLVGEKSNVIVDFTSGAAQYRRTKGGGELIAKAVNHTAHPTVWDATAGLGRDSFVLASLGLTVTAFEQHPAVACLLSDGIRRALLNPETQDTAARINLHFGNAAEQMPALVKTQGKPDIVYLDPMYPERRKSAAVKKEMAYFHRLVGEAQDEVVLLHTARQTAKKRVVVKRPRLGEHLAGQAPAYQYTGKSTRFDVYLPYGADKG

SEQ ID NO: 2581 - DNA, 195 bp, Neisseria gonorrhoeae
ttggtacacggacacaaagcccgtgccgacggtttggtacaacagcccgacaaagcggcagaagccaacgaggaggaatacctgaccaaagccctgtcgcaaaacctgctgtcaacattggatgccgcacttgcacgttttcctgaagacgcgtggtttcaggaaatcaaacaggatgcacaaaagcattttgct

SEQ ID NO: 2582 - protein, 65 aa, Neisseria gonorrhoeae
LVHGHKARADGLVQQPDKAAEANEEEYLTKALSQNLLSTLDAALARFPEDAWFQEIKQDAQKHFA

SEQ ID NO: 2583 - DNA, 114 bp, Neisseria gonorrhoeae
atgcacaaaagcattttgcttgaggacgtggcggtcaggaatatttccattcaggaagaaaagaagtgcctaattgggtataatcagggtaaatcttattttatttcagaagat

SEQ ID NO: 2584 - protein, 38 aa, Neisseria gonorrhoeae
MHKSILLEDVAVRNISIQEEKKCLIGYNQGKSYFISED

SEQ ID NO: 2585 - DNA, 105 bp, Neisseria gonorrhoeae
ttgaacgaggcaaaaataaacggcaaacatctcggattaacaaaattcagaatcaagacagggcaataccataccgggtttgcgccaacccgctataaaattgca

SEQ ID NO: 2586 - protein, 35 aa, Neisseria gonorrhoeae
LNEAKINGKHLGLTKFRIKTGQYHTGFAPTRYKIA

SEQ ID NO: 2587 - DNA, 921 bp, Neisseria gonorrhoeae
ttgcctcgttcaaacggcggctctgatctgcgcggtttctgtttgccgtattcgcctatccgtaccgcaaatgttatactgggaaaaattcaccgattgtattttacggcgtatttgccgataggatggaagagacaaatgagcagaatccggcaggcttttgccgctttggatggcggaaaggcattgattccctatattgcggtgggcgaccccgatattcggacaactttggcattgatgcacggcatggttgcaagcggtgcggatattttggagttgggcgtgccgttttccgatccgatggcggacgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaatcccatacataagatgggttatcgggagtttgctcaggaagccgcaaaggcgggggtggacggcgtgttgacggtggattcccccatcgaaaccatcgattctttatatcgcgagctgaaggataacgaggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcgtcagtatatcgatattcccatcggtgtcggtttcggcatcagcaatgcggaaagcgcgcgcaaaatcggccgggttgccgccgcgatcattgtcggcagccggattgtgaaagagattgaaaacaatgcgggcaacgaggctgccgccgtcggtgctttggtcaaagagttaaaggatgccgtgcgc

SEQ ID NO: 2588 - protein, 307 aa, Neisseria gonorrhoeae
LPRSNGGSDLRGFCLPYSPIRTANVILGKIHRLYFTAYLPIGWKRQMSRIRQAFAALDGGKALIPYIAVGDPDIRTTLALMHGMVASGADILELGVPFSDPMADGPVIQRAAERALANGISLRDVLDVVRKFRETDTQTPVVLMGYLNPIHKMGYREFAQEAAKAGVDGVLTVDSPIETIDSLYRELKDNEVDCIFLIAPTTTEDRIKTIAELAGGFVYYVSLKGVTGAASLDTDEVSRKIEYLRQYIDIPIGVGFGISNAESARKIGRVAAAIIVGSRIVKEIENNAGNEAAAVGALVKELKDAVR

SEQ ID NO: 2589 - DNA, 876 bp, Neisseria gonorrhoeae
ttgtccatgagctggttagataaaatcctgccacccaaaatcaagaatcgtgggaaagacggtgcttccaatgttcccgagggtttgtggcgcaaatgcccgtcttgttcggcaaccgtttattcgaccgagttgcagcagaacaatcaggtctgcccgaaatgcaaccaccacaatccgttatcggcgcgccagcgtttgaacctgcttttggatgaggaaggcagggaggaagttgcgggtaatgtcaaaccgaccgatcctttgaagtttaaagacagcaaaaaatatccggaccgtttgagtgcggcacgcaagctgaccggggaagatgacgcgctggtggtgatgaaggggatgatgaacggtctgcccgtcgtcgttgccgcgtttgaattccgctttatcggcggttcgatgggttcggttgtgggcgagcgtttcgtacagggtgtccgccgtgcggttgccgataattgtccgtttgtctgtgtggcggcttccggcggcgcgcgtatgcaggagggtgtaaactcgctgatgcagatgacgaaaaccagtgccgcgctgcatttgctgacggaaaaacgcctgccgtttatatcggtgttgaccgatccgactatgggcggcgtatctgccagcttcgcatttttaggcgatgtcgtgcttgccgaaccgaacgcgctgatcggttttgccggtccgcgcgtgattgagcagacggtgcgcgaaacgctgccggaaggcttccaacgcgccgagtttctgctggaaaaaggcgcgatcgaccagattgtcgaccgccgcgatatgaagcggcgcatcagtgatttgattacgctgttgtgccgtcaggacaaagtttccgccacc

SEQ ID NO: 2590 - protein, 292 aa, Neisseria gonorrhoeae
LSMSWLDKILPPKIKNRGKDGASNVPEGLWRKCPSCSATVYSTELQQNNQVCPKCNHHNPLSARQRLNLLLDEEGREEVAGNVKPTDPLKFKDSKKYPDRLSAARKLTGEDDALVVMKGMMNGLPVVVAAFEFRFIGGSMGSVVGERFVQGVRRAVADNCPFVCVAASGGARMQEGVNSLMQMTKTSAALHLLTEKRLPFISVLTDPTMGGVSASFAFLGDVVLAEPNALIGFAGPRVIEQTVRETLPEGFQRAEFLLEKGAIDQIVDRRDMKRRISDLITLLCRQDKVSAT

SEQ ID NO: 2591 - DNA, 621 bp, Neisseria gonorrhoeae
ttggagaaacttatgcgccgcgccatccttctgattctgaccctgactgtcggcacgtcccttgccgccggcttcagccaaaaagacacgccgatcaacacccgctaccgcgaaacgcccgaagaagccgccgcccgcgaatttaaagaacataccgccgaactgccgcctctgcccgatgcgcactcggacggctggtttgacatttatgtggatgaaaattacggcaaacagccgaaaatcctgctcgacagcctgcaaattatgcccgcgcccgacggcagcatccgctacattctcaatatccgctccgacaaaggctacgacaacctgactgccgaaggcatattctgcgcccgctcctccatcgggttcggcaacggcaaactttcctcctacaaagtattcggatacggcgatacggtcaacagccgctggatacagccccgaaacgccgaatggaaaccgataggcggcacacttgggcgcaacgacgcattgcgcgccgtcctgtatcaggcattctgcgagggcggcgtacccgccgacacgcaaggtttggtacaacgcctgaaagaacgtgccggacgctatgccccgtcgatgaagccgcacgacaaa

SEQ ID NO: 2592 - protein, 207 aa, Neisseria gonorrhoeae
LEKLMRRAILLILTLTVGTSLAAGFSQKDTPINTRYRETPEEAAAREFKEHTAELPPLPDAHSDGWFDIYVDENYGKQPKILLDSLQIMPAPDGSIRYILNIRSDKGYDNLTAEGIFCARSSIGFGNGKLSSYKVFGYGDTVNSRWIQPRNAEWKPIGGTLGRNDALRAVLYQAFCEGGVPADTQGLVQRLKERAGRYAPSMKPHDK

SEQ ID NO: 2593 - DNA, 681 bp, Neisseria gonorrhoeae
gtgcggcttcatcgacggggcatagcgtccggcacgttctttcaggcgttgtaccaaaccttgcgtgtcggcgggtacgccgccctcgcagaatgcctgatacaggacggcgcgcaatgcgtcgttgcgcccaagtgtgccgcctatcggtttccattcggcgtttcggggctgtatccagcggctgttgaccgtatcgccgtatccgaatactttgtaggaggaaagtttgccgttgccgaacccgatggaggagcgggcgcagaatatgccttcggcagtcaggttgtcgtagcctttgtcggagcggatattgagaatgtagcggatgctgccgtcgggcgcgggcataatttgcaggctgtcgagcaggattttcggctgtttgccgtaattttcatccacataaatgtcaaaccagccgtccgagtgcgcatcgggcagaggcggcagttcggcggtatgttctttaaattcgcgggcggcggcttcttcgggcgtttcgcggtagcgggtgttgatcggcgtgtctttttggctgaagccggcggcaagggacgtgccgacagtcagggtcagaatcagaaggatggcgcggcgcataagtttctccaaattgaaaacggctttattttatggtttggcgggaagggctgcaagcaatcggggtataatctgacc

SEQ ID NO: 2594 - protein, 227 aa, Neisseria gonorrhoeae
VRLHRRGIASGTFFQALYQTLRVGGYAALAECLIQDGAQCVVAPKCAAYRFPFGVSGLYPAAVDRIAVSEYFVGGKFAVAEPDGGAGAEYAFGSQVVVAFVGADIENVADAAVGRGHNLQAVEQDFRLFAVIFIHINVKPAVRVRIGQRRQFGGMFFKFAGGGFFGRFAVAGVDRRVFLAEAGGKGRADSQGQNQKDGAAHKFLQIENGFILWFGGKGCKQSGYNLT

SEQ ID NO: 2595 - DNA, 222 bp, Neisseria gonorrhoeae
atgaacagcgaaactttagacgtaaccggattgaaatgtcccctgccgattttgcgggcaaaaaaggctttggcgcaaatgcggcagggcgaggtattgaccgttctggcgaccgacggcggcgcgccgggggactttgaggctttttgccgccaaaccggtcatgtgctgttggattcttccgaacaggacggcgtgttcacactggtcgtcaagcacaaa

SEQ ID NO: 2596 - protein, 74 aa, Neisseria gonorrhoeae
MNSETLDVTGLKCPLPILRAKKALAQMRQGEVLTVLATDGGAPGDFEAFCRQTGHVLLDSSEQDGVFTLVVKHK

SEQ ID NO: 2597 - DNA, 129 bp, Neisseria gonorrhoeae
ttgaagcgtggcggcaacacggttacgcaggcggcgtttgaacgcaggttcatgccgtctgaaaaccgttcggacacattccgaaccgctgccgcagcgtgcggcggttcggaacgcgtccgtagggca

SEQ ID NO: 2598 - protein, 43 aa, Neisseria gonorrhoeae
LKRGGNTVTQAAFERRFMPSENRSDTFRTAAAACGGSERVRRA

SEQ ID NO: 2599 - DNA, 387 bp, Neisseria gonorrhoeae
ttgatgttattgctgtcggcatttgtgcttgctgcgtgtaatgcccaaaaccggcaatccggtgtacggcatcaggattttgcacgcgtagccgtcgatttgtttcggagtgcctgcgtcctgactcaaggtagtttcgaaccggtttccaagtttgccgctgtcggacattttgtccctgtcggaaaggaagacctgtcccgtctgccgcccgctgttgcagaacccgatgtacaggcgttgtggacgcttgaacgcgatggcggcatttattatttgagcctgacgcgcgacagttgcagtgtgaaagccgagcgggcagacagtgccgcgcttttggaacatttctcagggcttgtccgacagccgccgaaaaatgccaatata

SEQ ID NO: 2600 - protein, 129 aa, Neisseria gonorrhoeae
LMLLLSAFVLAACNAQNRQSGVRHQDFARVAVDLFRSACVLTQGSFEPVSKFAAVGHFVPVGKEDLSRLPPAVAEPDVQALWTLERDGGIYYLSLTRDSCSVKAERADSAALLEHFSGLVRQPPKNANI

SEQ ID NO: 2601 - DNA, 432 bp, Neisseria gonorrhoeae
ttgactatatattggcatttttcggcggctgtcggacaagccctgagaaatgttccaaaagcgcggcactgtctgcccgctcggctttcacactgcaactgtcgcgcgtcaggctcaaataataaatgccgccatcgcgttcaagcgtccacaacgcctgtacatcgggttctgcaacagcgggcggcagacgggacaggtcttcctttccgacagggacaaaatgtccgacagcggcaaacttggaaaccggttcgaaactaccttgagtcaggacgcaggcactccgaaacaaatcgacggctacgcgtgcaaaatcctgatgccgtacaccggattgccggttttgggcattacacgcagcaagcacaaatgccgacagcaataacatcaatcaggacatccgcatttcagacggcatttatttgtgct

SEQ ID NO: 2602 - protein, 144 aa, Neisseria gonorrhoeae
LTIYWHFSAAVGQALRNVPKARHCLPARLSHCNCRASGSNNKCRHRVQASTTPVHRVLQQRAADGTGLPFRQGQNVRQRQTWKPVRNYLESGRRHSETNRRLRVQNPDAVHRIAGFGHYTQQAQMPTAITSIRTSAFQTAFICA

SEQ ID NO: 2603 - DNA, 591 bp, Neisseria gonorrhoeae; identical to SEQ ID NO: 1631

SEQ ID NO: 2604 - protein, 197 aa, Neisseria gonorrhoeae; identical to SEQ ID NO: 1632

SEQ ID NO: 2605 - DNA, 294 bp, Neisseria gonorrhoeae; identical to SEQ ID NO: 1633

SEQ ID NO: 2606 - protein, 98 aa, Neisseria gonorrhoeae; identical to SEQ ID NO: 1634

SEQ ID NO: 2607 - DNA, 168 bp, Neisseria gonorrhoeae
gtgcaggcaccgtttgaaaccaggcaaatcagctatgcctggcgggaatcgggcagccctgaagaaaccgtattgaccgcacaaaccgccgattccccggatttacccgtacaggcagtattgaacctaacgcaccgttcccataacgggaaacccctaattctcccc

SEQ ID NO: 2608 - protein, 56 aa, Neisseria gonorrhoeae
VQAPFETRQISYAWRESGSPEETVLTAQTADSPDLPVQAVLNLTHRSHNGKPLILP

SEQ ID NO: 2609 - DNA, 105 bp, Neisseria gonorrhoeae
ttgtcattcccacggaagtgggaatccgattcgttcagttttagttgttttcaagtttcaggcaacttccaaaccgtcattcccgcgaaagtgggaatccggaaa

SEQ ID NO: 2610 - protein, 35 aa, Neisseria gonorrhoeae
LSFPRKWESDSFSFSCFQVSGNFQTVIPAKVGIRK

SEQ ID NO: 2611 - DNA, 1401 bp, Neisseria gonorrhoeae
atgaatactacattgaaaactaccttgacctctgttgcagcagcctttgcattgtctgcctgcaccatgattcctcaatacgagcagcccaaagtcgaagttgcggaaaccttccaaaacgacacatcggtttcttccatccgcgcggttgatttgggttggcatgactattttgccgacccgcgcctgcaaaagctgatcgacatcgcactcgagcgcaataccagtttgcgtacagccgtattgaacagcgaaatctaccgcaaacaatacatgatcgagcgcaacaacctcctgcccacgcttgccgccaatgcgaacggctcgcgccaaggcagcttgagcggcggcaatgtcagcagcagctacaatgtcggactgggtgcggcatcttacgaactcgatctgttcgggcgcgtgcgcagcagcagcgaagcagcactgcaaggctattttgccagcgttgccaaccgcgatgcggcacatttgagtctgattgccaccgttgccaaagcctatttcaacgagcgttatgccgaaaaagcgatgtctttggcgcagcgtgtcttgaaaacgcgcgaggaaacctacaagctgtccgaattgcggtacaaggcaggcgtgatttccgccgtcgccctgcgccagcaggaagccttgattgaatctgccaaagccgattatgcccatgccgcgcgcagccgcgaacaggcgcgcaatgccttggcaaccttgattaaccgtccgatacccgaagacctgcccgccggtttgccgttggacaagcagttttttgttgaaaaactgcctgccggtttgagttccgaagtattgctcgaccgtcccgacatccgcgccgccgaacacgcgctcaaacaggcaaacgccaatatcggtgcggcgcgcgccgcctttttcccgtccatccgcctgaccggaagcgtcggtacgggttctgtcgaattgggcgggctgttcaaaagcggcacgggcgtttgggcgttcgctccgtctattaccctgccgatttttacttggggaacgaacaaggcgaaccttgatgtggcaaaactgcgccaacaggcacaaattgttgcctatgaatccgccgtccaatccgcctttcaagacgtggcaaacgcattggcggcgcgcgagcagctggataaagcctatgacgctttaagcaaacaaagccgcgcctctaaagaagcgttgcgcttggtcggactgcgttacaaacacggcgtatccggcgcgctcgatttgctcgatgcggaacgcatcagctattcggcggaaggtgcggctttgtcggcacaactgacccgcgccgaaaaccttgccgatttgtacaaggcgctcggcggcggattgaaacgggatacccaaaccggcaaa

SEQ ID NO: 2612 - protein, 467 aa, Neisseria gonorrhoeae
MNTTLKTTLTSVAAAFALSACTMIPQYEQPKVEVAETFQNDTSVSSIRAVDLGWHDYFADPRLQKLIDIALERNTSLRTAVLNSEIYRKQYMIERNNLLPTLAANANGSRQGSLSGGNVSSSYNVGLGAASYELDLFGRVRSSSEAALQGYFASVANRDAAHLSLIATVAKAYFNERYAEKAMSLAQRVLKTREETYKLSELRYKAGVISAVALRQQEALIESAKADYAHAARSREQARNALATLINRPIPEDLPAGLPLDKQFFVEKLPAGLSSEVLLDRPDIRAAEHALKQANANIGAARAAFFPSIRLTGSVGTGSVELGGLFKSGTGVWAFAPSITLPIFTWGTNKANLDVAKLRQQAQIVAYESAVQSAFQDVANALAAREQLDKAYDALSKQSRASKEALRLVGLRYKHGVSGALDLLDAERISYSAEGAALSAQLTRAENLADLYKALGGGLKRDTQTGK

SEQ ID NO: 2613 - DNA, 198 bp, Neisseria gonorrhoeae
ttgttcctttttagatttttggtttccagacggcatgccgactttatgccgtctgaagtcaggggagaattaggggtttcccgttatgggaacggtgcgttaggttcaatactgcctgtacgggtaaatccggggaatcggcggtttgtgcggtcaatacggtttcttcagggctgcccgattcccgccaggcatagc

SEQ ID NO: 2614 - protein, 66 aa, Neisseria gonorrhoeae
LFLFRFLVSRRHADFMPSEVRGELGVSRYGNGALGSILPVRVNPGNRRFVRSIRFLQGCPIPARHS

SEQ ID NO: 2615 - DNA, 1032 bp, Neisseria gonorrhoeae
atgcaaaccctgaccatcatccgacccgacgatatgcacctgcacctgcgcgacggcgacgcgctcaaagccgttgccccttataccgcccgccagatggggcgcgccgtcatcatgcccaacctcaaaccgccagtcgtcagcgtagccgacgcgcttgcctacaaagcgcgcattatggcggcgttgcccgaaggcagcgcgtttgagccgctgatgacgctttacctgaccgaccaagccacgcccgaactcgtgcgcgaagccaaagccgccggcatcgtcgccttcaaactctaccccgcaggcgcgaccaccaattccgattccggcgtaaccgacctgttcaagctcatccccgtgttggaagaaatggcaaaacagggcatcctgttcctcgttcacggcgaagtaaccgaccccgaaatcgacattttcgaccgcgaagccgcctttatcgggcgcgtgatgaaacccgttttggcgcaagtgccgaatctcaaagtcgtgttcgaacacatcaccaccgccgaagccgcccgcctcgttttggaagccggcgacaacgttgccgccaccgttaccccgcaacacctcctgctcaaccgcaacgacctcttggtcggcggcgtgcgcccccatcatttctgcctgcccgtcctcaagcgcgaaacccaccgtcaggcattggtcgccgccgttaccggcgagaaggcgcacaaattcttcctcggcaccgactccgcgccgcacgccaaatccgccaaagaaaacgcctgcggctgcgccggtatgttcagcgcgatgaccgctatcgagctttacgccgaagtgtttgaaaaagcaggcgcgttggacaaactcgaagccttcgcctcgaaaaacggcgcaaggttctacggcattccggaaaacgccgacacgattacccttgtcaaacaaagccaaaccgttcccgcaagcgtcccttacggcgacggcgaacttgtcccgatgcgcgcgggcggcgaaatcggctggacggtgcagtat

SEQ ID NO: 2616 - protein, 344 aa, Neisseria gonorrhoeae
MQTLTIIRPDDMHLHLRDGDALKAVAPYTARQMGRAVIMPNLKPPVVSVADALAYKARIMAALPEGSAFEPLMTLYLTDQATPELVREAKAAGIVAFKLYPAGATTNSDSGVTDLFKLIPVLEEMAKQGILFLVHGEVTDPEIDIFDREAAFIGRVMKPVLAQVPNLKVVFEHITTAEAARLVLEAGDNVAATVTPQHLLLNRNDLLVGGVRPHHFCLPVLKRETHRQALVAAVTGEKAHKFFLGTDSAPHAKSAKENACGCAGMFSAMTAIELYAEVFEKAGALDKLEAFASKNGARFYGIPENADTITLVKQSQTVPASVPYGDGELVPMRAGGEIGWTVQY

SEQ ID NO: 2617 - DNA, 1119 bp, Neisseria gonorrhoeae
ttgaccgttcaatcaatactgcaccgtccagccgatttcgccgcccgcgcgcatcgggacaagttcgccgtcgccgtaagggacgcttgcgggaacggtttggctttgtttgacaagggtaatcgtgtcggcgttttccggaatgccgtagaaccttgcgccgtttttcgaggcgaaggcttcgagtttgtccaacgcgcctgctttttcaaacacttcggcgtaaagctcgatagcggtcatcgcgctgaacataccggcgcagccgcaggcgttttctttggcggatttggcgtgcggcgcggagtcggtgccgaggaagaatttgtgcgccttctcgccggtaacggcggcgaccaatgcctgacggtgggtttcgcgcttgaggacgggcaggcagaaatgatgggggcgcacgccgccgaccaagaggtcgttgcggttgagcaggaggtgttgcggggtaacggtggcggcaacgttgtcgccggcttccaaaacgaggcgggcggcttcggcggtggtgatgtgttcgaacacgactttgagattcggcacttgcgccaaaacgggtttcatcacgcgcccgataaaggcggcttcgcggtcgaaaatgtcgatttcggggtcggttacttcgccgtgaacgaggaacaggatgccctgttttgccatttcttccaacacggggatgagcttgaacaggtcggttacgccggaatcggaattggtggtcgcgcctgcggggtagagtttgaaggcgacgatgccggcggctttggcttcgcgcacgagttcgggcgtggcttggtcggtcaggtaaagcgtcatcagcggctcaaacgcgctgccttcgggcaacgccgccataatgcgcgctttgtaggcaagcgcgtcggctacgctgacgactggcggtttgaggttgggcatgatgacggcgcgccccatctggcgggcggtataaggggcaacggctttgagcgcgtcgccgtcgcgcaggtgcaggtgcatatcgtcgggtcggatgatggtcagggtttgcatggttgttcctttttagatttttggtttccagacggcatgccgactttatgccgtctgaagtcaggggagaat

SEQ ID NO: 2618 - protein, 373 aa, Neisseria gonorrhoeae
LTVQSILHRPADFAARAHRDKFAVAVRDACGNGLALFDKGNRVGVFRNAVEPCAVFRGEGFEFVQRACFFKHFGVKLDSGHRAEHTGAAAGVFFGGFGVRRGVGAEEEFVRLLAGNGGDQCLTVGFALEDGQAEMMGAHAADQEVVAVEQEVLRGNGGGNVVAGFQNEAGGFGGGDVFEHDFEIRHLRQNGFHHAPDKGGFAVENVDFGVGYFAVNEEQDALFCHFFQHGDELEQVGYAGIGIGGRACGVEFEGDDAGGFGFAHEFGRGLVGQVKRHQRLKRAAFGQRRHNARFVGKRVGYADDWRFEVGHDDGAPHLAGGIRGNGFERVAVAQVQVHIVGSDDGQGLHGCSFLDFWFPDGMPTLCRLKSGEN

SEQ ID NO: 2619 - DNA, 423 bp, Neisseria gonorrhoeae
atgaaaacagcccgccgccgttcccgcgagcttgccgtacaagccgtttaccaatcccttatcaaccgcaccgccgcgcccgaaattgctaaaaacatccgcgaaatgtccgactttgccaaagcggacgaagaattgttcaacaaactcttcttcggcacacaaaccaatgcagcggactacatccaaaaaatccgcccgctgctcgacagggacgaaaaagacctcaaccccatcgaacgcgccgttttgctgaccgcctgccacgagctttccgctatgcccgaaacgccctaccccgtcattatcaacgaagccatcgaagttaccaaaaccttcggcggcacggacgggcacaaattcgtcaacggcatcctcgacaaactcgccgcccaaatccgcccagacgagcccaaacgccgt

SEQ ID NO: 2620 - protein, 141 aa, Neisseria gonorrhoeae
MKTARRRSRELAVQAVYQSLINRTAAPEIAKNIREMSDFAKADEELFNKLFFGTQTNAADYIQKIRPLLDRDEKDLNPIERAVLLTACHELSAMPETPYPVIINEAIEVTKTFGGTDGHKFVNGILDKLAAQIRPDEPKRR

SEQ ID NO: 2621 - DNA, 738 bp, Neisseria gonorrhoeae
ttgaacggtcaagcaaaatgccgtctgaaaggttttcagacggcatttgtgtattttccgattcggattttccgagtatcaacggcgtttgggctcgtctgggcggatttgggcggcgagtttgtcgaggatgccgttgacgaatttgtgcccgtccgtgccgccgaaggttttggtaacttcgatggcttcgttgataatgacggggtagggcgtttcgggcatagcggaaagctcgtggcaggcggtcagcaaaacggcgcgttcgatggggttgaggtctttttcgtccctgtcgagcagcgggcggattttttggatgtagtccgctgcattggtttgtgtgccgaagaagagtttgttgaacaattcttcgtccgctttggcaaagtcggacatttcgcggatgtttttagcaatttcgggcgcggcggtgcggttgataagggattggtaaacggcttgtacggcaagctcgcgggaacggcggcgggctgttttcatgatttttccttgaaacggttgggcggcacggtatgccgtctgaaacggaaagggcgcatcggtgtacgccctgtttgttattcttcgtcttcaaactgttcttcgagcagaaggttgacgaggttggcgcattctacggcgactttggcggcatccgaggctttttctccaatccgttcaattgcctgcgcgtcgttttcggtggtcaggacggcgttggcaatcgggatgttg

SEQ ID NO: 2622 - protein, 246 aa, Neisseria gonorrhoeae
LNGQAKCRLKGFQTAFVYFPIRIFRVSTAFGLVWADLGGEFVEDAVDEFVPVRAAEGFGNFDGFVDNDGVGRFGHSGKLVAGGQQNGAFDGVEVFFVPVEQRADFLDVVRCIGLCAEEEFVEQFFVRFGKVGHFADVFSNFGRGGAVDKGLVNGLYGKLAGTAAGCFHDFSLKRLGGTVCRLKRKGRIGVRPVCYSSSSNCSSSRRLTRLAHSTATLAASEAFSPIRSIACASFSVVRTALAIGML

SEQ ID NO: 2623 - DNA, 681 bp, Neisseria gonorrhoeae
atgccgtctgaaacggaaagggcgcatcggtgtacgccctgtttgttattcttcgtcttcaaactgttcttcgagcagaaggttgacgaggttggcgcattctacggcgactttggcggcatccgaggctttttctccaatccgttcaattgcctgcgcgtcgttttcggtggtcaggacggcgttggcaatcgggatgttgtagtcgagtgcgacgcggccgatccctgcgccggattcgttggcaaccagctcgaaatggtaggtttcgccacggatgacgacgccgatggcaatcagtgcgtcaaatttttcggaagaggcaaagttcatcagcgcgatggggatttcaagcgcgccgggtacggtggcgacggtgatgttttcgtctgctacgcccaattcttggagggtgcggcagcagactttgagcatttggctgccgatttcgttggtgaagcgtgcctgtacgatgccgatgcggaggtgtttgccgtcgaggttgggggcgatggtgttcattgggtgtcctttggtattcggggtttcggaatgccgtctgaaggtttcagtcttgcggctgccagtcggcaacggtttggaatgtgccgtcttcggcaagctcccacgcgctgccttcgggttgggaaagcagtgcggcggtttcagggttggttttgg

SEQ ID NO: 2624 - protein, 227 aa, Neisseria gonorrhoeae
MPSETERAHRCTPCLLFFVFKLFFEQKVDEVGAFYGDFGGIRGFFSNPFNCLRVVFGGQDGVGNRDVVVECDAADPCAGFVGNQLEMVGFATDDDADGNQCVKFFGRGKVHQRDGDFKRAGYGGDGDVFVCYAQFLEGAAADFEHLAADFVGEACLYDADAEVFAVEVGGDGVHWVSFGIRGFGMPSEGFSLAAASRQRFGMCRLRQAPTRCLRVGKAVRRFQGWFW

SEQ ID NO: 2625 - DNA, 546 bp, Neisseria gonorrhoeae
ttgccgactggcagccgcaagactgaaaccttcagacggcattccgaaaccccgaataccaaaggacacccaatgaacaccatcgcccccaacctcgacggcaaacacctccgcatcggcatcgtacaggcacgcttcaccaacgaaatcggcagccaaatgctcaaagtctgctgccgcaccctccaagaattgggcgtagcagacgaaaacatcaccgtcgccaccgtacccggcgcgcttgaaatccccatcgcgctgatgaactttgcctcttccgaaaaatttgacgcactgattgccatcggcgtcgtcatccgtggcgaaacctaccatttcgagctggttgccaacgaatccggcgcagggatcggccgcgtcgcactcgactacaacatcccgattgccaacgccgtcctgaccaccgaaaacgacgcgcaggcaattgaacggattggagaaaaagcctcggatgccgccaaagtcgccgtagaatgcgccaacctcgtcaaccttctgctcgaagaacagtttgaagacgaagaa

SEQ ID NO: 2626 - protein, 182 aa, Neisseria gonorrhoeae
LPTGSRKTETFRRHSETPNTKGHPMNTIAPNLDGKHLRIGIVQARFTNEIGSQMLKVCCRTLQELGVADENITVATVPGALEIPIALMNFASSEKFDALIAIGVVIRGETYHFELVANESGAGIGRVALDYNIPIANAVLTTENDAQAIERIGEKASDAAKVAVECANLVNLLLEEQFEDEE

SEQ ID NO: 2627 - DNA, 321 bp, Neisseria gonorrhoeae
atgaacgcatttgcacaagcactttcctcggcactcgaccgctgcatcgccaccaacaccgtcgccaaacaaaaccggcccgtcggcttcctttaccgcgaagcccccgtttttgaaaacgacagcggctggcgtttcttcagcggcgacgaaaccgacgaatacaccgacgaccccgacaacttcagcatcgtcagcctcgccgacatcaccaaaaccaaccctgaaaccgccgcactgctttcccaacccgaaggcagcgcgtgggagcttgccgaagacggcacattccaaaccgttgccgactggcagccgcaagac

SEQ ID NO: 2628 - protein, 107 aa, Neisseria gonorrhoeae
MNAFAQALSSALDRCIATNTVAKQNRPVGFLYREAPVFENDSGWRFFSGDETDEYTDDPDNFSIVSLADITKTNPETAALLSQPEGSAWELAEDGTFQTVADWQPQD

SEQ ID NO: 2629 - DNA, 417 bp, Neisseria gonorrhoeae
ttgggaaagcagtgcggcggtttcagggttggttttggtgatgtcggcgaggctgacgatgctgaagttgtcggggtcgtcggtgtattcgtcggtttcgtcgccgctgaagaaacgccagccgctgtcgttttcaaaaacgggggcttcgcggtaaaggaagccgacgggccggttttgtttggcgacggtgttggtggcgatgcagcggtcgagtgccgaggaaagtgcttgtgcaaatgcgttcattgcgggaatacgttggggggggggaaacttgcggattttaccacgattcccgcgttgtcggcagacggcggcggtttggtggtacaatgtgcgccgtttgcagccttaaggtgtttctgtatttttggagtatggaaacgcattcgggctgttttttgcggaagacgg

SEQ ID NO: 2630 - protein, 139 aa, Neisseria gonorrhoeae
LGKQCGGFRVGFGDVGEADDAEVVGVVGVFVGFVAAEETPAAVVFKNGGFAVKEADGPVLFGDGVGGDAAVECRGKCLCKCVHCGNTLGGGKLADFTTIPALSADGGGLVVQCAPFAALRCFCIFGVWKRIRAVFCGRR

SEQ ID NO: 2631 - DNA, 684 bp, Neisseria gonorrhoeae
ttgactttaacccgaaaaacccttttcctcctcaccgccgcgttcggcacacactcccttcagacggcatccgccgacgcagtggtcaagccggaaaaactgcacgcctccgccaaccgcagctacaaagtcgccgaattcacgcaaaccggcaacgcctcgtggtacggcggcaggtttcacgggcgcaaaacttccggcggagaccgctacgatatgaacgcctttaccgccgcccacaaaaccctgcccatccccagccatgtgcgcgtaaccaacaccaaaaacggcaaaagcgtcatcgtccgcgtcaacgaccgcggccccttccacggcaaccgcatcatcgacgtatccaaagccgccgcgcaaaaattgggctttgtcagccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaatttcgccgcttcgtcatcaagcccgaacctctcggttgaaaaacgccgttacgaatacgttgtcaaaatgggcccgtttgcctcgcaggaacgcgccgccgaagccgaagcgcaggcacgcggtatggttcgggcggtactgacctccggt

SEQ ID NO: 2632 - protein, 228 aa, Neisseria gonorrhoeae
LTLTRKTLFLLTAAFGTHSLQTASADAVVKPEKLHASANRSYKVAEFTQTGNASWYGGRFHGRKTSGGDRYDMNAFTAAHKTLPIPSHVRVTNTKNGKSVIVRVNDRGPFHGNRIIDVSKAAAQKLGFVSQGTAHVKIEQIVPGQSAPVAENKDIFIDLKSFGTEHEAQAYLNQAAQNFAASSSSPNLSVEKRRYEYVVKMGPFASQERAAEAEAQARGMVRAVLTSG

SEQ ID NO: 2633 - DNA, 210 bp, Neisseria gonorrhoeae
ttgccgttcttatgcaaacgagaaaccggtttttgcgtttcgactgttttggataagtcatcacaccttaaagtttgtcattcccacggaagtgggaatccgattcgttcagttttagttgttttcaagtttcaggcaacttccaaaccgtcattcccgcgaaagtgggaatccggaaatgaaaggcaacaggaatttatcgtaaatgac

SEQ ID NO: 2634 - protein, 70 aa, Neisseria gonorrhoeae
LPFLCKRETGFCVSTVLDKSSHLKVCHSHGSGNPIRSVLVVFKFQATSKPSFPRKWESGNERQQEFIVND

SEQ ID NO: 2635 - DNA, 144 bp, Neisseria gonorrhoeae
atgcgtttccatactccaaaaatacagaaacaccttaaggctgcaaacggcgcacattgtaccaccaaaccgccgccgtctgccgacaacgcgggaatcgtggtaaaatccgcaagtttccccccccccaacgtattcccgcaa

SEQ ID NO: 2636 - protein, 48 aa, Neisseria gonorrhoeae
MRFHTPKIQKHLKAANGAHCTTKPPPSADNAGIVVKSASFPPPNVFPQ

SEQ ID NO: 2637 - DNA, 732 bp, Neisseria gonorrhoeae
ttgcggaagacggtaatgaaagacgatgttttgaaacggcaggcacatactgcgatacagaaaaagttaggctacgcgttccgcgatatgtcgcttttgcggcgggctttgacccacaggagccatcatgcgaagcacaacgaacggttcgagtttgtcggcgattcgattttgaattatacggtggcgcggatgctgtttgacgcgtttccgaagttgaccgagggcgagttgtcgcggttgagggcgagtctggtcaatgagggcgtgctggcggaaatggcggcggaaatgaatgtcggcgacggtctgtatttgggggcgggcgagttgaagagcagcggcttcagacggccttcgatactggcggacgcgatggaggcgatgtttgccgccgtcagcttcgatgccgatttcaacacggcggaaaaggtggtgcgccatttgtttgcagaacgcgtccggcgcgccgatttccaaaatcaggcaaaagacggcaaaactgctttgcaggaggcgttgcaggcgcgccgtttcgccttgccgaaataccgcatcgaagagcaaatcggccatgccgacgacagtatgtttgtcatttcctgcgatttgggcgaactgggtttcgtgtgccgtgccaaagggacgagccgcaaggcggcggaacaggaggcggcgaaagaggctttgaaatggctggaagagaagctgccgctgaagaagaaaaagaaa

SEQ ID NO: 2638 - protein, 244 aa, Neisseria gonorrhoeae
LRKTVMKDDVLKRQAHTAIQKKLGYAFRDMSLLRRALTHRSHHAKHNERFEFVGDSILNYTVARMLFDAFPKLTEGELSRLRASLVNEGVLAEMAAEMNVGDGLYLGAGELKSSGFRRPSILADAMEAMFAAVSFDADFNTAEKVVRHLFAERVRRADFQNQAKDGKTALQEALQARRFALPKYRIEEQIGHADDSMFVISCDLGELGFVCRAKGTSRKAAEQEAAKEALKWLEEKLPLKKKKK

SEQ ID NO: 2639 - DNA, 939 bp, Neisseria gonorrhoeae
gtggatatgaaagcgaatatggatattgaaaccttccttgcaggggaacgcgccgccggcggataccgttgcggcttcgtggcgattgtcggtcgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgccgggctttcaaaccgaccaccgcaacgcgctcaacgacaggctgaatcaaaatgttaccgaggcgctcggcggtgtggatgtggtggttttcgtcgtggaggcgatgcgccttaccgatgccgaccgcgtcgtgttgaaacaactgcccaagcacacgccggtcattttagtgatcaacaaaatcgacaaggacaaggcgaaagaccgttacgcgctggaggcgtttgttgcccaagtgcgcgccgaatttgaatttgcggcggcggaggcggtcagtgcgaaacacggtttgcggattgccaacctgttggagctgctcaagccgtatctgcccgaaagcgtaccgatgtatcccgaagacatggttacggacaaatcggcgcgttttttggcgatggaaatcgtgcgtgaaaaactcttccgctatttgggcgaggagctgccttatgcgatgaacgtcgaagtggagcagtttgaagagggagacggtttgaaccgcatctacatcgccgttttggtcgacaaagaaagccaaaaggcgattttgatcggtaaaggcggggagcgtttgaaaaaaatttccaccgaagcgcggctggatatggaaaaactgtttgataacaaagtatttttgaaggtctgggtcaaagtcaaatccggttgggcagacgacattcgcttcctgcgcgagctgggtttg

SEQ ID NO: 2640 - protein, 313 aa, Neisseria gonorrhoeae
VDMKANMDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRLTDADRVVLKQLPKHTPVILVINKIDKDKAKDRYALEAFVAQVRAEFEFAAAEAVSAKHGLRIANLLELLKPYLPESVPMYPEDMVTDKSARFLAMEIVREKLFRYLGEELPYAMNVEVEQFEEGDGLNRIYIAVLVDKESQKAILIGKGGERLKKISTEARLDMEKLFDNKVFLKVWVKVKSGWADDIRFLRELGL

SEQ ID NO: 2641 - DNA, 723 bp, Neisseria gonorrhoeae
ttgccccgccccggcaccaaagaggcggcagacctgatttcagacggcaaaagccgggggatacaggcaaaaaccgcttacggcagtaaaaaccgccaatttatgaagtcgctcggcgcggggttcagcaaagacggttgggaagggctgctaatccgaaccgaacgccaagggcgggaaacgcgcccgcacggcgatattgcggacggggtggaatacggcatagaccgtttggacgcgttccgccagacatacgatattaaacgcaagacaacagagccatttttcttagtagagggcgagaatacactcaagcccgtggcaaaattggcgggctacgggatatatttgaaccgccagctcaaccgctgggtaaaagaacgtattgaacaaaatcagcctttaagtgctgaagaagaggcgcaggtgcgggaggcgcaggcgcgccacgaaaacctgtccgcccaagcctacacgggcggcggcaggatattgcccgatccgatggattaccgcagcggctcttggcttgccaagctgggctaccgcttcggcggcaggcattatgtcggcggcgtgtttgaggataccaaacagcgttacgacatccgcgatatgacggaaaacagtattacggtacggacgaggcggaaaagtttagagacaagagcggggtgtacgacggcgacgatttccgcgacggcttgtattttgtgccgaata

SEQ ID NO: 2642 - protein, 241 aa, Neisseria gonorrhoeae
LPRPGTKEAADLISDGKSRGIQAKTAYGSKNRQFMKSLGAGFSKDGWEGLLIRTERQGRETRPHGDIADGVEYGIDRLDAFRQTYDIKRKTTEPFFLVEGENTLKPVAKLAGYGIYLNRQLNRWVKERIEQNQPLSAEEEAQVREAQARHENLSAQAYTGGGRILPDPMDYRSGSWLAKLGYRFGGRHYVGGVFEDTKQRYDIRDMTENSITVRTRRKSLETRAGCTTATISATACILCRI

SEQ ID NO: 2643 - DNA, 681 bp, Neisseria gonorrhoeae
gtgtacgacggcgacgatttccgcgacggcttgtattttgtgccgaatatagaagagtggaagggcgataaaaatttggtcaagggcataggtttgaaatattcccgcaccaaatttattgacgaacatcaccgccgccgccgtatgggtttgctgtaccgttatgaaaatgagaaatactcggacaactgggcggataaggcggtgttgtcgtttgacaaacagggcgtggcaaccgacaacaacacgctgaagctgaattgcgccgtgtatcctgccgtggacaaatcctgccgcgcgtcggcggacaaaccgtattcctacgacagcagcgaccgtttccactaccgcgaacagcacaatgttttgaatgcctcgtttgagaagtcgctgaaaaacaaatggacgaaacaccatctgactttgggcttcggttacgatgcttccaaagcagtatcccgcccagaacagctttcccacaatgcggcaaggatttcggaatccacgggattcgatgaaaagaatcaagataagtaccgtttgggtaagcccgaagtcgtcgaagggtcggtctgcggctatatcgaaaccctgcgttgccgcaaatgcgtgccaagaaaaatcaacggcagcaatattccacatttctttgaacgaccgtttttcaatcggcaaatattt

SEQ ID NO: 2644 - protein, 227 aa, Neisseria gonorrhoeae
VYDGDDFRDGLYFVPNIEEWKGDKNLVKGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASKAVSRPEQLSHNAARISESTGFDEKNQDKYRLGKPEVVEGSVCGYIETLRCRKCVPRKINGSNIPHFFERPFFNRQIF

SEQ ID NO: 2645 - DNA, 993 bp, Neisseria gonorrhoeae
ttgaacgaccgtttttcaatcggcaaatattttgatttcagcttgggcggcaggtacgaccggaaaaacttcaccacgtcggaagaactcgtccgcagcgggcggtatgccgaccgttcgtggaacagcggcatcgtgttcaaaccgaaccggcatttttccgtgtcttaccgcgcctccagcggcttcagaacgccttccttccaagaacttttcgggatagacatttatcacgattatccgaaaggctggcagcgtcccgccctgaaatcggaaaaggcagccaaccgggaaatcggtttgcagtggaagggcgatttcggctttttggaaatcagcagtttccgcaaccgttataccgatatgattgccgttgccgatcaaaaaaccaaattgccggattcagcaggacgattgacagagattgatatacgcgattattacaatgcccaaaatatgtcgcttcaaggcatcaacatcttggggaaaatcgactggaacggcgtatacggcaaactgcccgaaggcctgtacaccacattggcgtacaaccgtatcaaaccgaaatcggtatccaaccggccggacttgtccctccgcagctatgctttggatgcggtacagccgtcgcgttatgttttggggttcggatacgaccagcccgaggggaaatggggcgcaaacattatgctgacctattccaaagggaaaaaccctgacgagcttgcttatctggcaggcgatcaaaaacgatattcggcaggaagggttacgtcttcttggaaaacggcagatgtttccgcttatctgaatctgaaaaaacggctgaccttgagggcggctatctacaatatcggcaactaccgctacgttacttgggaatccttgcgccagactgcggaaagcacggcaaaccggcacggcggcgacagcaactatggaaggtatgccgcaccgggcaggaacttcagcctcgcgctcgaaatgaagttt

SEQ ID NO: 2646 - protein, 331 aa, Neisseria gonorrhoeae
LNDRFSIGKYFDFSLGGRYDRKNFTTSEELVRSGRYADRSWNSGIVFKPNRHFSVSYRASSGFRTPSFQELFGIDIYHDYPKGWQRPALKSEKAANREIGLQWKGDFGFLEISSFRNRYTDMIAVADQKTKLPDSAGRLTEIDIRDYYNAQNMSLQGINILGKIDWNGVYGKLPEGLYTTLAYNRIKPKSVSNRPDLSLRSYALDAVQPSRYVLGFGYDQPEGKWGANIMLTYSKGKNPDELAYLAGDQKRYSAGRVTSSWKTADVSAYLNLKKRLTLRAAIYNIGNYRYVTWESLRQTAESTANRHGGDSNYGRYAAPGRNFSLALEMKF

SEQ ID NO: 2647 - DNA, 3201 bp, Neisseria gonorrhoeae
atggctaaattctttatcgaccgccccattttcgcgtgggttatttcgattttcattattgcggcaggtattttcggcattaaaagcctgccggtttcgcaatatccgtccgttgccgccccgaccattactttgcacgccatttatccgggtgcgtccgcacaagtgatggaaggcagcgtactttccgtgatcgaacggaatatgaacggcgtggaaggtttggactatatgtccacttccgccgattcgagcggcagcggcagcgtgagcctgacctttacgcccgataccgacgagaatctggcgcaggtggaagtgcagaacaagctttccgaagtattgagcacgctgccggcaaccgtccagcaatacggcgtaaccgtatccaaggcgcgttccaatttcctgatgattgtgatgctttcgtcggatgtgcagtcaaccgaagagatgaacgactacgcgcagcgcaacgtcgttcccgaattgcagcgtatcgaaggcgtggggcaggtccgcctgttcggcgcgcaacgcgcgatgcggatttgggtcgatcctaagaaactgcaaaactacaatttgtcgtttgccgatgtcggcagcgcgttgtcggcgcagaatatccaaatttccgcaggttccatcggttcgcttcccgctgtgcgcggacagacggttacggctaccgtaacggcgcaagggcagttgggtacggcagaagaattcggcaacgtcatcctccgcgccaataccgacggttctaatatttacctgaaggatgtggcgaaagtcggattgggtatggaagactattcttcctcaacccgcctgaacggggtaaataccaccggtatggcggtaatgttgtccaacagcggcaatgcgatggcgacggcaaaggcggtaaaagaacgcttggcggtgctggaaaaatactttccgcagggtatgagttggaaaaccccttacgatacttccaaattcgttgaaatttcgattgaaaaagtgattcacactttaatcgaagcgatggtgctggtgtttgtcgtaatgtacctcttcctgcaaaacatccgttatacgctgattccgaccatcgtcgtaccgatttccctgttgggcggtttcgccttcatctcttatatggggatgtcgattaacgtattgacgatgtttgcgatgatattggtcatcggcatcgtggtcgatgacgcgattgtggtggttgaaaacgtcgagcgcattatggcgggtgaaggcctgccgcccaaagaagcgaccaaaaaagcgatgggtcagatttcgggcgcggtcatcggtattaccgccgttctgatttccgtgttcgtgcctctggcgatgttcagcggggcggccggcaatatttacaaacagtttgccctgacgatggcgtcatcaatcgcattctccgccttccttgcgctgacccttacccctgctttgtgtgccacaatgttgaagacaatcccgaaagggcatcacgaagagaaaaaaggtttcttcggctggttcaacaagaaattcgacagttggacgcacggctacgaaggccgggttgccaaagtgctgcgtaagactttccgcatgatggttgtctatatcggcttggcggttgtgggcgtgttcctgtttatgcgcctgccgacttcgttcctgccgaccgaagaccaaggcttcgttatggtcagcgtgcaactgcctgcgggtgcgaccaaagagcgcaccgatgcgacgctagcacaagttacccaactggcgaaaagcattcccgaaattgaaaacatcattaccgtttccggcttcagcttttcgggcagcggtcagaatatggcgatgggttttgccatattgaaagattggaacgaacgtaccgcctccggcagcgatgccgttgcggttgccggcaagctgacgggtatgatgatggggacgcttaaagacggtttcggcatctccgtcgtcccgcctccgattctggagttgggcaacggttcgggcctgagcatcaacctgcaagaccgcaacaataccggccataccgcattgctggcgaagcgcaacgagctgattcagaaaatgcgtgccagcggtttgtttgaccccagcaccgtccgtgccggcggtttggaagactcgccgcagttgaaaatcgacatcaaccgtgccgcagcggcggcgcaaggcatttcgtttgccgacatccgcaccgcattggcaagcgcgctgagttcgtcttatgtcagcgacttcccgaaccaaggccgtctgcaacgcgtgatggtgcaggccgacgaggatgcccgtatgcagcctgccgatattttgaacctgaccgtgccgaacaaatccggcgtcgccgtaccgctttccaccattgctactgtttcttgggaaaacggtacggaacagagcgtacgcttcaacggttatccctcgatgaagctgtccgcttcgcctgcaaccggcgtttccaccgggcaggctatggcggcggttcaaaaaatggttgacgaattgggcggcggttacagcttcgaatggggtggacagtcgcgcgaagaggcaaaaggcggctcgcaaaccctgattttgtacggtttggcggttgcagccgtatttttggtacttgccgcgctttatgaaagctggtcgattccgctggcggtcatccttgtgattccgttgggtttgatcggtgcggctgcgggcgtaaccgggcgcaacctgtttgaaggactgttgggcagcgttccctcgtttgccaacgacatctacttccaagtcggtttcgttactgtgatgggtttgagtgcgaaaaacgcgattctgattatcgaatttgccaaagaccttcaagcgcaagggaaaagcgcggtcgaagccgctttggaggcagcccgcctgcgtttccgtccgattatcatgacctcgtttgcctttattttgggcgtggttcccctgtatattgccgctggtgcgagttctgccagccagcgcgccatcggcacgaccgtattctgggggatgttggtcggcacgctcttgtccgtgttccttgttccgcttttttatgtagtggtgcgcaaattcttcaaagaaactgcacacgagcatgaaatggcggtcagacatgcatcaaaagcgggtataaccggttcggacgataaacaatat

SEQ ID NO: 2648 - protein, 1067 aa, Neisseria gonorrhoeae
MAKFFIDRPIFAWVISIFIIAAGIFGIKSLPVSQYPSVAAPTITLHAIYPGASAQVMEGSVLSVIERNMNGVEGLDYMSTSADSSGSGSVSLTFTPDTDENLAQVEVQNKLSEVLSTLPATVQQYGVTVSKARSNFLMIVMLSSDVQSTEEMNDYAQRNVVPELQRIEGVGQVRLFGAQRAMRIWVDPKKLQNYNLSFADVGSALSAQNIQISAGSIGSLPAVRGQTVTATVTAQGQLGTAEEFGNVILRANTDGSNIYLKDVAKVGLGMEDYSSSTRLNGVNTTGMAVMLSNSGNAMATAKAVKERLAVLEKYFPQGMSWKTPYDTSKFVEISIEKVIHTLIEAMVLVFVVMYLFLQNIRYTLIPTIVVPISLLGGFAFISYMGMSINVLTMFAMILVIGIVVDDAIVVVENVERIMAGEGLPPKEATKKAMGQISGAVIGITAVLISVFVPLAMFSGAAGNIYKQFALTMASSIAFSAFLALTLTPALCATMLKTIPKGHHEEKKGFFGWFNKKFDSWTHGYEGRVAKVLRKTFRMMVVYIGLAVVGVFLFMRLPTSFLPTEDQGFVMVSVQLPAGATKERTDATLAQVTQLAKSIPEIENIITVSGFSFSGSGQNMAMGFAILKDWNERTASGSDAVAVAGKLTGMMMGTLKDGFGISVVPPPILELGNGSGLSINLQDRNNTGHTALLAKRNELIQKMRASGLFDPSTVRAGGLEDSPQLKIDINRAAAAAQGISFADIRTALASALSSSYVSDFPNQGRLQRVMVQADEDARMQPADILNLTVPNKSGVAVPLSTIATVSWENGTEQSVRFNGYPSMKLSASPATGVSTGQAMAAVQKMVDELGGGYSFEWGGQSREEAKGGSQTLILYGLAVAAVFLVLAALYESWSIPLAVILVIPLGLIGAAAGVTGRNLFEGLLGSVPSFANDIYFQVGFVTVMGLSAKNAILIIEFAKDLQAQGKSAVEAALEAARLRFRPIIMTSFAFILGVVPLYIAAGASSASQRAIGTTVFWGMLVGTLLSVFLVPLFYVVVRKFFKETAHEHEMAVRHASKAGITGSDDKQY

SEQ ID NO: 2649 - DNA, 198 bp, Neisseria gonorrhoeae
ttgggtagcggcaatcttcaaaagtcgtctgaaaaatcagaagttctagattcccgttttcacgggaatgacggaatttcagacggcatcctcccgccccgtcattcccgcgcaggcgggaatctagtccgttcggtttcagtcatttacgataaattcctgttgcctttcatttccggattcccactttcgcgggaa

SEQ ID NO: 2650 - protein, 66 aa, Neisseria gonorrhoeae
LGSGNLQKSSEKSEVLDSRFHGNDGISDGILPPRHSRAGGNLVRSVSVIYDKFLLPFISGFPLSRE

SEQ ID NO: 2651 - DNA, 123 bp, Neisseria gonorrhoeae
atgggcgcaagcctgatccagccatgccgcgtgtctgaagaaggccttcgggttgtaaaggacttttgtcagggaagaaaaggccgttgccaatatcggcggccgatgacggtacctgaagaa

SEQ ID NO: 2652 - protein, 41 aa, Neisseria gonorrhoeae
MGASLIQPCRVSEEGLRVVKDFCQGRKGRCQYRRPMTVPEE

SEQ ID NO: 2653 - DNA, 138 bp, Neisseria gonorrhoeae
atgccgtctggaagcttgatctgcaccccaaaagtcggactaaaccgccaactgattaaggtgcaggtttttttgattcaatataaacaagatttccgccgtcattcccgcgcaggcgggaatccggacattcaatgc

SEQ ID NO: 2654 - protein, 46 aa, Neisseria gonorrhoeae
MPSGSLICTPKVGLNRQLIKVQVFLIQYKQDFRRHSRAGGNPDIQC

SEQ ID NO: 2655 - DNA, 129 bp, Neisseria gonorrhoeae
gtgggaatccggttttttgagtttcagtcatttccgataaattgccttagcattgaatgtccggattcccgcctgcgcgggaatgacggcggaaatcttgtttatattgaatcaaaaaaacctgcacct

SEQ ID NO: 2656 - protein, 43 aa, Neisseria gonorrhoeae
VGIRFFEFQSFPINCLSIECPDSRLRGNDGGNLVYIESKKPAP

SEQ ID NO: 2657 - DNA, 624 bp, Neisseria gonorrhoeae
atgaggaaaatccgcaccaaaatctgcggcatcaccacaccggaagacgcactgtatgccgcccacgccggcgcagacgcattgggactggttttttacccccaaagcccccgcgctatcgacatcattaaagcacaaaaaatcgccgccgcactgccgccgtttgtcagcgttgtcgcccttttcgtcaacgaaagcgcgcaaaacatccgccgcatccttgccgaagtgccgatacacatcatccaattccacggcgacgaagacgatgcattctgccggcagttcgaccgcccctatattaaagccattcgtgttcagacggcatcagacatccgaaacgccgccacgcgcttccccaacgctcaggcactgctgttcgatgcctatcacccttcggaatacggcggcaccggacaccgcttcgactggacgctgttggcggaatattcgggcaagccgtgggtgcttgccggcgggctgacccctgaaaacgtcggcgaagccgtccgcatcaccggagcggaagcggtcgacgtatccggcggcgtggaagcgtctaaaggcaaaaaagaccccgccaaagtcgccgcctttatcgcaaccgccaaccgcctatcccgt

SEQ ID NO: 2658 - protein, 208 aa, Neisseria gonorrhoeae
MRKIRTKICGITTPEDALYAAHAGADALGLVFYPQSPRAIDIIKAQKIAAALPPFVSVVALFVNESAQNIRRILAEVPIHIIQFHGDEDDAFCRQFDRPYIKAIRVQTASDIRNAATRFPNAQALLFDAYHPSEYGGTGHRFDWTLLAEYSGKPWVLAGGLTPENVGEAVRITGAEAVDVSGGVEASKGKKDPAKVAAFIATANRLSR

SEQ ID NO: 2659 - DNA, 537 bp, Neisseria gonorrhoeae
gtgcgcttgtgccgtttcagacggcattcccgatcagtcgattttgatgtattcgacagaaaggatttcaatttcctcacggccttccggcgtgttcaaaaccacttcgtcgccttcgcgcgctttaatcaggcaacgcgccaacggcgaaatccaagaaattttgttttgcgcggtatcgatttcatcgacgccgacgattttgacggtttgctcgcgcccgtcgccgcgcaacagaccgacggtcgcgccgaaaaatacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttattgaccagttgataaagctcgtctttcaatgcctgccatccggcgggcgtaatgtagtttttggtttcggtactcatattgtgtgcgga

SEQ ID NO: 2660 - protein, 179 aa, Neisseria gonorrhoeae
VRLCRFRRHSRSVDFDVFDRKDFNFLTAFRRVQNHFVAFARFNQATRQRRNPRNFVLRGIDFIDADDFDGLLAPVAAQQTDGRAEKYLVGRFAQFGIDDDGSLQTFGQETDAAVDFAHTAFAVKIVAVFAAVAVACRPVDDLDDFGAFFIDQLIKLVFQCLPSGGRNVVFGFGTHIVCG

SEQ ID NO: 2661 - DNA, 489 bp, Neisseria gonorrhoeae
atgagtaccgaaaccaaaaactacattacgcccgccggatggcaggcattgaaagacgagctttatcaactggtcaataaagaacgccccgaaatcgtccaaatcgtcaactgggcggcaggcaacggcgaccgcagcgaaaacggcgactatctttacggcaaacgccgtatgcgcgaaatcgaccgccgcatccgtttcctgaccaaacgtttggaggctgccgtcgtcgtcgatcccgaattgcgcgaagcgaccgaccaagtatttttcggcgcgaccgtcggtctgttgcgcggcgacgggcgcgagcaaaccgtcaaaatcgtcggcgtcgatgaaatcgataccgcgcaaaacaaaatttcttggatttcgccgttggcgcgttgcctgattaaagcgcgcgaaggcgacgaagtggttttgaacacgccggaaggccgtgaggaaattgaaatcctttctgtcgaatacatcaaaatcgac

SEQ ID NO: 2662 - protein, 163 aa, Neisseria gonorrhoeae
MSTETKNYITPAGWQALKDELYQLVNKERPEIVQIVNWAAGNGDRSENGDYLYGKRRMREIDRRIRFLTKRLEAAVVVDPELREATDQVFFGATVGLLRGDGREQTVKIVGVDEIDTAQNKISWISPLARCLIKAREGDEVVLNTPEGREEIEILSVEYIKID

SEQ ID NO: 2663 - DNA, 1542 bp, Neisseria gonorrhoeae
atgtgcggcgtattaggtttggtcagtcatgaacccgtgaaccagcttctgtacgacggtttgcagatgttgcagcacagggggcaggatgcggcgggcattgcaacggcggaaggcggtaccttccatatgcacaaaggcaaagggatggtgagcgaagtgttccgcacgcgcaatatgcgcgatttgaccggcaacgccggcatcgcccacgtccgttatcccacggcgggcaacgccggcagcagcgcggaggcgcagcctttctacgtcagctcgcctttcggcatcgttttggcgcacaacggcaacctcaccaacactgccgaactgtatgaaaacgtgtgtaacaaacacctgcgccacatcaacaccggctccgattccgaagttttgctcaacgtattcgcgcacgaattgcgccgcgaagtctctaaaaacgccgacccgcaccggctcaatgccgacaatattttcaacgccgttgccgaagtccaccgcctagtgcgcggtgcatacggcgtggttgccatgattgcgggctacggtatgctcgccttccgcgacccttacggcatccgcccgctggcattgggttcgcaaaccgacagcgaaggcaggaaatcctatgccgtcgcctccgaatccgtcgccttcaatgcgcttgcctacgatttggaacgcgatatccggccgggcgaagcggtatttgtcggctttaacggcacaatcatcgcccgacaatgcagcgaccgtgccaaactcagcccctgcctttttgaatatgtttattttgcccgccccgactctgtgattgacggtgtatcggtttaccaatcgcgcttggatatgggcgtgtccttggcggaaaaaatcaaacgcgagctgcccgtggacggcatcgacgtcgtgatgcccattcccgataccagccgccccagtgcaatggagcttgccgtccacctcaacaaaccctaccgcgagggtttgattaaaaaccgctatatcggccgcacctttattatgcccggtcagtcgacgcgcaaaaaatccgtgcgccaaaaactcagcccgatggaaaccgaatttgcaggcaaaagcgtgttgctggtggacgactccatcgtgcgcgggacgaccagccgcgaaatcgtcgaaatggtacgcgcggcgggcgcgcgcaaagtctatatcgcctccgccgcgcccgaagtgcgctatcccaatgtgtacggcatcgatatgcccacgcgcgaagagttgattgccaacgggcgcagcgcggcggaaatcgccgccgaaatcggcgcggacggcatcgtgtttcaagacttgggcgatttggaagccgtcgtcaaagcactcaacccgaaaatcgaatccttcgattcgtcctgtttcaacggcatttatcggaccggcgacatcgatgatgcctacctcgaccgcctgtctgccgagaaatccggctgcgccggtctgaaaatccacccgagcaggatggaacacagcatcagcatcagcgatgcgggcgacgaagaa

SEQ ID NO: 2664 - protein, 514 aa, Neisseria gonorrhoeae
MCGVLGLVSHEPVNQLLYDGLQMLQHRGQDAAGIATAEGGTFHMHKGKGMVSEVFRTRNMRDLTGNAGIAHVRYPTAGNAGSSAEAQPFYVSSPFGIVLAHNGNLTNTAELYENVCNKHLRHINTGSDSEVLLNVFAHELRREVSKNADPHRLNADNIFNAVAEVHRLVRGAYGVVAMIAGYGMLAFRDPYGIRPLALGSQTDSEGRKSYAVASESVAFNALAYDLERDIRPGEAVFVGFNGTIIARQCSDRAKLSPCLFEYVYFARPDSVIDGVSVYQSRLDMGVSLAEKIKRELPVDGIDVVMPIPDTSRPSAMELAVHLNKPYREGLIKNRYIGRTFIMPGQSTRKKSVRQKLSPMETEFAGKSVLLVDDSIVRGTTSREIVEMVRAAGARKVYIASAAPEVRYPNVYGIDMPTREELIANGRSAAEIAAEIGADGIVFQDLGDLEAVVKALNPKIESFDSSCFNGIYRTGDIDDAYLDRLSAEKSGCAGLKIHPSRMEHSISISDAGDEE

SEQ ID NO: 2665 - DNA, 159 bp, Neisseria gonorrhoeae
gtggcgtttcagacagcatacctgatttatgccgtccgaaacgccttttctttccttgacacaccccgacagacaaagcgcacctgcctgactttacacaaatattgtcaacaattcgggcaaaaagccgccgtttgctttataattccgtttcaccct

SEQ ID NO: 2666 - protein, 53 aa, Neisseria gonorrhoeae
VAFQTAYLIYAVRNAFSFLDTPRQTKRTCLTLHKYCQQFGQKAAVCFIIPFHP

SEQ ID NO: 2667 - DNA, 456 bp, Neisseria gonorrhoeae
atgggtggtttccttcttttttgccaaactctttgccgcacccttcgccgacctcgcctttgcctcgttccaaccccgcctgtttgcattggctctgtcattcatttccctgttcgtcattgcctgtctgatccagaaaatgctccgttcgctgctgaccggcgcagtttcggcggtcggtctgggctttgccaaccgcattttgggcggtgtattcggtgcattgaaaggcgttttgattgttaccctgctgatcatgcttgcttcaaaaaccgacctgcccgataccgaagaatggcaacagtcctataccgtaccgtttttcgtatcgctttccgaagcggtgttaaaccatacggacaacgcacccgaatccctcgacgacgactaatccgcatacgtggcgtttcagacagcatacctgatttatgccgtccgaaacgccttttctttcct

SEQ ID NO: 2668 - protein, 152 aa, Neisseria gonorrhoeae
MGGFLLFCQTLCRTLRRPRLCLVPTPPVCIGSVIHFPVRHCLSDPENAPFAADRRSFGGRSGLCQPHFGRCIRCIERRFDCYPADHACFKNRPARYRRMATVLYRTVFRIAFRSGVKPYGQRTRIPRRRLIRIRGVSDSIPDLCRPKRLFFP

SEQ ID NO: 2669 - DNA, 324 bp, Neisseria gonorrhoeae
atgaacatcaaacaccttctcttgaccgccgccgcaaccgcactgttgggcatttccgcccccgcactcgcccaccacgacggacacggcgatgacgaccacggacacgccgcacaccaacacggcaaacaagacaaaatcatcagccgcgcccaagccgaaaaagcggcttgggcgcgtgtcggcggcaaaatcaccgacatcgatctcgaacacgacgacggccgtccgcactatgatgtcgaaatcgtcaaaaacggacaggaatacaaagtcgttgtcgatgcccgtaccggccgcgtgatttcctcccgccgcgacgac

SEQ ID NO: 2670 - protein, 108 aa, Neisseria gonorrhoeae
MNIKHLLLTAAATALLGISAPALAHHDGHGDDDHGHAAHQHGKQDKIISRAQAEKAAWARVGGKITDIDLEHDDGRPHYDVEIVKNGQEYKVVVDARTGRVISSRRDD

SEQ ID NO: 2671 - DNA, 105 bp, Neisseria gonorrhoeae
atgctgttgtcaattaaagtagtatctcgtcattcccgcaaaagcgggaatccagatcattgggtagcggcaatcttcaaaagtcgtctgaaaaatcagaagttc

SEQ ID NO: 2672 - protein, 35 aa, Neisseria gonorrhoeae
MLLSIKVVSRHSRKSGNPDHWVAAIFKSRLKNQKF

SEQ ID NO: 2673 - DNA, 495 bp, Neisseria gonorrhoeae
atgaatagcctccccattgccgacctcctcgcctccgccgtcatcgccgcctgcatcgtcatttccacgatgcgcggcgtgattgcggaagcaggttcgatggtggcatgggtggtttccttcttttttgccaaactctttgccgcacccttcgccgacctcgcctttgcctcgttccaaccccgcctgtttgcattggctctgtcattcatttccctgttcgtcattgcctgtctgatccagaaaatgctccgttcgctgctgaccggcgcagtttcggcggtcggtctgggctttgccaaccgcattttgggcggtgtattcggtgcattgaaaggcgttttgattgttaccctgctgatcatgcttgcttcaaaaaccgacctgcccgataccgaagaatggcaacagtcctataccgtaccgtttttcgtatcgctttccgaagcggtgttaaaccatacggacaacgcacccgaatccctcgacgacgac

SEQ ID NO: 2674 - protein, 165 aa, Neisseria gonorrhoeae
MNSLPIADLLASAVIAACIVISTMRGVIAEAGSMVAWVVSFFFAKLFAAPFADLAFASFQPRLFALALSFISLFVIACLIQKMLRSLLTGAVSAVGLGFANRILGGVFGALKGVLIVTLLIMLASKTDLPDTEEWQQSYTVPFFVSLSEAVLNHTDNAPESLDDD

SEQ ID NO: 2675 - DNA, 1038 bp, Neisseria gonorrhoeae
atgtccgaaaacaaacaaaacgaagtcctgaccggttacgaacagctgaaacggcgcaaccgccgccgcctcgtaacggcaagctccctggttgccgcctcctgcatcctgctggcagccgcactcagttccgatcctgccgacagcaatcccgcaccgcaggccggcgaaaccggcgcaacggaaagccaaacggcaaacacggcacaaacccctgccttgaaatccgccgccgaaaacggggaaaccgccgccgacaaaccgcaggacttggcaggcgaagacaagccttctgccgccgacagcgaaatcagcgagcctgaaaacgtaggcgcgccgctggtgctgattaacgaccggctcgaagacagcaacatcaaaggtttggaagaatccgagaaactgcaacaggcagaaaccgccaaaaccgaaccgaagcaggcaaaacaacgcgctgccgaaaaagtgtcggcaactgccgacagtacggatacggtagcggttgaaaaaccgaaacgcactgccgaacccaaaccgcaaaaagcggaacgcactgccgaagccaagcccaaagccaaagaaaccaaaaccgccgaaaaagttgccgacaaaccgaaaactgctgccgaaaaaaccaaaccggatacggcaaaatccgacagcgcggtaaaagaagcgaaaaaagccgacaaggctgaaggcaaaaagacagccgaaaaagaccgttcggacggcaaaaaacacgaaacggcgcaaaaaaccgacaaagcggacaaaaccaaaaccgccgagaaggaaaaatccggcaaggcgggcaaaaaagccgccattcaggcaggttatgccgaaaaagaacgcgccttgagcctccagcgcaaaatgaaggcggcgggtatcgattcgaccatcaccgaaatcatgaccgacaacggcaaagtttaccgcgtcaaatcaagcaactataaaaacgcaagggatgccgaacgcgatttgaacaaactgcgcgtgcacggcatcgccggccaggtaacgaatgaa

SEQ ID NO: 2676 - protein, 346 aa, Neisseria gonorrhoeae
MSENKQNEVLTGYEQLKRRNRRRLVTASSLVAASCILLAAALSSDPADSNPAPQAGETGATESQTANTAQTPALKSAAENGETAADKPQDLAGEDKPSAADSEISEPENVGAPLVLINDRLEDSNIKGLEESEKLQQAETAKTEPKQAKQRAAEKVSATADSTDTVAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAAIQAGYAEKERALSLQRKMKAAGIDSTITEIMTDNGKVYRVKSSNYKNARDAERDLNKLRVHGIAGQVTNE

SEQ ID NO: 2677 - DNA, 1272 bp, Neisseria gonorrhoeae
atgaaaacactacaagactggctctcgcatttggaaaccgcccacagcggcggtttgatcgacatgggtttggagcgcgtaagcgaagtaaaaaagcgcatgaacctgacaccgcaatgccccgtcgtcgtcgtcgcgggaacaaacggcaaaggttcggtctgcgcctacctgacacagatttacaaacaggcaggcttcaaaaccggcacgctgaccagcccgcatttattgcattacaacgaacgcatcgccatcaacgccgaacccgtttcggacgatacgattattgcctctttcgagcgcatcgaagccgcgcgcggcgaaatatcgctgacttattttgaattcaatgccttggcggctgtcgacattttcatacgcgaacaagtggatgtaatgatattggaagtcggcttgggcggacgtttggacgcggtcaacgcgtttgacggcgattgcgcggtggttactagtgtggatttggaccatcaggcatttttgggcgatacggtcgaacaggtcggctttgaaaaggcaggcgtgttccgcagcggcaaacccgccatctgcggtcaaaaccccgcgcccgcatcattggtcgcacacgccgaagccataggcgcgaaactgctgatggtacagcgcgatttcgagtttcacgcgatggaaaacatccaatggaactaccgcttccggccgcagcattcagacggccccgcacgcaaccgcaatgccctgcccttccccgcattgcgcggcgcataccagctttctaacgccgcctgcgcgttgaccgtattggaatgcctcgacgacagactgccggtggacattggtgcaatcaaacgcgggctgctgctggttgaaaatcccggacgcttccaagtcctgcccggccggccgctgaccgtattggatgtcggacacaacccccacgccgcccgcgccctgcgccgcaacctaatcaaccttgcctacgcgcaaaagcgcaccgccgtgttcagtatgctgtccgacaaagacatagacggcgtgtcggaaaccgttaaagaccagtttgacgagtggtatatcgcgcctttggacgtgccgcgcggtatgacggcggatgcactgaaagccaaattggaacaacaccacatcgaaaacatacagacattcgccgccgtccgcgacgcgtaccgggcggcagcctcaaaagcgggcgaagacgacagaatcgtcgtattcggctcatttcataccgtcgccgacgtaatgtcggtactg

SEQ ID NO: 2678 - protein, 424 aa, Neisseria gonorrhoeae
MKTLQDWLSHLETAHSGGLIDMGLERVSEVKKRMNLTPQCPVVVVAGTNGKGSVCAYLTQIYKQAGFKTGTLTSPHLLHYNERIAINAEPVSDDTIIASFERIEAARGEISLTYFEFNALAAVDIFIREQVDVMILEVGLGGRLDAVNAFDGDCAVVTSVDLDHQAFLGDTVEQVGFEKAGVFRSGKPAICGQNPAPASLVAHAEAIGAKLLMVQRDFEFHAMENIQWNYRFRPQHSDGPARNRNALPFPALRGAYQLSNAACALTVLECLDDRLPVDIGAIKRGLLLVENPGRFQVLPGRPLTVLDVGHNPHAARALRRNLINLAYAQKRTAVFSMLSDKDIDGVSETVKDQFDEWYIAPLDVPRGMTADALKAKLEQHHIENIQTFAAVRDAYRAAASKAGEDDRIVVFGSFHTVADVMSVL

SEQ ID NO: 2679 - DNA, 438 bp, Neisseria gonorrhoeae
atgcgcgcctttcagacggcattgaggccgtcccgcatcctgaacatcctgaccgtatcactccactcggcttccattgccgtctgcctgacttggttttacggccggatgatgtggttcggtttggcggctttggcggcaagttacgcatactcgctcaggataacgaatctgaaacaccgccatgccataaccgccattaccatagaccgcgacggacgggcggaaatcgtatccggcaaagacaaaacagcggcaacacttgcgggcagcagtatggttacgccttatgccttattcttacaatgggacacaggcggcaaaaccgtccgccaatgcatcatgcccgacatgacggacaaagaatcctaccggcggctgaaagtctgggtgctttggcggcagccgaaaaaaaccgccgaaaccgatacatcagac

SEQ ID NO: 2680 - protein, 146 aa, Neisseria gonorrhoeae
MRAFQTALRPSRILNILTVSLHSASIAVCLTWFYGRMMWFGLAALAASYAYSLRITNLKHRHAITAITIDRDGRAEIVSGKDKTAATLAGSSMVTPYALFLQWDTGGKTVRQCIMPDMTDKESYRRLKVWVLWRQPKKTAETDTSD

SEQ ID NO: 2681 - DNA, 372 bp, Neisseria gonorrhoeae
ttgagaaagcacaccatgtattttgttgaccgcaccgccgccgtcctcaagccgaccgcgcgctttttggaatggctcaaaagcaccgacgaaaatatgcccgacctgaccatagaacagcttcgcgccgactgttccgtcttcctcgttccgcagttcgacgaaccggaagccgtcgtttcctacttcgacgaacgctaccggcagatttttgaggcggagctggcaggttgggacatcgacaaggacaaatggccgcaagatatggggctgaaggcgttttgggaatttttcgacattgaaatccacgatatggttttggatatggaagaagcggatttgaacatcacgcccgtgttcgacaatatgatg

SEQ ID NO: 2682 - protein, 124 aa, Neisseria gonorrhoeae
LRKHTMYFVDRTAAVLKPTARFLEWLKSTDENMPDLTIEQLRADCSVFLVPQFDEPEAVVSYFDERYRQIFEAELAGWDIDKDKWPQDMGLKAFWEFFDIEIHDMVLDMEEADLNITPVFDNMM

SEQ ID NO: 2683 - DNA, 1191 bp, Neisseria gonorrhoeae
atggcgttacatcatattgtcgaacacgggcgtgatgttcaaatccgcttcttccatatccaaaaccatatcgtggatttcaatgtcgaaaaattcccaaaacgccttcagccccatatcttgcggccatttgtccttgtcgatgtcccaacctgccagctccgcctcaaaaatctgccggtagcgttcgtcgaagtaggaaacgacggcttccggttcgtcgaactgcggaacgaggaagacggaacagtcggcgcgaagctgttctatggtcaggtcgggcatattttcgtcggtgcttttgagccattccaaaaagcgcgcggtcggcttgaggacggcggcggtgcggtcaacaaaatacatggtgtgctttctcaatcatcttgcggtgtcgggctatgccgtctgaacgttcggttttcagacggcatagcatcaatgggtcatgacttgttgcaggaactgcttggcgcgttcgtgtttcgggttggtgaaaaacgcttccggcgtttcgtcttcaaggatttgccctttatcgacgaaaatcacgcggtcggcaacttcgcgggcaaaccccatttcgtgggttacgcacatcatcgtcatgccgctttccgccaagtctttcatcactttcaacacttcgccgaccatttcggggtcgagtgcggaagtcggctcgtcaaacagcatcacgcgcggctccatcgccagcccgcgcgcaatcgccacgcgttgctgctggccgccggaaagttgggaagggaaggcgtcttttttgtgtgccagtccgacgcgttccaaaagctccattgcctttttctccgcctgttccgcattttgccccttaaccttcatcggtgcgagggtgatgttgtccaacacggtcaggtgcgggtagaggttgaaactttgaaacacaaagccgacttcttcgcggattttgttcaaatcggttttggggtcggcaacgttgacgccgtccacccaaatctcgccgctttcgatgctttcaagctggttgacggtgcggatgagtgtggatttgccgctgcccgaaggcccgcagacgacgaccacttcgccttttttgatttccaagtttacgccgttgatgacgtgcaggtctttgaaatgtttgtgtacgtttttgaatttgatcatagtgtccattcttttcgggcagtc

SEQ ID NO: 2684 - protein, 397 aa, Neisseria gonorrhoeae
MALHHIVEHGRDVQIRFFHIQNHIVDFNVEKFPKRLQPHILRPFVLVDVPTCQLRLKNLPVAFVEVGNDGFRFVELRNEEDGTVGAKLFYGQVGHIFVGAFEPFQKARGRLEDGGGAVNKIHGVLSQSSCGVGLCRLNVRFSDGIASMGHDLLQELLGAFVFRVGEKRFRRFVFKDLPFIDENHAVGNFAGKPHFVGYAHHRHAAFRQVFHHFQHFADHFGVECGSRLVKQHHARLHRQPARNRHALLLAAGKLGREGVFFVCQSDAFQKLHCLFLRLFRILPLNLHRCEGDVVQHGQVRVEVETLKHKADFFADFVQIGFGVGNVDAVHPNLAAFDAFKLVDGADECGFAAARRPADDDHFAFFDFQVYAVDDVQVFEMFVYVFEFDHSVHSFRAV

SEQ ID NO: 2685 - DNA, 735 bp, Neisseria gonorrhoeae
atggacactatgatcaaattcaaaaacgtacacaaacatttcaaagacctgcacgtcatcaacggcgtaaacttggaaatcaaaaaaggcgaagtggtcgtcgtctgcgggccttcgggcagcggcaaatccacactcatccgcaccgtcaaccagcttgaaagcatcgaaagcggcgagatttgggtggacggcgtcaacgttgccgaccccaaaaccgatttgaacaaaatccgcgaagaagtcggctttgtgtttcaaagtttcaacctctacccgcacctgaccgtgttggacaacatcaccctcgcaccgatgaaggttaaggggcaaaatgcggaacaggcggagaaaaaggcaatggagcttttggaacgcgtcggactggcacacaaaaaagacgccttcccttcccaactttccggcggccagcagcaacgcgtggcgattgcgcgcgggctggcgatggagccgcgcgtgatgctgtttgacgagccgacttccgcactcgaccccgaaatggtcggcgaagtgttgaaagtgatgaaagacttggcggaaagcggcatgacgatgatgtgcgtaacccacgaaatggggtttgcccgcgaagttgccgaccgcgtgattttcgtcgataaagggcaaatccttgaagacgaaacgccggaagcgtttttcaccaacccgaaacacgaacgcgccaagcagttcctgcaacaagtcatgacccat

SEQ ID NO: 2686 - protein, 245 aa, Neisseria gonorrhoeae
MDTMIKFKNVHKHFKDLHVINGVNLEIKKGEVVVVCGPSGSGKSTLIRTVNQLESIESGEIWVDGVNVADPKTDLNKIREEVGFVFQSFNLYPHLTVLDNITLAPMKVKGQNAEQAEKKAMELLERVGLAHKKDAFPSQLSGGQQQRVAIARGLAMEPRVMLFDEPTSALDPEMVGEVLKVMKDLAESGMTMMCVTHEMGFAREVADRVIFVDKGQILEDETPEAFFTNPKHERAKQFLQQVMTH

SEQ ID NO: 2687 - DNA, 453 bp, Neisseria gonorrhoeae; identical to SEQ ID NO: 243

SEQ ID NO: 2688 - protein, 189 aa, Neisseria gonorrhoeae
LNCRQAALKPFITVYKRINHKIHNRIPDFSFNRPSEQTMKYTAALLTFLLTACMNPNDAFFQNRRYQMPEAQLNGSNAVFHYGYSQNPDHDLLVDQVRVPDAYRASFARDWIAKEQGYRKNDCVLEKAESGGVTYYTCDAEKGFNGTRFVIYVVNMKNDKGYVKVYRGMNKPNQEELTKLVADLNKFYP

SEQ ID NO: 2689 - DNA, 567 bp, Neisseria gonorrhoeae; identical to SEQ ID NO: 245

SEQ ID NO: 2690 - protein, 189 aa, Neisseria gonorrhoeae; identical to SEQ ID NO: 246

SEQ ID NO: 2691 - DNA, 777 bp, Neisseria gonorrhoeae
atgaaagaacacaaagcccgcaagcgtttcgggcagaattttttgcaggacacgcggattatcggcgatattgtcaacgccgtgcgcccgcaggcggatgatgtcgtgattgaaatcggcccgggtttggcggcaattaccgaacctttggcgaaaaagctgaaccgcctgcacgttgtcgaaatcgaccgcgacatcgtatgccgtctgaaaacgctgccgtttgcggataaactggtgattcacgaaggcgacgtgttgcagtttgatttcaacggcatctcaggcaaaaagaaaatcgtcggcaacctgccgtataacatctccacgccgcttttgttcaaactggcggaggtggcggacgatgtcgccgatatgcactttatgttgcaaaaagaagtggtcgagcgcatggttgccgcgccgaaaagcaacgactacggtcgcttgggtgtgatgctgcaatattttttcgatatggagctgctgattgacgtgccgcccgaatcgttcgatcccgcgccgaaaatcgattccgcagtggtgcgcatgattccggtgaaacaccgtatcggcaaggcggacgatttcgatcatttcgccaaactggtgaaactcgccttccgccaacgccgcaaaaccatacgcaacaacctgaaagaacttgccgacgacgatgatttgcaggcagtcggcatcagtccgcaagaccgtgccgaacacatcgcgccggagaaatatgtggcgttgagcaattatctggcggacaaggccgtc

SEQ ID NO: 2692 - protein, 259 aa, Neisseria gonorrhoeae
MKEHKARKRFGQNFLQDTRIIGDIVNAVRPQADDVVIEIGPGLAAITEPLAKKLNRLHVVEIDRDIVCRLKTLPFADKLVIHEGDVLQFDFNGISGKKKIVGNLPYNISTPLLFKLAEVADDVADMHFMLQKEVVERMVAAPKSNDYGRLGVMLQYFFDMELLIDVPPESFDPAPKIDSAVVRMIPVKHRIGKADDFDHFAKLVKLAFRQRRKTIRNNLKELADDDDLQAVGISPQDRAEHIAPEKYVALSNYLADKAV

SEQ ID NO: 2693 - DNA, 261 bp, Neisseria gonorrhoeae
atgaccgcagccttcggcggcaacacgggatcgaagggatgggtttcgatttcaagcagattttcagacacgttcaatcctccaacaggcaaagcggcagacagccggtttgcaccaaaccgccaaacacggcaagccttcaaacagcattatcacgccctgccgttttcggttacaatgccgacatcaaacggatactgtaaacacatttatgttccaacacacaggacgacacataaagcaccgccctatgtgtcgtcc

SEQ ID NO: 2694 - protein, 87 aa, Neisseria gonorrhoeae
MTAAFGGNTGSKGWVSISSRFSDTFNPPTGKAADSRFAPNRQTRQAFKQHYHALPFSVTMPTSNGYCKHIYVPTHRTTHKAPPYVSS

SEQ ID NO: 2695 - DNA, 612 bp, Neisseria gonorrhoeae
ttgcacccgacacttcaggattcggcacacatgatcagcagactgaccggcaaactggttgaaaaaaaccctccgcaaatcgtcatcgatgtcaacggtgtcggttatgaagccgacgtatcgatgcagaccttctacaacctgccgcccgtgggtgaaagcgtacaactgtttacccagcttatcattcgggaagacgcacatcttttatttggttttgccactgcggaagaacgcaagaccttccgccaactgattaaggtcggcggcatcggcgcgaaaacggctttgggcattttgtcggcgatgacggcagacgagctggcgcgggcggttgcagaagaagatgtcaaacgcctctcctccgctccgggaatcggcaaaaaaaccgccgaacgtatggtcttggaactgcgcggcaagctggtcgcgcatacggtaacggacgggctgtttgccgcctcacccgccgccgacgaaacggaagacatcgtcagcacgctgcttgcgctgggttacaacgaacgcgaggcaaaagcggcggtcaaaggcgttccgaaggggacggacgtgggcgaaggcgtgcgccttgccctgaaaaacctgctgaaa

SEQ ID NO: 2696 - protein, 204 aa, Neisseria gonorrhoeae
LHPTLQDSAHMISRLTGKLVEKNPPQIVIDVNGVGYEADVSMQTFYNLPPVGESVQLFTQLIIREDAHLLFGFATAEERKTFRQLIKVGGIGAKTALGILSAMTADELARAVAEEDVKRLSSAPGIGKKTAERMVLELRGKLVAHTVTDGLFAASPAADETEDIVSTLLALGYNEREAKAAVKGVPKGTDVGEGVRLALKNLLK

SEQ ID NO: 2697 - DNA, 942 bp, Neisseria gonorrhoeae
ttggacatatccaagctgacatttgacgcaacggccatggtcggcaaaacggagcattcggcaaagtttgacaacgattcaaaaggtttagatcagttttcggaccggttgaaaagcttgggatatcagaatctgcatatctgcatggaggcaaccggcagttattatgaagaagttgccgactacttcgcgcagtattacagcgtttacgtagtgaacccgctgaaaataagcaagtatgcagaaagcaggttcaagcgaaccaaaacagacaaacaggatgcaaagctgatagcgcagtattgccggtcggcgaaagaaagcgagcttgtaaagaggcagaagcctacggacgagcaatacaggctttcacggatgaccgcagcatacgcgcaaatcaaaagcgaatgcgcggcaatgaaaaaccgtcatcacgcggcaaaagatgaagaagcggccaaagcatatgcgcaaatcatcaaagccatgaatgaacagcttgaagttttaaaggagaagataaaagagcagacggagaagcctaactgcaaggaaggcgtgaagcgtcttgaaaccataccggcaataggcagaatgaccgcagccgtattgtttcatcatctaacatcttcgaaatttgaaacatcaaacaaatttgcagcattcgcaggcttaagcccgcaacaaaaagaatccgggacaagcgtaaggggaaaaggcaaactgaccaagtttggcaacaggaaattacgcgccgtcttgtttatgccggccatggtcgcataccggataagggcatttcccgacttcatcaaaaggctggaagaaaagaagaagcctaaaaaagtcatcatcgcagcattgatgcgtaaactcgccgttattgcgtatcacgtacataagaaaggcggagattacgatccatcgcgttacaaatcggcg

SEQ ID NO: 2698 - protein, 314 aa, Neisseria gonorrhoeae
LDISKLTFDATAMVGKTEHSAKFDNDSKGLDQFSDRLKSLGYQNLHICMEATGSYYEEVADYFAQYYSVYVVNPLKISKYAESRFKRTKTDKQDAKLIAQYCRSAKESELVKRQKPTDEQYRLSRMTAAYAQIKSECAAMKNRHHAAKDEEAAKAYAQIIKAMNEQLEVLKEKIKEQTEKPNCKEGVKRLETIPAIGRMTAAVLFHHLTSSKFETSNKFAAFAGLSPQQKESGTSVRGKGKLTKFGNRKLRAVLFMPAMVAYRIRAFPDFIKRLEEKKKPKKVIIAALMRKLAVIAYHVHKKGGDYDPSRYKSA

SEQ ID NO: 2699 - DNA, 579 bp, Neisseria gonorrhoeae
ttgccgccgaaggctgcggtcatgatgatggggacgtttccgcccaaggaagacaaacgcgcgatgcagtttcattatccgaatttccaaaacgatatgtggcgcgtttacgggctggtgttttttaacgatgcggcgcatttccggatgccgtcccacggggaggctgcgcactctgaaaaagcgtttgacgcggagaaaatcaaggcgtttttgcacgaacgggggattgcgtcctgtccgaccgtgttgaaggcggcaagggagcacggcaatgcgtccgacaagtttttaaaggtagttgaaaccgtcgatttggcggcggtgttggcgaaaataccagactgccgccatatttgtacgacaggcggcaaggcgacggaaatcctgctcgatattcagggcggcggcatcaaaatgccgaaaacgggcgaaaccgtgccgtttccgtttgccggacgggatttgacactgacgcgcctgccttcgacttcgcgcgcctatcctttgagtttggcgaaaaaggcagcggcgtatcgggcgtttttcgaaatggcgggcttgtgtgaaaagcagtta

SEQ ID NO: 2700 - protein, 193 aa, Neisseria gonorrhoeae
LPPKAAVMMMGTFPPKEDKRAMQFHYPNFQNDMWRVYGLVFFNDAAHFRMPSHGEAAHSEKAFDAEKIKAFLHERGIASCPTVLKAAREHGNASDKFLKVVETVDLAAVLAKIPDCRHICTTGGKATEILLDIQGGGIKMPKTGETVPFPFAGRDLTLTRLPSTSRAYPLSLAKKAAAYRAFFEMAGLCEKQL

SEQ ID NO: 2701 - DNA, 1200 bp, Neisseria gonorrhoeae
atgaagaactaccacgcgcccgacgaaaagggctttttcggcgaacacggcgggctttatgtttccgaaaccctgattcccgctttgaaagagctggaacaggcctacaacgaagcgaaaaacgatcctgaattttgggcggagttccgccgcgatttgaaacattatgtcggcaggcccagccccgtttaccacgccgcgcggttgtccgagcatttgggcggcgcgcaaatctggttgaagcgcgaagacttgaaccacaccggcgcgcacaaggtcaacaacaccatcggtcaggcattgcttgcccgccgtatgggcaaaaaacgcgtcatcgccgaaaccggcgcgggtcagcacggcgtggcttctgccaccgtcgccgcacgtttcggcatgacttgcgacgtgtacatgggtgcggacgatattcaacgccaaatgccgaatgtgttccgtatgaagctgcttggtgcgaatgtcatcggcgttgacagtggcagccgtactttgaaagacgcgatgaacgaagcgatgcgcgaatgggtcgcccgagtggacgatacgttctacatcatcggcaccgccgccggccccgcgccgtatcccgaaatggtgcgtgatttccaatgcgtcatcggcaacgaagccaaagcgcagatgcaggaagccaccggcagacagcccgacgtcgccgttgcctgcgtcggcggcggctcgaacgccatcggtttgttctatccctatatcgaagaagaaaacgtacgtttggtcggcgtagaagcaggcggtttgggcgtggatacgcctgaccacgccgcgccgattacttcgggcgcaccgattggcgtactgcacggcttccgcagctatctgatgcaggacgaaaacggccaagtcttggggacgcactctgtttccgcaggcttggattaccccggcatcggcccggaacacagccatctgcacgacatcaagcgcgtcgaatacaccgttgccaaagatgacgaagcactcgaagcctttgacttgctctgccgattcgagggcatcatccccgcgctcgaatccagccacgccgttgcttgggcggtgaaaaacgcgccgaaaatgggtaaagaccaagtgattttggtcaacctgtcgggtcgcggcgacaaagacatcaataccgtggcgaaactcaaaggcattgagctg

SEQ ID NO: 2702 - protein, 400 aa, Neisseria gonorrhoeae
MKNYHAPDEKGFFGEHGGLYVSETLIPALKELEQAYNEAKNDPEFWAEFRRDLKHYVGRPSPVYHAARLSEHLGGAQIWLKREDLNHTGAHKVNNTIGQALLARRMGKKRVIAETGAGQHGVASATVAARFGMTCDVYMGADDIQRQMPNVFRMKLLGANVIGVDSGSRTLKDAMNEAMREWVARVDDTFYIIGTAAGPAPYPEMVRDFQCVIGNEAKAQMQEATGRQPDVAVACVGGGSNAIGLFYPYIEEENVRLVGVEAGGLGVDTPDHAAPITSGAPIGVLHGFRSYLMQDENGQVLGTHSVSAGLDYPGIGPEHSHLHDIKRVEYTVAKDDEALEAFDLLCRFEGIIPALESSHAVAWAVKNAPKMGKDQVILVNLSGRGDKDINTVAKLKGIEL

SEQ ID NO: 2703 - DNA, 4695 bp, Neisseria gonorrhoeae
ttggtgagagacgatgtcgattatcaaatattccgtgactttgcagaaaacaaaggcaaattttttgtcggcgcaaccgatttatcagtgaaaaacaaacgaggtcaaaacatcggcaacgcgttatccaacgtaccgatgattgattttagcgttgcagatgtcaacaaacgcatagcaacggtagtcgatccccaatatgccgtcagcgtcaaacacgccaaagcagaagtccatactttttattacggccaatacaacggtcataatgatgtagccgacaaagaaaatgaataccgcgttgtcgaacaaaataactatgaaccccataaagcttggagtgcgagcaatttaggccgcctcgaagattataatatggcgcgttttaataagtttgtaaccgaagtggcaccgattgcaccaactgatgccggcggcggattagatacttacaaagataaaaaccgtttttcctcttttgtcagaatcggtgcgggcaggcaattagtttatgaaaaaggggtttatcatcaagaaggaaatgaaaaaggctacgatttgcgcgatctttcacaagcctatcgttatgccattgcaggtacgccttataaagatattaatattgaccaaacaatgaataccgaaggtttgatcggctttggtaatcataataaacagtattcggcagaagaacttaaacaagcactttcgcaagatgcgttaacaaattacggcgtgttgggcgatagcggctctccgttatttgcttttgacaaacaaaaaaatcaatgggtctttttgggaacttacgattattgggcaggttacggaaaaaaatcatggcaagaatggaatatctataaaaaagaatttgcagataaaatcaaacaacacgataacgccggcaccgtcaaaggtaatggagaacatcattggaaaaccacgggtacaaacagccatatcggttcgacagcggtaaggcttgccaacaatgaaggagatgcgaacaacggacaaaatgttacctttgaagacaacggcactttggtattggatcaaaacatcaaccaaggcgcgggcggcctgtttttcaaaggcgattacacagtcaaaggcgcaaataatgacatcacttggttaggtgcggggattgatgttgccgacggcaaaaaagtcgtttggcaagtcaaaaatccgaatggcgacagattggcaaaaatcggcaaaggcactttggaaataaacggcacaggcgttaaccaagggcaattaaaagtcggcgacggtacggttattctgaatcaaaaagccgattcaaaccaaaaagttcaggctttctcccaagtcggcattgtcagcggacgcggtacattggtgctgaacagtccggaccagattaacccgaataatctgtatttcggtttccgtggcggtcgtttggatgccaatggcaatgacttgacttttgaacacatccgcaacgtggatgaaggcgcgcgcattgtcaaccacaacacagaccacgcctccacaatcacactaacgggtaaatctttaattaccaatccgaacagcctttcggtacatagtatacaaaatgactatgacgaagataattatagttattattaccggccaaggcgacccatcccacaaggcaaagatctttattacaaaaactatcgttattacgccctaaaatccggtggcagtgttaacgcaccgatgcccgaaaacggacaaacggaaaataacgactggattttaatgggcagcacacaagaagaagccaagaaaaacgcgatgaaccataaaaacaatcagcgtattagcggttttagcggtttctttggcgaagaaaacggaaaaggacataacggcgcattaaaccttaatttcaatggcaaaagcgcgcaaaaccgtttcttgttaacaggcggcgccaatttaaacggaaaaataagcgtaactcaaggcaatgtcttgttatcaggtcgtccaacaccacacgcaagagattttgtgaacaaatcttcagcccgaaaagacgcacatttctccaaaaacaatgaagtcgtatttgaagacgactggataaaccgcacattcaaagccgcagaaattgcggttaaccaatccgcatcattctcttccggcagaaatgtatccgacatcaccgccaacatcaccgcaacagacaacgccaaagtaaatttgggttacaaaaacggcgatgaggtttgcgtgcgctcggactataccggttacgttacctgcaacacaggcaacttatccgataaggctttaaacagctttgatgcgacacggattaacggcaatgtgaatttgaatcagaatgcggcattggtcttgggcaaggctgcattatgggggcaaattcaagggcaaggaaacagccgtgtcagcctaaaccaacatagcaaatggcatttgaccggcgacagccaagtacacaatctgtcattggcggatagccatattcatttgaacaacgcttccgatgcgcaaagtgcaaataaataccacacgatcaaaatcaatcatttatccggtaacgggcattttcattatctgacggacttggcgaaaaatcttggggataaagtgcttgtgaaggaatccgcatccggccattatcagctccatgttcaaaataaaacaggcgaacctaatcaggaagggctggatctctttgatgcatcatccgtacaagaccgctcccgcctttttgtttccttggcaaatcattacgtcgatttaggcgcattgcgttatacaatcaaaacagaaaacggtattacccggttgtacaatccttatgccgggaaccgccgcccagtcaagccggccccgtctcctgccgcaaacacggcttctcaagcacaaaaggcaacacaaacggacggtgcacaaattgccaaacctcaagatattgtcgtcgcaccgcccagcccgcaagcaaatcaagccgaagaagcaaaacgccaacaagcaaaagcggagcaagtgaagcgtcagcaagcagaagcagggcgtaaatcggcagagttgtcggcaaaacaaagggccggggaagaggaacgccgtcaaacagcccaatcccagccgcaacgccgcaaacgccgtgccgcaccgcaggattatatggcagtttcccaagaccgtccgaaacgccgcggacaccgttcggtacagcaaaacaatgtggaaattgcccaagcccaagcagaacttgcgcgccgacagcaggaagaacgcaaagcggcagagttgttggcaaaacaaagggcagaagccgaacgtgaggctcaagcattggctgcgcgccgaaaagccgaagccgaagaggcaaaacaccaagctgccgaacttgcacatcgccaggaagcaaaacgcaaagcggcagaatccgcgaaacgaaaagctgaggaagaagagcaccgtcaaacagcccaatcccagccgcaacgccgcaaacgccgtgccgcaccgcaggattatatggcagtttcccaagaccgtccgaaacgtcgcggacgcagatctactctgccggcaccgccctcgccatcatttgattcatcagcttacgcagcacccagggccttgcataatccggactggtatgaaaatgattatgaagaaatccccttggatgcgctggaagatgaagatgtatccgaatcggttgacacatcagacaaacagcctcaagacaatacggaacttcatgaaaaagttgaggcagtgagtttgcaaccaagagccgcgcagccgcgaacccaagccgccgcgcaagccgatgcagtcagcaccaatactaactcggctttatctgacgcaatggcaagcacgcaatctatcttgttggatacaggtgcttcattaacacggcacattgcacaaaaatcacgcgctgatgccgaaaaaaacagtgtttggatgtcaaacaccggttatggccgtgattatgcttccgcacaatatcgccggtttagttcgaaacgcacgcaaacacaaatcggcattgaccgcagcttgtccgaaaatatgcagataggcggagtattgacttactctgacagtcagcatacttttgatcaggcgggcggcaaaaatacttttgtgcaagccaacctttatggtaagtattatttaaatgatgcttggtatgtggccggcgatattggtgcgggcagcttgagaagccggttacaaacgcagcaaaaagcaaactttaaccgaacaagcatccaaaccggccttactttgggcaatacgctgaaaatcaatcaattcgagattgtccctagtgcgggtatccgttacagccgcctgtcatctgcagattacaagttgggtgacgacagtgttaaagtaagttctatggcagtgaaaacactaacggccggactggattttgcttatcggtttaaagtcggcaaccttaccgtaaaacccttgttatctgcagcttactttgccaattatggcaaaggcggcgtgaatgtgggcggtaaatccttcgcctataaagcagataatcaacagcaatattcagcaggcgccgcgttactgtaccgtaatgttacattaaacgtaaatggcagtattacaaaaggaaaacaattggaaaaacaaaaatccggacaaattaaaatacagattcgtttc

SEQ ID NO: 2704 - protein, 1565 aa, Neisseria gonorrhoeae
LVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWSASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLDQNINQGAGGLFFKGDYTVKGANNDITWLGAGIDVADGKKVVWQVKNPNGDRLAKIGKGTLEINGTGVNQGQLKVGDGTVILNQKADSNQKVQAFSQVGIVSGRGTLVLNSPDQINPNNLYFGFRGGRLDANGNDLTFEHIRNVDEGARIVNHNTDHASTITLTGKSLITNPNSLSVHSIQNDYDEDNYSYYYRPRRPIPQGKDLYYKNYRYYALKSGGSVNAPMPENGQTENNDWILMGSTQEEAKKNAMNHKNNQRISGFSGFFGEENGKGHNGALNLNFNGKSAQNRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGQIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNRRPVKPAPSPAANTASQAQKATQTDGAQIAKPQDIVVAPPSPQANQAEEAKRQQAKAEQVKRQQAEAGRKSAELSAKQRAGEEERRQTAQSQPQRRKRRAAPQDYMAVSQDRPKRRGHRSVQQNNVEIAQAQAELARRQQEERKAAELLAKQRAEAEREAQALAARRKAEAEEAKHQAAELAHRQEAKRKAAESAKRKAEEEEHRQTAQSQPQRRKRRAAPQDYMAVSQDRPKRRGRRSTLPAPPSPSFDSSAYAAPRALHNPDWYENDYEEIPLDALEDEDVSESVDTSDKQPQDNTELHEKVEAVSLQPRAAQPRTQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQAGGKNTFVQANLYGKYYLNDAWYVAGDIGAGSLRSRLQTQQKANFNRTSIQTGLTLGNTLKINQFEIVPSAGIRYSRLSSADYKLGDDSVKVSSMAVKTLTAGLDFAYRFKVGNLTVKPLLSAAYFANYGKGGVNVGGKSFAYKADNQQQYSAGAALLYRNVTLNVNGSITKGKQLEKQKSGQIKIQIRF

SEQ ID NO: 2705 - DNA, 102 bp, Neisseria gonorrhoeae
atggataaggatatggcgttaattttaaaacgtttggctttcataaggttttaccgttttaatagcgataatgttttgcattttacgccggttgggtggtgt

SEQ ID NO: 2706 - protein, 34 aa, Neisseria gonorrhoeae
MDKDMALILKRLAFIRFYRFNSDNVLHFTPVGWC

SEQ ID NO: 2707 - DNA, 99 bp, Neisseria gonorrhoeae
atgagttacacaaaaaaatactcaacaccacccaaccggcgtaaaatgcaaaacattatcgctattaaaacggtaaaaccttatgaaagccaaacgttt

SEQ ID NO: 2708 - protein, 33 aa, Neisseria gonorrhoeae
MSYTKKYSTPPNRRKMQNIIAIKTVKPYESQTF

SEQ ID NO: 2709 - DNA, 135 bp, Neisseria gonorrhoeae
atgccgtccgaaggcggcgcggcgtttgccctgacgaaaccctgcgtttccgccccgcgctgtcttcccgacggcttttcccgtaaaatggcgttattgtccttcctttcagacggcattgtgtttgatgccgtc

SEQ ID NO: 2710 - protein, 45 aa, Neisseria gonorrhoeae
MPSEGGAAFALTKPCVSAPRCLPDGFSRKMALLSFLSDGIVFDAV

SEQ ID NO: 2711 - DNA, 243 bp, Neisseria gonorrhoeae
ttggatatgtccaatcctacggtgttacgcatgggattacccttatctattcagaatctgtgttctttgatactactcaatttcacaaacaagaaaaccgcccgcctattctcgtcatcaaactttaagtttgtggtttgttcaggctggacggtttcggcaaagggtagctattcctttgccgtgtctgattttatttgggttgcaggttttggtaaagattcctgttgcgacccgaatgtc

SEQ ID NO: 2712 - protein, 81 aa, Neisseria gonorrhoeae
LDMSNPTVLRMGLPLSIQNLCSLILLNFTNKKTARLFSSSNFKFVVCSGWTVSAKGSYSFAVSDFIWVAGFGKDSCCDPNV

SEQ ID NO: 2713 - DNA, 1236 bp, Neisseria gonorrhoeae
atggctttttatgcttctaaggcgatgcgtgcggccgcgttggctgccgccgttgcattggcactgtcgtcttgcggtaaaggcggagacgcggcgcagggcgggcagcctgcgggtcgggaagcccccgcgcccgtcgtcggcgtcgtaaccgtccatccgcaaaccgtcgcattgaccgtcgagttgccggggcgtttggaatcgctgcgtaccgccgatgtccgcgcccaagtcggcggcatcatccaaaaacgcctgttccaagaaggcagttatgtccgcgccgggcagccgctgtatcagatcgacagttccacttatgaagcaggtctggaaagcgcgcgcgcgcaactggcaacggcacaggcaacgcttgccaaagcggatgcggatttggcgcgttacaaaccgctggtttccgccgatgccatcagtaaacaagagtacgatgctgcggtaacggcgaaacgttctgccgaggcgggcgttaaagcggcgcaggcggcgatcaaatccgccggcatcaatctgaaccgttcgcgcattaccgcgccgatttcgggctttatcggtcagtccaaagtttccgaaggtacgctgttgaatgcgggcgatacaactgttttagccaccatccgccaaaccaatccgatgtatgtgaacgttacccagtctgcatccgaagtgatgaaactgcgccggcagatagccgaaggcaagctgctggcggcggatggtgcgattgcggtcggcatcaaatttgacgacggtacggtttatcctgaaaaaggccgcctgctgtttgctgatccgaccgttgaggaatcgaccggtcagattaccttgcgcgccgccgtatcgaacgatcagaatatcctgatgcccggcctgtatgtgcgtgtgctgatggatcaggtggcggcggataatgcattcatcgttccacagcaggcggtaacgcgcggtgcgaaagataccgtgatgattgtgaatgcccagggcggtatggaaccccgcgaggtaacggtcgcgcaacagcagggtacgaattggattgttacgtcgggtctgaaggacggggacaaggtggttgtggaaggcatcagtatcgccggtatgacgggggcgaaaaaggtaacgcctaaagaatgggcgccgtctgaaaatcaagctgccgcccctcaagccggcgttcagacggcatctgaagccaaacctgcttctgaagcgaaa

SEQ ID NO: 2714 - protein, 412 aa, Neisseria gonorrhoeae
MAFYASKAMRAAALAAAVALALSSCGKGGDAAQGGQPAGREAPAPVVGVVTVHPQTVALTVELPGRLESLRTADVRAQVGGIIQKRLFQEGSYVRAGQPLYQIDSSTYEAGLESARAQLATAQATLAKADADLARYKPLVSADAISKQEYDAAVTAKRSAEAGVKAAQAAIKSAGINLNRSRITAPISGFIGQSKVSEGTLLNAGDTTVLATIRQTNPMYVNVTQSASEVMKLRRQIAEGKLLAADGAIAVGIKFDDGTVYPEKGRLLFADPTVEESTGQITLRAAVSNDQNILMPGLYVRVLMDQVAADNAFIVPQQAVTRGAKDTVMIVNAQGGMEPREVTVAQQQGTNWIVTSGLKDGDKVVVEGISIAGMTGAKKVTPKEWAPSENQAAAPQAGVQTASEAKPASEAK

SEQ ID NO: 2715 - DNA, 159 bp, Neisseria gonorrhoeae
ttgaaaatgataagaatgcaaacgaaaagcctcagtattatccgagacaacggcaaactttccatcgtcattcccgcaaaagcgggaatccaaagacaaaaagccgcagaaatttatcggaaagaaccgaaccacaaaaaccggcttcccatcttcgct

SEQ ID NO: 2716 - protein, 53 aa, Neisseria gonorrhoeae
LKMIRMQTKSLSIIRDNGKLSIVIPAKAGIQRQKAAEIYRKEPNHKNRLPIFA

SEQ ID NO: 2717 - DNA, 204 bp, Neisseria gonorrhoeae
atgtttttatttccgctttctttgttctgttattcaagcgaagatgggaagccggtttttgtggttcggttctttccgataaatttctgcggctttttgtctttggattcccgcttttgcgggaatgacgatggaaagtttgccgttgtctcggataatactgaggcttttcgtttgcattcttatcattttcaaatcttgtta

SEQ ID NO: 2718 - protein, 68 aa, Neisseria gonorrhoeae
MFLFPLSLFCYSSEDGKPVFVVRFFPINFCGFLSLDSRFCGNDDGKFAVVSDNTEAFRLHSYHFQILL

SEQ ID NO: 2719 - DNA, 273 bp, Neisseria gonorrhoeae
atgataaagcaaagccataaaaccgtcataacaagatttgaaaatgataagaatgcaaacgaaaagcctcagtattatccgagacaacggcaaactttccatcgtcattcccgcaaaagcgggaatccaaagacaaaaagccgcagaaatttatcggaaagaaccgaaccacaaaaaccggcttcccatcttcgcttgaataacagaacaaagaaagcggaaataaaaacatcgggattcttttttaaattggcaataaaacaccaaaatgaa

SEQ ID NO: 2720 - protein, 91 aa, Neisseria gonorrhoeae
MIKQSHKTVITRFENDKNANEKPQYYPRQRQTFHRHSRKSGNPKTKSRRNLSERTEPQKPASHLRLNNRTKKAEIKTSGFFFKLAIKHQNE

SEQ ID NO: 2721 - DNA, 2277 bp, Neisseria gonorrhoeae
atgacggttttatggctttgctttatcatcgtttgttttttatatcgggagtggggagacgtgttccgtcgttggtttttgccgtgttgggttgtcggcgtggcagtttcgttcgcactgtcggttgtaccgcattggccgttttggttggcggcttttgcggttttggctgtgcttgcaaggcgttttgcgtttgccggtctgatgctgtgcgtgttggcgggcgcggcttacggcgtattcagaacggaagcggcactgtcttcgcaatggcgggcggaggcggtttcaggcgtgcctttgacggtggaagtgacggatatgccgaggtcggacgggcggcgcgtgcagtttgcggcaaaggctgtggacagcggcggtcggacgtttgatttgctgctgtcggactacaaacggcgcgaatgggcggtcgggagcagatggcggataacggcacgcgtgcaccccgtcgtcggggagttgaacctgcgcggtttgaaccgtgaggcgtgggcattatccaacggggtaggcggcgtggggacggtcggtgcggacagggttttgctgcatggcggaagcggttgggggattgcggtttggcgcagccgcatcagccgcaattggcggcaggcggatgcggacggcgggctttcagacggcatcgggctgatgcgcgcgttgagcgtgggcgaacagtcggcattgcgccccgaattgtggcaggcgttccggccgttggggctgacgcatttggtcagtatctcgggtttgcacgttacgatggtggcggtgctgtttgcgtggctggcgaagcggctgcttgcctgttccccgcgccttcccgcccggccgcgcgcgtgggttttggcggcggggtgtgcgggcgcgctgttttacgcgctgcttgccggtttttccgtgccgacgcagcgcagtgttttgatgttggcggcgttcgcgtgggcgtggcgcaggggaagactgtcggcgtgggcgacgtggtggcaggcgttggcggcggtgctgctgttcgaccctttggcggttttgggtgtcggtacttggctgtctttcggtttggtggcggccctgatatgggcgtgtgcagggtgtttgtacgaggggaaacggcaaaccgccgtgcgcgggcagtgggcggcttcggtgttgtctctggttttgctcggttatctgtttgcctcgctgcctttggtcagccctttggtcaatgcggtgtcgataccgtggttttcttgggtgttgaccccgctggcgttgctgggttcggtcgtgccgtttgcgccgcttcagcaggcgggggcatttttggcggaatacactttgcggtttttggtgtggcttgccgatgtgtcgcctgagtttgccgttgccgccgcacctttgccgctgctggtgttggcggtgtgtgccgctttgctgttgctgctgccgcgcggcttgggtttgcgtccgtgggcggtgttgctgttggcagggtttgtatcctaccgtcctgaagcagtacctgaaaacgaagctgcggttacggtttgggatgcggggcagggcttgtcggtgcttgtgcggacggcaaaccgccatctgcttttcgatacgggaacggtagcggcggcacaaacgggtatcgtgccgagtttgaatgcggcgggtgtccgccgtttggacaagctggttctgtcgcatcacgacagcgaccacgacggcggctttcaggcagtcggcaagataccgaacggcgggatttatgccggacagccggaattttatgagggggcgcggcattgtgcggaacagcgttggcaatgggacggcgtggatttcgagtttttgaggccgtctgaacgcaaaaatatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaagcatccgaccgaagcggtgcagaaccgtgtccgcgcacacggcatcaagttgttgcggacggatttgtcgggcgcgctgcaattcggcttgggacgcggaggcgtaaaggctcaacgtttgagagtgtataaattctattggcagaaaaaaccgtttgag

SEQ ID NO: 2722 - protein, 759 aa, Neisseria gonorrhoeae
MTVLWLCFIIVCFLYREWGDVFRRWFLPCWVVGVAVSFALSVVPHWPFWLAAFAVLAVLARRFAFAGLMLCVLAGAAYGVFRTEAALSSQWRAEAVSGVPLTVEVTDMPRSDGRRVQFAAKAVDSGGRTFDLLLSDYKRREWAVGSRWRITARVHPVVGELNLRGLNREAWALSNGVGGVGTVGADRVLLHGGSGWGIAVWRSRISRNWRQADADGGLSDGIGLMRALSVGEQSALRPELWQAFRPLGLTHLVSISGLHVTMVAVLFAWLAKRLLACSPRLPARPRAWVLAAGCAGALFYALLAGFSVPTQRSVLMLAAFAWAWRRGRLSAWATWWQALAAVLLFDPLAVLGVGTWLSFGLVAALIWACAGCLYEGKRQTAVRGQWAASVLSLVLLGYLFASLPLVSPLVNAVSIPWFSWVLTPLALLGSVVPFAPLQQAGAFLAEYTLRFLVWLADVSPEFAVAAAPLPLLVLAVCAALLLLLPRGLGLRPWAVLLLAGFVSYRPEAVPENEAAVTVWDAGQGLSVLVRTANRHLLFDTGTVAAAQTGIVPSLNAAGVRRLDKLVLSHHDSDHDGGFQAVGKIPNGGIYAGQPEFYEGARHCAEQRWQWDGVDFEFLRPSERKNIDDNGKSCVLRVVAGGAALLVTGDLDTKGEESLVGKYGGNLYSQVLVLGHHGSNTSSSGVFLNAVSPEYAVASSGYANAYKHPTEAVQNRVRAHGIKLLRTDLSGALQFGLGRGGVKAQRLRVYKFYWQKKPFE

SEQ ID NO: 2723 - DNA, 801 bp, Neisseria gonorrhoeae
atgaaaaaaattcttttaacggtttcattaggtttggcactgagtgcctgtgccactcaaggtacggccgataaagatgcccagattacccaagattggagtgtggagaagctctatgccgaagcccaggacgaattgaacagcagcaattatacgcgggctgtcaagttatacgaaatcttggaatcgcgcttccccaccagccgccatgcccggcaatcccaactggataccgcatacgcctattataaagacgatgaaaaagacaaggctctggcggcaatcgaacgcttccgccgcctccatccgcagcatccgaacatggattacgcgctgtacctgcgcggcttggtgctgtttaacgaagatcagtccttcctgaacaaactggcctcgcaagactggtccgaccgcgacccgaaagccaaccgcgaagcgtaccaggcgtttgcggaactcgtccaacgcttcccgaacagcaaatacgccgccgatgcaaccgcacgcatggtcaaactggtcgatgctttgggcggcaatgaaatgtcggtggcgcgttactacatgaaacgcggcgcatatatcgccgccgccaaccgcgccaaaaaaattatcggcagctatcaaaatacacgctatgtcgaagaatcactggccatattggaacttgcctacaagaagttggacaagccccagcttgccgccgatacgcgccgcgtattggaaaccaacttcccgaaaagcccgtttttgacgcacgcttggcagcccgacgatatgccctggtggcgttactggcat

SEQ ID NO: 2724 - protein, 267 aa, Neisseria gonorrhoeae
MKKILLTVSLGLALSACATQGTADKDAQITQDWSVEKLYAEAQDELNSSNYTRAVKLYEILESRFPTSRHARQSQLDTAYAYYKDDEKDKALAAIERFRRLHPQHPNMDYALYLRGLVLFNEDQSFLNKLASQDWSDRDPKANREAYQAFAELVQRFPNSKYAADATARMVKLVDALGGNEMSVARYYMKRGAYIAAANRAKKIIGSYQNTRYVEESLAILELAYKKLDKPQLAADTRRVLETNFPKSPFLTHAWQPDDMPWWRYWH

SEQ ID NO: 2725 - DNA, 1176 bp, Neisseria gonorrhoeae
gtggcacaggcactcagtgccaaacctaatgaaaccgttaaaagaatttttttcatgcagaatacttcctttgataatgaatccgattatagcgacgattcagactttgcgtcagcttccggaactgaaaaccgtatcggtctgaccgttccgctcgagcttgccggcgggcggttggatgcggtgttggcgaaacttctgcccgactattcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccggagcctatggatttggatattgtttacgaagacgataccgtcatcgtcgtcaacaaaccggccggactggtggtgcatccggcggcgggcaactggacggggacgctgctcaacggcctgttggcgcattgccccgagctgtcccaaattccgcgcgcgggcatcgtacaccgtttggacaaagaaaccagcgggctgatggtggttgccaaaaccctgccggcgcaaaattccctcgtgaggcagcttcaagaacgcacggtcaaacgcatctaccgcgccgtcgccaacggcatcgtccccttcgacggtaaaatcgaaacccaaatcggacgcgatccgcacaaccgcctgaaaatggcagccgtcaaattcggcggcaagcctgccgtaacccacgtcaaagtgttggaacgctatcttgcccacagctacatcgaatgctcgctcggaacgggcaggacgcaccaaatccgcgtccatatgcgcgaggccaaccatccgcttgccggcgacccggtttacggcaacccgcgccatccgtgcggcgacacggtgaaagaagccgttaaaagtttgggcgcgcgtcaggcgttgcacgcctaccgcttgagttttacccatccggaaagcggcgaaaccgtttcgtttgaggcaccgattccggacgacatatatcatttgttgtccgtcctccgtcttgaagccggtttggattcgtctttgagcaatgaagaggaatggcaggacaaattcggcgcggacgacgatgacgattggaacgaagacgactacgatgtcgaagtggtttatgtaagggag

SEQ ID NO: 2726 - protein, 392 aa, Neisseria gonorrhoeae
VAQALSAKPNETVKRIFFMQNTSFDNESDYSDDSDFASASGTENRIGLTVPLELAGGRLDAVLAKLLPDYSRSRLTSWIKEGAVIVNDKPSQPKDKMIGGEQICVTVRPSEENLAFVPEPMDLDIVYEDDTVIVVNKPAGLVVHPAAGNWTGTLLNGLLAHCPELSQIPRAGIVHRLDKETSGLMVVAKTLPAQNSLVRQLQERTVKRIYRAVANGIVPFDGKIETQIGRDPHNRLKMAAVKFGGKPAVTHVKVLERYLAHSYIECSLGTGRTHQIRVHMREANHPLAGDPVYGNPRHPCGDTVKEAVKSLGARQALHAYRLSFTHPESGETVSFEAPIPDDIYHLLSVLRLEAGLDSSLSNEEEWQDKFGADDDDDWNEDDYDVEVVYVRE

SEQ ID NO: 2727 - DNA, 147 bp, Neisseria gonorrhoeae
ttgaaaggcggggcgaacgcaggcagccgaaccggagcagccgggcaatcgtccccgccgatttcaaacaaaggccgtctgaaggggccgggcagaaaccgccggtttcggttgccccgttcagacggcattatgatgaaaggcgtt

SEQ ID NO: 2728 - protein, 49 aa, Neisseria gonorrhoeae
LKGGANAGSRTGAAGQSSPPISNKGRLKGPGRNRRFRLPRSDGIMMKGV

SEQ ID NO: 2729 - DNA, 816 bp, Neisseria gonorrhoeae
ttgacgctcaaaccttccgacttcgatattttgttcaaacaccccaaagccgtcatcatcggcgtaatcgcacaattcgccattatgccggcaaccgcctggctgccgtccaaactgttgaacctgcctgccgaaatcgcggtcggcgtgattttggtcggctgctgcccgggcggtacggcttccaatgtgatgacctatctggcgcgcggcaatgtggctttgtcggttgccgttacgtctgtttccaccctgatttccccattgctgactcccgccatcttcctgatgcttgccggtgaaatgctggaaatccaagcggccggtatgttgatgtccatcgtcaaaatggttttgctccccattgttttgggtttgattgtccataaggttttgggcagtaaaaccgaaaagccgaccgatgcgctgccgctggtttccgttgccgccatcgtgctgattatcggcgcggtagtcggggcaagcaaaggcaagattatggaaagcggcctgctgatttttgcggttgtcgtactccgcaacggcatcggctacctgctcggcttctttgccgccaaatggaccggcctgccttatgatgcacaaaaaacgctggccatcgaagtcggtatgcaaaactcgggcctggccgccgcgcttgccgccgcacactttgccgccgcgccggtcgttgccgttccgggcgcattgttcagcgtgtggcacaatatctccggctcgctgctggcaacttattgggcggccaaagccggtaaacataaaaaaaccctaaacgcctttcatcataatgccgtc

SEQ ID NO: 2730 - protein, 272 aa, Neisseria gonorrhoeae
LTLKPSDFDILFKHPKAVIIGVIAQFAIMPATAWLPSKLLNLPAEIAVGVILVGCCPGGTASNVMTYLARGNVALSVAVTSVSTLISPLLTPAIFLMLAGEMLEIQAAGMLMSIVKMVLLPIVLGLIVHKVLGSKTEKPTDALPLVSVAAIVLIIGAVVGASKGKIMESGLLIFAVVVLRNGIGYLLGFFAAKWTGLPYDAQKTLAIEVGMQNSGLAAALAAAHFAAAPVVAVPGALFSVWHNISGSLLATYWAAKAGKHKKTLNAFHHNAV

SEQ ID NO: 2731 - DNA, 318 bp, Neisseria gonorrhoeae
atggatgcttgttttttcgtcattcccgcacaggcgggaattcggagattcgggattgttttcaaacgttcgggtcggattcttgccggtgcgggaatgatgcccttatatactttctccgagctttatatgcttcaacaggggacggcacatcaagcaccgcactgcgtgttgcccgaacgaggctgccctccgattagattctatcgctataaacagacgggtttcaaccgaaaaggaatggggataaagtccatttccgacacctctcgggcgatgccgtctgaaaaccaatctccactttcagacggcattgtt

SEQ ID NO: 2732 - protein, 106 aa, Neisseria gonorrhoeae
MDACFFVIPAQAGIRRFGIVFKRSGRILAGAGMMPLYTFSELYMLQQGTAHQAPHCVLPERGCPPIRFYRYKQTGFNRKGMGIKSISDTSRAMPSENQSPLSDGIV

SEQ ID NO: 2733 - DNA, 777 bp, Neisseria gonorrhoeae
atgaaaaccatcacagaaaccctaaatctcgccccgaaaggcaaaaacttcctgaccgccgattggcccgcgcccgccaatgtgaaaaccctgattaccacgcgcaacggcggcgtgagccaaggtgcgtatcagagtttgaacctcggtacgcacgtcggcgacgaccctgaaaccgtgcgccgcaaccgcgaaatcgtgcaacagcaggtcggattgcccgttgcctatctcaatcaaatccacagcaccattgtcgtcaatgctgccgaagcattggacggcacgcccgatgccgacgcttccgtggacgacacgggtaaagccgtctgtgccgtgatgactgcagactgtctgcccgttctattttgcgacagggcaggtacggcggttgccgccgcacacgcgggctggagcggtttggcgggcggcgtattgcaaaacaccattgccgcgatgaaggttccgcctgtcgaaattatggcgtatctcggccctgccatcagtgcggatgcgtttgaagtcgggcaggacgtgtttgatgcgttctgcacgtccatgcccgaagccgctgctgcatttgaacccatcggcggcggcaaattccttgccgacctctacgcgctcgcccgcctgattctgaagcgcgaaggcgtgggcggcgtgtacggcggcacgcattgtacggttttggaacgggatattttcttttcctaccgccgcgacggagcgacggggcgtatggcgagcctgatttggctggacggcaatgccgtc

SEQ ID NO: 2734 - protein, 259 aa, Neisseria gonorrhoeae
MKTITETLNLAPKGKNFLTADWPAPANVKTLITTRNGGVSQGAYQSLNLGTHVGDDPETVRRNREIVQQQVGLPVAYLNQIHSTIVVNAAEALDGTPDADASVDDTGKAVCAVMTADCLPVLFCDRAGTAVAAAHAGWSGLAGGVLQNTIAAMKVPPVEIMAYLGPAISADAFEVGQDVFDAFCTSMPEAAAAFEPIGGGKFLADLYALARLILKREGVGGVYGGTHCTVLERDIFFSYRRDGATGRMASLIWLDGNAV

SEQ ID NO: 2735 - DNA, 477 bp, Neisseria gonorrhoeae
atgaacaaaatattccttactgccgcagccttggtgctgggcgcgtgcggtttccacctgaaaggtgcagacggcatttctccgccgctgacctaccggagctggcacatcgaaggcggacaggcattgcagtttcctttggaaaccgcgctgtatcaggcttcgggcagggtggacgatgctgccggcgcgcagatgaccctgcgtatagacagcgtttcccaaaacaaggaaacctataccgttacccgtgcggcagtcatcaacgaatatcttttgatattgacggttgaagcgcaggtattgaaacgcggcgagccggtcggcaaaccgatgaccgtgtccgtccgccgcattttggattatgccgacaacgaaattttgggcaaacaggaagaagaagaaaccctgtgggcggaaatgcggcaggatgttgccgaacagattgtccgccgcctgacctttctgaaggcggaa

SEQ ID NO: 2736 - protein, 159 aa, Neisseria gonorrhoeae
MNKIFLTAAALVLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRILDYADNEILGKQEEEETLWAEMRQDVAEQIVRRLTFLKAE

SEQ ID NO: 2737 - DNA, 525 bp, Neisseria gonorrhoeae
atgcgtccgatatgtgccgccacgtcattccgccttcagaaaggtcaggcggcggacaatctgttcggcaacatcctgccgcatttccgcccacagggtttcttcttcttcctgtttgcccaaaatttcgttgtcggcataatccaaaatgcggcggacggacacggtcatcggtttgccgaccggctcgccgcgtttcaatacctgcgcttcaaccgtcaatatcaaaagatattcgttgatgactgccgcacgggtaacggtataggtttccttgttttgggaaacgctgtctatacgcagggtcatctgcgcgccggcagcatcgtccaccctgcccgaagcctgatacagcgcggtttccaaaggaaactgcaatgcctgtccgccttcgatgtgccagctccggtaggtcagcggcggagaaatgccgtctgcacctttcaggtggaaaccgcacgcgcccagcaccaaggctgcggcagtaaggaatattttgttcatcgcttgcctttctcaaaagca

SEQ ID NO: 2738 - protein, 175 aa, Neisseria gonorrhoeae
MRPICAATSFRLQKGQAADNLFGNILPHFRPQGFFFFLFAQNFVVGIIQNAADGHGHRFADRLAAFQYLRFNRQYQKIFVDDCRTGNGIGFLVLGNAVYTQGHLRAGSIVHPARSLIQRGFQRKLQCLSAFDVPAPVGQRRRNAVCTFQVETARAQHQGCGSKEYFVHRLPFSKA

SEQ ID NO: 2739 - DNA, 996 bp, Neisseria gonorrhoeae
gtggcggcacatatcggacgcatcgatacggacgcgcctttgaaacctctgtacgtcatccacggcgaggaagaactgctgcgtatcgaggcagtggacgcattgagggcggcggcgaagaagcagggttatctcaaccgcgaagcctataccgccgacgcgtctttcgattggaacgaactgctgcaaaccgcaggcaatgcgggtctgtttgccgatttgaaactgttggaactgcatatccccaacggaaaacccggcaaaaacggcggcgaggcattgcaggattttgccgcccgactgccggaagatacggtaacgctggttttgctgcccaaactggagaaaacccggctccagtccaaatggtttgccgcattggcggcaaagggggaagtatgggaagccaaaccggtcggtgcggcggctttgccccaatggatacgcggacggctggacaaaatcggtttgggtatcgaggcagacgcattggcactgtttgccgagcgcgtggaaggcaatctgttggcggcacgtcaggaaatcgacaagctcgcgctgctgtatccgaaagggcatgccgtcaatatcgatgaggcgcaaaccgccgttgccaatgttgcccgcttcgacgcgttccaactggcaggcgcgtggatgaagggcgatgtcccgcgcgtatgcaggctgttggacgggttggaggaagaaggcgaagaaccggtgctgcttctgtgggcggttgccgaagacgtgcggacgctgattcggcttgccgctgccctgaaacaggggcagagcatccaatccgtccgcaacagcctcaggctttggggcgacaaacagacgctcgcaccgcttgcggtcaagcggatttccgtcgtccgcctgcttgacgcgctcaaaacctgcgcccaaatcgaccgaatcatcaaaggcgcggaagacggcgacgcatggacggtattcaaacagcttgtcgtgtcgctggcggaa

SEQ ID NO: 2740 - protein, 332 aa, Neisseria gonorrhoeae
VAAHIGRIDTDAPLKPLYVIHGEEELLRIEAVDALRAAAKKQGYLNREAYTADASFDWNELLQTAGNAGLFADLKLLELHIPNGKPGKNGGEALQDFAARLPEDTVTLVLLPKLEKTRLQSKWFAALAAKGEVWEAKPVGAAALPQWIRGRLDKIGLGIEADALALFAERVEGNLLAARQEIDKLALLYPKGHAVNIDEAQTAVANVARFDAFQLAGAWMKGDVPRVCRLLDGLEEEGEEPVLLLWAVAEDVRTLIRLAAALKQGQSIQSVRNSLRLWGDKQTLAPLAVKRISVVRLLDALKTCAQIDRIIKGAEDGDAWTVFKQLVVSLAE

SEQ ID NO: 2741 - DNA, 1230 bp, Neisseria gonorrhoeae
ttggggattaccgctttattccgccagcgacacgacaagctgtttgaataccgtccatgcgtcgccgtcttccgcgcctttgatgattcggtcgatttgggcgcaggttttgagcgcgtcaagcaggcggacgacggaaatccgcttgaccgcaagcggtgcgagcgtctgtttgtcgccccaaagcctgaggctgttgcggacggattggatgctctgcccctgtttcagggcagcggcaagccgaatcagcgtccgcacgtcttcggcaaccgcccacagaagcagcaccggttcttcgccttcttcctccaacccgtccaacagcctgcatacgcgcgggacatcgcccttcatccacgcgcctgccagttggaacgcgtcgaagcgggcaacattggcaacggcggtttgcgcctcatcgatattgacggcatgccctttcggatacagcagcgcgagcttgtcgatttcctgacgtgccgccaacagattgccttccacgcgctcggcaaacagtgccaatgcgtctgcctcgatacccaaaccgattttgtccagccgtccgcgtatccattggggcaaagccgccgcaccgaccggtttggcttcccatacttccccctttgccgccaatgcggcaaaccatttggactggagccgggttttctccagtttgggcagcaaaaccagcgttaccgtatcttccggcagtcgggcggcaaaatcctgcaatgcctcgccgccgtttttgccgggttttccgttggggatatgcagttccaacagtttcaaatcggcaaacagacccgcattgcctgcggtttgcagcagttcgttccaatcgaaagacgcgtcggcggtataggcttcgcggttgagataaccctgcttcttcgccgccgccctcaatgcgtccactgcctcgatacgcagcagttcttcctcgccgtggatgacgtacagaggtttcaaaggcgcgtccgtatcgatgcgtccgatatgtgccgccacgtcattccgccttcagaaaggtcaggcggcggacaatctgttcggcaacatcctgccgcatttccgcccacagggtttcttcttcttcctgtttgcccaaaatttcgttgtcggcataatccaaaatgcggcggacggacacggtcatcggtttgccgaccggctcgccgcgtttcaatacctgcgcttcaaccgtcaatatcaaaagatattcgt

SEQ ID NO: 2742 - protein, 410 aa, Neisseria gonorrhoeae
LGITALFRQRHDKLFEYRPCVAVFRAFDDSVDLGAGFERVKQADDGNPLDRKRCERLFVAPKPEAVADGLDALPLFQGSGKPNQRPHVFGNRPQKQHRFFAFFLQPVQQPAYARDIALHPRACQLERVEAGNIGNGGLRLIDIDGMPFRIQQRELVDFLTCRQQIAFHALGKQCQCVCLDTQTDFVQPSAYPLGQSRRTDRFGFPYFPLCRQCGKPFGLEPGFLQFGQQNQRYRIFRQSGGKILQCLAAVFAGFSVGDMQFQQFQIGKQTRIACGLQQFVPIERRVGGIGFAVEITLLLRRRPQCVHCLDTQQFFLAVDDVQRFQRRVRIDASDMCRHVIPPSERSGGGQSVRQHPAAFPPTGFLLLPVCPKFRCRHNPKCGGRTRSSVCRPARRVSIPALQPSISKDIR

SEQ ID NO: 2743 - DNA, 90 bp, Neisseria gonorrhoeae
ttgagactgcatctcaactttgaaaacaggtataacctgctttgcaacccgttcgaacattcggtatcaaagcaggcggtttttatatcc

SEQ ID NO: 2744 - protein, 30 aa, Neisseria gonorrhoeae
LRLHLNFENRYNLLCNPFEHSVSKQAVFIS

SEQ ID NO: 2745 - DNA, 141 bp, Neisseria gonorrhoeae
ttgtacgtgcaggaaaatagggcggaaaaaaggaaaagggggaagctttgtaaagattgggtgcgttacccaatctttacgaataccccccttttccttttttatgaactgtttttcaataccgcaaacccactaacggag

SEQ ID NO: 2746 - protein, 47 aa, Neisseria gonorrhoeae
LYVQENRAEKRKRGKLCKDWVRYPIFTNTPLFLFYELFFNTANPLTE

SEQ ID NO: 2747 - DNA, 417 bp, Neisseria gonorrhoeae
atggacaataagaccaaactgcgcttgggcggcctgattttactgaccaccgccgttttaagcctcattatcgtattgattgtcgattcctggccgcttgccatcctgcttgccgccgtcatcgtcgccgccgctgcgggcggctttgtttggacatcccgccgacagcaacgccagtttatcgaacgtctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgt

SEQ ID NO: 2748 - protein, 139 aa, Neisseria gonorrhoeae
MDNKTKLRLGGLILLTTAVLSLIIVLIVDSWPLAILLAAVIVAAAAGGFVWTSRRQQRQFIERLKKFDIDPEKGRINEANLRRMYHSGGQHQKDAITLICLSQKCSVDEAHAMFKKRPTRQEINQMAAKQSRGQKRPHR

SEQ ID NO: 2749 - DNA, 564 bp, Neisseria gonorrhoeae
atgccgtctgaagtctgttggcgtttcagacggcatattccgattgaaaagatgatgatactgaaaaccgccccgctcaaacgccgctttgccgccatactgtatgagatgctgctggtcggtgcggcgacctgtttggcagcattgcttgccggtattgccgccatttttctgaatcccgtttctatcgcggtttctgcattggtaacgagtatcctgataatgggagcatggtggctttatttccgcgccaactggcacggtcaggggcagaccttggcgatgaggacatggaaaatcggcttgtgcgaccttaacggcatacagccgtctttgcacctgctgcgcctgcgctttatttgggcgtgcatattcatcgtcttcattcctatgcttgcttatgccggattgcgccacttcctcggcattccgcccaagggcgcggccggcgcggcattggtttggctgattttgccgtgggggttcgccctgctgaatcccgaccggcagtttctgtatgacttccttgccggaacgaggttggtggatgtgaaagaacaatct

SEQ ID NO: 2750 - protein, 188 aa, Neisseria gonorrhoeae
MPSEVCWRFRRHIPIEKMMILKTAPLKRRFAAILYEMLLVGAATCLAALLAGIAAIFLNPVSIAVSALVTSILIMGAWWLYFRANWHGQGQTLAMRTWKIGLCDLNGIQPSLHLLRLRFIWACIFIVFIPMLAYAGLRHFLGIPPKGAAGAALVWLILPWGFALLNPDRQFLYDFLAGTRLVDVKEQS

SEQ ID NO: 2751 - DNA, 420 bp, Neisseria gonorrhoeae
atgccgtctgaaacgccaacagacttcagacggcatttgtgcaaagatgccttgcggcggttaacggtgcggacgtttctgaccgcgcgactgttttgccgccatttgattgatttcctgacgtgtcgggcgttttttgaacatagcgtgcgcctcgtccaccgaacatttttgcgacaggcagatcagggtaatcgcatctttctggtgttgtccgccgctgtggtacatacggcgcaggtttgcctcgttgattctgcctttttcgggatcgatgtcgaattttttcagacgttcgataaactggcgttgctgtcggcgggatgtccaaacaaagccgcccgcagcggcggcgacgatgacggcggcaagcaggatggcaagcggccaggaatcgacaatcaatacgataatgaggct

SEQ ID NO: 2752 - protein, 140 aa, Neisseria gonorrhoeae
MPSETPTDFRRHLCKDALRRLTVRTFLTARLFCRHLIDFLTCRAFFEHSVRLVHRTFLRQADQGNRIFLVLSAAVVHTAQVCLVDSAFFGIDVEFFQTFDKLALLSAGCPNKAARSGGDDDGGKQDGKRPGIDNQYDNEA

SEQ ID NO: 2753 - DNA, 882 bp, Neisseria gonorrhoeae
atgagcagcggaaatatccgcatccacagcatgaccggctttgccaacgcggcggcagagtgcggcagcaaacgcatcaacctcgacatccgcgccgtcaaccaccgctttttggacattcaaatcaggatgcccgacgatttgcgccatttggaaaacggcatccgcgagcagatttcatcccatctggcgcgcggcaaagtcgaatgcaaaatccaaattcaagatgcggaaaacggcaatcagtctttggaactgaatcgcgttctggtcggacagcttgccgaaatcaacaaaaacctccgcaaacattatgatttggcaaaactgggcgttgctgatattttgcgctttccgggcgtattggcaagccaaaaggaaaatacggaagcattggcgaaaaccattgtcgaactggccgacaaagcactaaaagactttaccgccgcacgtcggcgtgaagggaaaaaattgggcgaacacctgttacaacgcattaaaaacatggaagaaatcatcgatgctttgagcgaaatcttccccgcgctggtggaagcgcataaagaaaaaatccgcacccgccttgccgaagccgtcggcagcatcgacaacgacaggctgcaacaggaatttgccctctttatccaaaaatccgacatcgacgaagaattcagccgcctgcgcacccacattgccgaagtgcgccgtatcgttaccgaacacaaaggcagcagcggcaaacggttggacttcctgatgcaggaactgaaccgcgaagccaacactttgggcagcaaatccatcgctaccgaatgcacccaagcctcggtcgagctgaaagtcctgatcgaacagatgcgcgaacaggtgcagaatatcgaa

SEQ ID NO: 2754 - protein, 294 aa, Neisseria gonorrhoeae
MSSGNIRIHSMTGFANAAAECGSKRINLDIRAVNHRFLDIQIRMPDDLRHLENGIREQISSHLARGKVECKIQIQDAENGNQSLELNRVLVGQLAEINKNLRKHYDLAKLGVADILRFPGVLASQKENTEALAKTIVELADKALKDFTAARRREGKKLGEHLLQRIKNMEEIIDALSEIFPALVEAHKEKIRTRLAEAVGSIDNDRLQQEFALFIQKSDIDEEFSRLRTHIAEVRRIVTEHKGSSGKRLDFLMQELNREANTLGSKSIATECTQASVELKVLIEQMREQVQNIE

SEQ ID NO: 2755 - DNA, 105 bp, Neisseria gonorrhoeae
ttgatacatttcccttccttgcagcaacaaaagcgcgtgattccaatctaccgctgcgaaatcttcaatttttcacacccgaaaacgcttgccgccatacagatg

SEQ ID NO: 2756 - protein, 35 aa, Neisseria gonorrhoeae
LIHFPSLQQQKRVIPIYRCEIFNFSHPKTLAAIQM

SEQ ID NO: 2757 - DNA, 1854 bp, Neisseria gonorrhoeae
atgttgaacaaaatattttcctggttcgagtcccgaatcgacccctaccccgaagccgcgccgaaaacgcccgaaaaaggcttgtgccggtttgtctggagcagtatggacggggtgcggaaatggatagccgccctagctgcgctgaccgccggcatcggcattatggaagccctgatttttcaatttatgggcaaaatcgtagagtggctcggcaaatacgcgcccgccgaactgtttgccgaaaaaggttgggaactggcggcaatggcggcgatgatggtgttttcggtcgtgtgggcgtttgccgcgtccaacgtgcgcctgcaaacccttcagggcgtgttccctatgcgcctgcgctggaacttccaccgcctgatgctgaaccagagcctcggtttttatcaggacgaatttgccggccgcgtgtccgccaaagtcatgcagaccgcgctggcgttgcgcgacgcggtgatgacggttgccgatatggtcgtttatgtgtcggtgtatttcatcacttcgggcgtgattctcgcctcgctcgactcatggctgctgctgccctttatcggctggataatcggtttcgcttcggtaatgcgcctgctgattcccagattggggcaaaccgccgcacggcaggcgaatgcccgctcgctgatgaccggccgcattaccgatgcctattccaatatcgccaccgtcaaactctttttccacggcgcgcgcgaagccgtctatgccaagcagtcgatggaagaatttatggttacggtgcgcgcccaaatgcggctggcgactctgctgcattcgtgcaacttcatcgtcaacacttcgctgaccctctccaccgccgcactgggcatctggctttggcacaacggacaggtcggcgtgggtgcggtcgccaccgccaccgcgatggcgttgcgcgccaacgggctgtcgcaatacattatgtgggaatccgcgcggctgtttgaaaacatcggcatcgtcaacgacggcatggcgaccctgtccaaaccgcacaccatcctcgacaagccccaagccctgccgctgaacgtgccgcaaggcgcaatcaagttcgaacacgtcgatttttgctacgaagccggcaaaccgctgctcaacggctttaacctgaatatcaaacccggcgaaaaagtcggcttgatcggacgcagcggcgcgggcaaatccaccatcgtcaacctgcttttgcgtttctacgaaccgcaaagcggcacggtttcgatcgacgggcaggacataagcggcgttacccaagaatctttacgcgcccaaatcggtttggtcacacaagatacctcgctgctgcaccgttccgtgcgcgacaacattatttacggccgccccgacgcgaccgatgccgaaatggtttccgccgccgaacgcgccgaagccgccggcttcatccccgacctttccgatgccaaagggcggagcggctacgacgcgcacgtcggcgaacgcggcgtgaaactctccggcggacaacgccagcgcatcgccatcgcccgcgtgatgctcaaagacgcacccatcctgctgcttgacgaagccaccagcgcgctcgattccgaagttgaagccgccatccaagaaagcctcgacaaaatgatggaaggcaaaaccgtcatcgccatcgcccaccgcctctccaccattgccgcgatggacaggctcgtcgtcctcgacaaaggccgcatcatcgaagaaggcacacacgccgaactcctcgaaaaacgcgggctttacgccaaactctgggcgcaccagagcggcggcttcctcagcgaacacgtcgagtggcagcacgac

SEQ ID NO: 2758 - protein, 618 aa, Neisseria gonorrhoeae
MLNKIFSWFESRIDPYPEAAPKTPEKGLCRFVWSSMDGVRKWIAALAALTAGIGIMEALIFQFMGKIVEWLGKYAPAELFAEKGWELAAMAAMMVFSVVWAFAASNVRLQTLQGVFPMRLRWNFHRLMLNQSLGFYQDEFAGRVSAKVMQTALALRDAVMTVADMVVYVSVYFITSGVILASLDSWLLLPFIGWIIGFASVMRLLIPRLGQTAARQANARSLMTGRITDAYSNIATVKLFFHGAREAVYAKQSMEEFMVTVRAQMRLATLLHSCNFIVNTSLTLSTAALGIWLWHNGQVGVGAVATATAMALRANGLSQYIMWESARLFENIGIVNDGMATLSKPHTILDKPQALPLNVPQGAIKFEHVDFCYEAGKPLLNGFNLNIKPGEKVGLIGRSGAGKSTIVNLLLRFYEPQSGTVSIDGQDISGVTQESLRAQIGLVTQDTSLLHRSVRDNIIYGRPDATDAEMVSAAERAEAAGFIPDLSDAKGRSGYDAHVGERGVKLSGGQRQRIAIARVMLKDAPILLLDEATSALDSEVEAAIQESLDKMMEGKTVIAIAHRLSTIAAMDRLVVLDKGRIIEEGTHAELLEKRGLYAKLWAHQSGGFLSEHVEWQHD

SEQ ID NO: 2759 - DNA, 156 bp, Neisseria gonorrhoeae
atgttcgaacgggttgcaaagcaggttatacctgttttcaaagttgagatgcagtctcaattttatgggtttcattatacatacacgattgcacggataaaaagtcttttttataatccgccctcgtcaaaccgacccgaaacgaaaacgccatta

SEQ ID NO: 2760 - protein, 52 aa, Neisseria gonorrhoeae
MFERVAKQVIPVFKVEMQSQFYGFHYTYTIARIKSLFYNPPSSNRPETKTPL

SEQ ID NO: 2761 - DNA, 246 bp, Neisseria gonorrhoeae
atgttctggcttaaagatggtcgggttgcccggaaagacagtttgtttgaagttgattacatttacggtgcagacggttgcgggttcttgccgtcaaatttaacggagttcagaaaatattgccggaaaaagcaccaaaagtttaaggacgatgaagttttagtaaaccgttacgcggtcgattttttgggtgcgaaggaacccccatatgacgaccgccatgtgacttcagtcaaatattttgtt

SEQ ID NO: 2762 - protein, 82 aa, Neisseria gonorrhoeae
MFWLKDGRVARKDSLFEVDYIYGADGCGFLPSNLTEFRKYCRKKHQKFKDDEVLVNRYAVDFLGAKEPPYDDRHVTSVKYFV

SEQ ID NO: 2763 - DNA, 384 bp, Neisseria gonorrhoeae
atgatttttgcaagccgttggctgcaagtgccgatttatgcggggctgactgttgtacgggcgatttgtgcctataagtttttgaaatcgttgaagcatctggtcatgaatttggatgtgtcggacgaaaacgccatcatgctcgctgttttaaatctgattgatgtggttatgattgcgaatttgctgaccatggtgcagattggcgggtatgagtcgttcgtatcccggttgcgtatcgacgaccatcctgaccggcccgagtggttgagccatgtgaatgcaccggtattgaaggtaaggctgtcgatgtcgattatcggtattcatccatccatttgctccaaacatttatcaattccgccaatctgtcggaaaagcagc

SEQ ID NO: 2764 - protein, 128 aa, Neisseria gonorrhoeae
MIFASRWLQVPIYAGLTVVRAICAYKFLKSLKHLVMNLDVSDENAIMLAVLNLIDVVMIANLLTMVQIGGYESFVSRLRIDDHPDRPEWLSHVNAPVLKVRLSMSIIGIHPSICSKHLSIPPICRKSS

SEQ ID NO: 2765 - DNA, 219 bp, Neisseria gonorrhoeae
gtggttgagccatgtgaatgcaccggtattgaaggtaaggctgtcgatgtcgattatcggtattcatccatccatttgctccaaacatttatcaattccgccaatctgtcggaaaagcagctgatgtggcagtgtctggtgcatgtctgctttttgatttcggcgattgcgatggcttgggcggataaaatcgtgtacggcacgacgcacaaaccgcat

SEQ ID NO: 2766 - protein, 73 aa, Neisseria gonorrhoeae
VVEPCECTGIEGKAVDVDYRYSSIHLLQTFINSANLSEKQLMWQCLVHVCFLISAIAMAWADKIVYGTTHKPH

SEQ ID NO: 2767 - DNA, 861 bp, Neisseria gonorrhoeae
atgaataacgctttcgcattacccgccatccaaagcggcaacggcagcctcgaacaatacatccacaccgtcaacagcatcccgatgctgtcccaggaagaagaaacccgcctcgccgaacgccggataaagggcgacctcaacgccgccaaacaactcatcctgtcccacctgcgcgtcgtcgtttccatcgcgcgcggctatgacggctacgggctgaatcaggccgacctgattcaggaaggaaatatcggtctgatgaaggcggtcaaacgctacgagcccggtcgaggtgcacgcctgttttcatttgccgtgcattggattaaagcggaaattcacgaattcatcctgaggaactggcgccttgtccgcgttgccaccaccaaaccgcaacgcaagctgtttttcaacctgcgcagcatgcgtaaaaaccttaatgtcctgtctcccaaagaggcacaagacatcgccgacgatttgggtgtcaaactttccgaagttctggaaatggaacagcgcatgacgggacacgacatcgccatcatggcagacaacagcgacgacgaggacagtttcgcccccatcgactggcttgccgaccacgattccgaaccgagccgacaactatcgaaacaggcgcattacgccctgcaaaccgaaggcctgcaaaacgccttggcgcaattggacgacaggagccgccgcattgtggaaagccgctggcttcaagacgacggcggactgacgctgcaccagcttgccgccgaatacggcgtatctgccgagcgcatccgccagattgaagcgaaagccatgcagaaactgcgcggtttcctgaccgaagaagccgaagcggtt

SEQ ID NO: 2768 - protein, 287 aa, Neisseria gonorrhoeae
MNNAFALPAIQSGNGSLEQYIHTVNSIPMLSQEEETRLAERRIKGDLNAAKQLILSHLRVVVSIARGYDGYGLNQADLIQEGNIGLMKAVKRYEPGRGARLFSFAVHWIKAEIHEFILRNWRLVRVATTKPQRKLFFNLRSMRKNLNVLSPKEAQDIADDLGVKLSEVLEMEQRMTGHDIAIMADNSDDEDSFAPIDWLADHDSEPSRQLSKQAHYALQTEGLQNALAQLDDRSRRIVESRWLQDDGGLTLHQLAAEYGVSAERIRQIEAKAMQKLRGFLTEEAEAV

SEQ ID NO: 2769 - DNA, 144 bp, Neisseria gonorrhoeae
atggcgggtaatgcgaaagcgttattcatttggggcatttcctttcggctgaaactgcgtatcggcggtttggtgtgttgggatgcagtatatcactgcttggcttgtattttgtatgtttggcaggagatatacgctaaggtt

SEQ ID NO: 2770 - protein, 48 aa, Neisseria gonorrhoeae
MAGNAKALFIWGISFRLKLRIGGLVCWDAVYHCLACILYVWQEIYAKV

SEQ ID NO: 2771 - DNA, 1536 bp, Neisseria gonorrhoeae
atgttttccaaactggacaaatactggcagcaccccgccctctactggcctttgctcatcctttttgccgccgccacccccttcgccttcgcaccctactaccacttttggctgatgcccttgattttcggcgccttcgtccgcctcatcgaactgcgtccgcgttttgccgcctcttccgcctacctgttcggtctgaccgcatacacggcacagttctactggatacacactgccctgcacgacgtttccggcctgcccgacctctatgccgtaccgctgaccttcctgctgcccgcctaccttgccctttatccggcactgtgtttctggctgtggaaaaaatttaccctgccccagggcataaagaccggtctggtactgcccatcctgtggacgctgaccgagtttgcccgcgagcgtttcctgaccggattcggctggggcgcaatcggctactcccaaatcaccccggacagcccgctggcgggtttcgcccccttgggcggcatccacatggttacactggcaaccgcctttctcggtgtctggctggttttggcgatcgacaacaccgcacgttcgggcaaacgcctgcttccggccattctgattgccgccctgcttgccgcaggctacaccgcccaacaaaccgacttcacccgccccgacggcagccgcagcaccgtcgccctgcttcagggcaacatcgcccaaaccctcaaatggcgtgaagaccaagtcatcccgaccatacagaaatattacgaacaggtcggcaaaaccactgccgacatcgtcatcctgcccgaaaccgccattcccatcatgcgccaaaacctgccggaaaacatactggcgcaattcgccgaacaggcgcaaaacaacggcagcgcgctcgccgtcggcatcagccaatacacttcggacggcaacggttacgaaaacgccgtcatcaacctgaccggctatcaggaaaacaatcaggacggcatcccttactacgccaaaaaccacctcgtccccttcggcgaatacaaaccgctgcccctcctgaccacaccgctttacaaaatgatggacatgcccctttccgacttccgcaaaggcggcggcaagcaatccgccatgatgatgaaaaaccaaaaaatcgccttcaacatctgctacgaagacggattcggcgacgaactgattgccgccgccaaagacgccacactgcttgccaatgtcagcaatatggcgtggtatggaaaatccaacgccatgtaccagcacctccaacaatcgcaggcgcgggctatggaactcggacgctatatggtccgcgccaccaacaccggcgcaaccgccatcatctcccccaaaggcaacatcatcgcccaagcccaacccgatacggaaaccgtattagaaggacacatcaaaggctacatcggcgaaacgccctatatgaaaaccggcagttcatggtggttgatgggcatattgaccctagccgcactgattcttttcatcttccgaaacaaagaacac

SEQ ID NO: 2772 - protein, 512 aa, Neisseria gonorrhoeae
MFSKLDKYWQHPALYWPLLILFAAATPFAFAPYYHFWLMPLIFGAFVRLIELRPRFAASSAYLFGLTAYTAQFYWIHTALHDVSGLPDLYAVPLTFLLPAYLALYPALCFWLWKKFTLPQGIKTGLVLPILWTLTEFARERFLTGFGWGAIGYSQITPDSPLAGFAPLGGIHMVTLATAFLGVWLVLAIDNTARSGKRLLPAILIAALLAAGYTAQQTDFTRPDGSRSTVALLQGNIAQTLKWREDQVIPTIQKYYEQVGKTTADIVILPETAIPIMRQNLPENILAQFAEQAQNNGSALAVGISQYTSDGNGYENAVINLTGYQENNQDGIPYYAKNHLVPFGEYKPLPLLTTPLYKMMDMPLSDFRKGGGKQSAMMMKNQKIAFNICYEDGFGDELIAAAKDATLLANVSNMAWYGKSNAMYQHLQQSQARAMELGRYMVRATNTGATAIISPKGNIIAQAQPDTETVLEGHIKGYIGETPYMKTGSSWWLMGILTLAALILFIFRNKEH

SEQ ID NO: 2773 - DNA, 1449 bp, Neisseria gonorrhoeae
ttgggcttgggcgatgatgttgcctttgggggagatgatggcggttgcgccggtgttggtggcgcggaccatatagcgtccgagttccatagcccgcgcctgcgattgttggaggtgctggtacatggcgttggattttccataccacgccatattgctgacattggcaagcagtgtggcgtctttggcggcggcaatcagttcgtcgccgaatccgtcttcgtagcagatgttgaaggcgattttttggtttttcatcatcatggcggattgcttgccgccgcctttgcggaagtcggaaaggggcatgtccatcattttgtaaagcggtgtggtcaggaggggcagcggtttgtattcgccgaaggggacgaggtggtttttggcgtagtaagggatgccgtcctgattgttttcctgatagccggtcaggttgatgacggcgttttcgtaaccgttgccgtccgaagtgtattggctgatgccgacggcgagcgcgctgccgttgttttgcgcctgttcggcgaattgcgccagtatgttttccggcaggttttggcgcatgatgggaatggcggtttcgggcaggatgacgatgtcggcagtggttttgccgacctgttcgtaatatttctgtatggtcgggatgacttggtcttcacgccatttgagggtttgggcgatgttgccctgaagcagggcgacggtgctgcggctgccgtcggggcgggtgaagtcggtttgttgggcggtgtagcctgcggcaagcagggcggcaatcagaatggccggaagcaggcgtttgcccgaacgtgcggtgttgtcgatcgccaaaaccagccagacaccgagaaaggcggttgccagtgtaaccatgtggatgccgcccaagggggcgaaacccgccagcgggctgtccggggtgatttgggagtagccgattgcgccccagccgaatccggtcaggaaacgctcgcgggcaaactcggtcagcgtccacaggatgggcagtaccagaccggtctttatgccctggggcagggtaaattttttccacagccagaaacacagtgccggataaagggcaaggtaggcgggcagcaggaaggtcagcggtacggcatagaggtcgggcaggccggaaacgtcgtgcagggcagtgtgtatccagtagaactgtgccgtgtatgcggtcagaccgaacaggtaggcggaagaggcggcaaaacgcggacgcagttcgatgaggcggacgaaggcgccgaaaatcaagggcatcagccaaaagtggtagtagggtgcgaaggcgaagggggtggcggcggcaaaaaggatgagcaaaggccagtagagggcggggtgctgccagtatttgtccagtttggaaaacatattcgtctgtctgttcggaagatgccgtctgaacgtctttcagacggcatcggtatt

SEQ ID NO: 2774 - protein, 483 aa, Neisseria gonorrhoeae
LGLGDDVAFGGDDGGCAGVGGADHIASEFHSPRLRLLEVLVHGVGFSIPRHIADIGKQCGVFGGGNQFVAESVFVADVEGDFLVFHHHGGLLAAAFAEVGKGHVHHFVKRCGQEGQRFVFAEGDEVVFGVVRDAVLIVFLIAGQVDDGVFVTVAVRSVLADADGERAAVVLRLFGELRQYVFRQVLAHDGNGGFGQDDDVGSGFADLFVIFLYGRDDLVFTPFEGLGDVALKQGDGAAAAVGAGEVGLLGGVACGKQGGNQNGRKQAFARTCGVVDRQNQPDTEKGGCQCNHVDAAQGGETRQRAVRGDLGVADCAPAESGQETLAGKLGQRPQDGQYQTGLYALGQGKFFPQPETQCRIKGKVGGQQEGQRYGIEVGQAGNVVQGSVYPVELCRVCGQTEQVGGRGGKTRTQFDEADEGAENQGHQPKVVVGCEGEGGGGGKKDEQRPVEGGVLPVFVQFGKHIRLSVRKMPSERLSDGIGI

SEQ ID NO: 2775 - DNA, 183 bp, Neisseria gonorrhoeae
atggagacggagaacacgtgtgaaatccccgttttcatctacaattttgatatatcttggtttgtgaatcatgacatcctcagatttagtattcagaatatgattttaaaaagaactttctgctttacgactccgccgccgattccttcaaacggttttccgcgctcttcagttgtcgtacat

SEQ ID NO: 2776 - protein, 61 aa, Neisseria gonorrhoeae
METENTCEIPVFIYNFDISWFVNHDILRFSIQNMILKRTFCFTTPPPIPSNGFPRSSVVVH

SEQ ID NO: 2777 - DNA, 129 bp, Neisseria gonorrhoeae
ttggtttttctcataatggcgttttcgtttcgggtcggtttgacgagggcggattataaaaaagactttttatccgtgcaatcgtgtatgtataatgaaacccataaaattgagactgcatctcaactt

SEQ ID NO: 2778 - protein, 43 aa, Neisseria gonorrhoeae
LVFLIMAFSFRVGLTRADYKKDFLSVQSCMYNETHKIETASQL

SEQ ID NO: 2779 - DNA, 111 bp, Neisseria gonorrhoeae
ttgcacgatttcctgcacgcgcaacactggaacgctggctggacagagtattccgccaacctcgttgtcgggccgctttccggttcgattgcctgcgccccgccttgtcgc

SEQ ID NO: 2780 - protein, 37 aa, Neisseria gonorrhoeae
LHDFLHAQHWNAGWTEYSANLVVGPLSGSIACAPPCR

SEQ ID NO: 2781 - DNA, 690 bp, Neisseria gonorrhoeae
ttggacgatgttgccctgatgaccaaagccgccgcaaagaaaaccgccggcgtggccggcgacgatttggcacccaatgccaaccgggttacaggcgtatcggcagaacgcgagttgccgattgtttggccggtggcgaaaggttcttttgccaacaagccggttttggtgtctgcggctctgctgctttccgccttcctgccgcaactcattacgccgcttttgacggcaggcgggatttatttgtgctttgagggcgtggaaaagctgctgcacaagtttctgcaccgacatgacgcgcacgatgacggcggcgaaacggcggttaacgagcaggctaaaatcaaaggtgcaatccgtaccgactttatcctgtccgcagaaatcatcatcatcgcgctgtgcgtggtcgaacaatacagcctgatgacgcgctcgctcgtgatggcggcaatcggcatcggcatgactgttttggtgtacggaatcgtcgccgtcatcgtcaaactcgacgacttgggcatgctgctgatgcgccgcccacaacctcggccttttgcacgatttcctgcacgcgcaacactggaacgctggctggacagagtattccgccaacctcgttgtcgggccgctttccggttcgattgcctgcgccccgccttgtcgctgatgaatcgtttcggcaggcat

SEQ ID NO: 2782 - protein, 230 aa, Neisseria gonorrhoeae
LDDVALMTKAAAKKTAGVAGDDLAPNANRVTGVSAERELPIVWPVAKGSFANKPVLVSAALLLSAFLPQLITPLLTAGGIYLCFEGVEKLLHKFLHRHDAHDDGGETAVNEQAKIKGAIRTDFILSAEIIIIALCVVEQYSLMTRSLVMAAIGIGMTVLVYGIVAVIVKLDDLGMLLMRRPQPRPFARFPARATLERWLDRVFRQPRCRAAFRFDCLRPALSLMNRFGRH

SEQ ID NO: 2783 - DNA, 96 bp, Neisseria gonorrhoeae
ttgggaacgcccatcaccagcggcatcatcgccagcgaaatcggtacggctcctcgcaagcccaaccaactgatatacgccttttcacgcaggctg

SEQ ID NO: 2784 - protein, 32 aa, Neisseria gonorrhoeae
LGTPITSGIIASEIGTAPRKPNQLIYAFSRRL

SEQ ID NO: 2785 - DNA, 1728 bp, Neisseria gonorrhoeae
gtggattggatgaacagcctgtttctgctgggtggcgcactgttgttcctgagcgtggtttcgaccactttgtccgcacgtttgggaatgcctttgctgctggtgtttcttgccgtcggcatgctggcgggcgaggaaggcgttggcggcattgccttcaataatgtcgtgatggcgaatttcatcagccagcttgctttggcggttattctgctcgacggcggtttgcggacgcagctttccagttttcggattgcgttgaagcccgcgtcggtactcgcttcgtggggcgtgtttgccactgtgcttccgctgggactgtttgcaactttttatctcggtttggattggaagttcggcgtgctgatggcggcgattgtcggttcgaccgatgccggcgcggtattcagccttttgcgcaacagcggcgtgcgtttgaacgaacgggtgcaggcgactttggaaatcgaatcgggtgcgaacgacccgatggcggtttttttggttacggcactgattaccatgattatgcagccggcggaatcgggtgcggcagcgtttgtccggatgcttgcgctgcaaatcggtttcggtctgctgacgggttgggcgggcggaaagatattggcaaagctggtacgccgtctgaatcttgcggaaggtctgtacgcgctgatgattgtgtcgggcgggctgcttgtgtttgcgtttaccaataccataggcggcagcggctttttggcggtttaccttgccggcatcattgtcggtaaccagcgcaaccgtgcgacggaacacgttttgcgtgtgatggacggtttggcttggctggcgcaggcaactttgttcgtcatgctcggtctgctggtttctcccgccggcgtgttggacagggcggcggaagccttggcgattgcggcgttcctgatgctggtcgcgcgtccgctggcagtgttcggcggtttgtggaaattcaattacagcctgcgtgaaaaggcgtatatcagttggttgggcttgcgaggagccgtaccgatttcgctggcgatgatgccgctggtgatgggcgttcccaattcgcacctgctgtttgatgtggcgtttgccgtggtggtgctgtcgctgctgattcagggaacgacgattcctgtgatggcgcggctgttgaaggttgccatgcccaacaagcccgaaccgaaagatacgcatgatatttggctggcggaaaaggaaattgtcagaatgtcggcgtttaaagtggttgccgaatctgaagcggagggacaccatcccgatacggtcgaaccgatttccgattcgtttgacgcacgctgtttcgcattgatacgcaacggcagccgaatcgaaatgcagtccgacaccgtgcttcaggcggaggatttggcgtggtacatcctggccgacggcaaggtcgataaaatggcgaaatactttaccgagacgggtatcggcgtccgtgaaaattttgatttcttcggtgagtttgtcgtttcgccggcagcacgttcgggcgatttggcacttgcttacggtttgaagctggaagcgggcgaagagggtttgagccttgccgagcttttcgataagcgttccgacagtcaggagccggtcgagggcgaccgtattgacatcggcggctttatgctgaccgcgaaggaggttgacggtggcggcaatatcgggtctatggggctgaaagtaccgcgt

SEQ ID NO: 2786 - protein, 576 aa, Neisseria gonorrhoeae
VDWMNSLFLLGGALLFLSVVSTTLSARLGMPLLLVFLAVGMLAGEEGVGGIAFNNVVMANFISQLALAVILLDGGLRTQLSSFRIALKPASVLASWGVFATVLPLGLFATFYLGLDWKFGVLMAAIVGSTDAGAVFSLLRNSGVRLNERVQATLEIESGANDPMAVFLVTALITMIMQPAESGAAAFVRMLALQIGFGLLTGWAGGKILAKLVRRLNLAEGLYALMIVSGGLLVFAFTNTIGGSGFLAVYLAGIIVGNQRNRATEHVLRVMDGLAWLAQATLFVMLGLLVSPAGVLDRAAEALAIAAFLMLVARPLAVFGGLWKFNYSLREKAYISWLGLRGAVPISLAMMPLVMGVPNSHLLFDVAFAVVVLSLLIQGTTIPVMARLLKVAMPNKPEPKDTHDIWLAEKEIVRMSAFKVVAESEAEGHHPDTVEPISDSFDARCFALIRNGSRIEMQSDTVLQAEDLAWYILADGKVDKMAKYFTETGIGVRENFDFFGEFVVSPAARSGDLALAYGLKLEAGEEGLSLAELFDKRSDSQEPVEGDRIDIGGFMLTAKEVDGGGNIGSMGLKVPR

SEQ ID NO: 2787 - DNA, 234 bp, Neisseria gonorrhoeae
atgaaattagaatcgaaagattgtaacacggcattttcttctcacgaaactttatttcatgtccgccaccgccttcagacggcattttcctgtttcatgccgcctgataccgcccaaacccgcgttctcctatataatgtcggactttgcgccgcatttcaggattttttatggcatttgcctcactatttactctgccggactacatcgccgccgttttggacgatgttgccc

SEQ ID NO: 2788 - protein, 78 aa, Neisseria gonorrhoeae
MKLESKDCNTAFSSHETLFHVRHRLQTAFSCFMPPDTAQTRVLLYNVGLCAAFQDFLWHLPHYLLCRTTSPPFWTMLP

SEQ ID NO: 2789 - DNA, 552 bp, Neisseria gonorrhoeae
gtgcaaccttactaccgattcggcaaaaaaacctttcacccgctacgcaaaatcaacaacaaggtttcaaacattaaggaaacgccaatgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaaccaaacagacaaaatgccgtctgaaaccggcaatccggcttcagacggcattcaaatcaaacctttc

SEQ ID NO: 2790 - protein, 184 aa, Neisseria gonorrhoeae
VQPYYRFGKKTFHPLRKINNKVSNIKETPMNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKNQTDKMPSETGNPASDGIQIKPF

SEQ ID NO: 2791 - DNA, 921 bp, Neisseria gonorrhoeae
atgccgtccgaacaccccttttcagacggcatttccacacccaaccccaaagaaaccatgaacgacaccgcccaaattaccgccggctacggccgccgctacatcgtccgcacgcccgacggcacaacctacgaagccagcacccgcaaaaaacgcgtcgatttcgcctgcggcgaccgcgtccgcatcagccccgtcaacgccgaacaagttgtgattgaagattttttaccgcgccaaagcctgctctaccgccaagacgcgtggaaaaccaaactcatcgccgccaacgttacccaactcctcatcgtaaccgccgccgtcccgagtccgagcgtgcggctgctacagcgcgccctgcttgccgccgaagccgccggcatccgcgccgtcatcgtcctgaacaaagccgacctgcccgaaaccgccctctggctcgaaaaactcaaattctacgaaacgctgggttaccccgtcatcgaaacccgcgtgctggaaaacgccgacagcctgcgccccgtcctgcaagggcacagcaacatcctgctcggacaaagcggtatgggcaaatccaccctggccaacgcccttttaggcagccaaaccgcccgcaccggcgacatttccgccgcactcgactcgggaaaacacaccaccacccacgcccggctttatgatttgaacggcgaaacccaactcatcgactccccgggtttgcaagaatttggtttacaccacctccaagccgccgatttgccgcactatttccccgatttccgccaccttgtcgggcaatgccgcttccacaactgcacccaccgcgccgaacccggctgcgccttcaaagccgctgccgaaaccggggcagcaagccccgaacgcctcgcctttttgcagggcatcaccgacgaactgctcggg

SEQ ID NO: 2792 - protein, 307 aa, Neisseria gonorrhoeae
MPSEHPFSDGISTPNPKETMNDTAQITAGYGRRYIVRTPDGTTYEASTRKKRVDFACGDRVRISPVNAEQVVIEDFLPRQSLLYRQDAWKTKLIAANVTQLLIVTAAVPSPSVRLLQRALLAAEAAGIRAVIVLNKADLPETALWLEKLKFYETLGYPVIETRVLENADSLRPVLQGHSNILLGQSGMGKSTLANALLGSQTARTGDISAALDSGKHTTTHARLYDLNGETQLIDSPGLQEFGLHHLQAADLPHYFPDFRHLVGQCRFHNCTHRAEPGCAFKAAAETGAASPERLAFLQGITDELLG

SEQ ID NO: 2793 - DNA, 1083 bp, Neisseria gonorrhoeae
atgatttatctgtttacgggaaacatgggggcaggcaaaaccccccgcgtcgtctctatgattttgaacaacgaagacggattgttcaaaatggaattggaagacggcacggaggcagaccggccgctttatttctgccatatcgacggattggacaaacgaaaattcaatgcccgcgaactggcggaagggcaaatcatgtccgccccgcttcgtgatgtcataccggaaggcgcggtgctgattgttggcgaagcgcactacacttacccggtacgcgcggcaggccgtcccgttccgccctatattcaggaactgacagaactccgccatcacgggcataccgtcattttgatgacgcggcacccgagccaacttgatatattcgtccgcaaccttgtttcaaagcatgtacaccttgaacgcaaggcaatcggcatgaaacagtattattggtataaatgcgtaacctcgttggacaatccggcaggcgtgagcggcgtagaagccgcaaattggaaaccgcctaaagaagccttcaaatactataaatccgcaagccggcaccaaaagttcaagaaaaaagtgccttgggcggtttgggcgttgattgcggttgtagggtttgtaggctggaaaagttacggcatgtttcaagtttacagcaaagccacagacagccggattgagcaggaagcgcaaaaagaaagcgttgtgcagacgatgacggagcagacggcatcatcagaaacagcgccttttgagcattccgacaatctgaaacctgaagactttgtgccgactttgcccgaaaagcccgaaagcaagcctatttataacacagtccgacaagtaaaaacctttgagcaaatcgccggatgcatagacggcggaaaatcagattgcacatgctattcaaatcaaggaacacccttgaaagaaataacaaagataatgtgtaaagaatatgtgaaaaacgggttgcctttcaatccttacaaggacgaacggcaaaggacggaacaggcggcacagtccgcgaaagcggacaagccccaagttctcgtaatgggcggaaagtcc

SEQ ID NO: 2794 - protein, 361 aa, Neisseria gonorrhoeae
MIYLFTGNMGAGKTPRVVSMILNNEDGLFKMELEDGTEADRPLYFCHIDGLDKRKFNARELAEGQIMSAPLRDVIPEGAVLIVGEAHYTYPVRAAGRPVPPYIQELTELRHHGHTVILMTRHPSQLDIFVRNLVSKHVHLERKAIGMKQYYWYKCVTSLDNPAGVSGVEAANWKPPKEAFKYYKSASRHQKFKKKVPWAVWALIAVVGFVGWKSYGMFQVYSKATDSRIEQEAQKESVVQTMTEQTASSETAPFEHSDNLKPEDFVPTLPEKPESKPIYNTVRQVKTFEQIAGCIDGGKSDCTCYSNQGTPLKEITKIMCKEYVKNGLPFNPYKDERQRTEQAAQSAKADKPQVLVMGGKS

SEQ ID NO: 2795 - DNA, 1080 bp, Neisseria gonorrhoeae
atgccgtctgaagccgcttcagacagcattttgccgctttaccctgcctgcactatttttcagaaaccgatcatgcttccattccttccagaaccctccctttcctatacgcaacaaaaccgtaccgccgttttgctgttgaacctcggcacacccgacgcaccgaccgcacaggcggtacgcccttatctgaaatcctttctgaccgaccggcgcatcgtcgaactgcccaaatggctgtggtatcccattctgcatggcctggtactgacgttccgccccaaaaaaagcgcgcacgcctatgaaaaaatctggtttaaggaaggttcgcccctagaagtttacacagcacgccaagctgccgcgcttgccgaacgtatgcccgacctcatcgtccgccacgccatgacttacggcaatccttcgatagcggatgtattggcggagctgaaatcccaaggtgtaggcagattgcttgcgattcccctgtatccgcaatatgccgcttccagcagcggagcggcggtagataaagtgtgcgaacaactgctgctgcaacgcaaccaaatgagcgtccgcaccatttcgcgcttttatgatgatgccggctacattgatgcgatgaaaaaccacatcctccgatattgggcggaacacgggcgtgggaaaaaactgatgttgagttttcacggcgtaccgcagaagcactacgacctcggcgacccctatcccgacgagtgccgccacaccgccaaactgcttgccgaagcactggaactgaccgaagacgaatataccgtatcgttccaaagccaattcggcagggcaaaatgggttacaccgagcacgcaggatttgttcggcaaactgcccaaacagggggtaaccgagctggacgtattctgcccgggctttttggcagactgcttggaaaccatggaagaaatcgccctgatggggcgggaacagttttatgaagcgggcggaaaaaactaccgctacatcccctgcctcaacgacaaccccgactggatagacgcactcgtcgcacttgccgaagaaaaccttggcggctggcgt

SEQ ID NO: 2796 - protein, 360 aa, Neisseria gonorrhoeae
MPSEAASDSILPLYPACTIFQKPIMLPFLPEPSLSYTQQNRTAVLLLNLGTPDAPTAQAVRPYLKSFLTDRRIVELPKWLWYPILHGLVLTFRPKKSAHAYEKIWFKEGSPLEVYTARQAAALAERMPDLIVRHAMTYGNPSIADVLAELKSQGVGRLLAIPLYPQYAASSSGAAVDKVCEQLLLQRNQMSVRTISRFYDDAGYIDAMKNHILRYWAEHGRGKKLMLSFHGVPQKHYDLGDPYPDECRHTAKLLAEALELTEDEYTVSFQSQFGRAKWVTPSTQDLFGKLPKQGVTELDVFCPGFLADCLETMEEIALMGREQFYEAGGKNYRYIPCLNDNPDWIDALVALAEENLGGWR

SEQ ID NO: 2797 - DNA, 990 bp, Neisseria gonorrhoeae
atgaacccgcaaaacctgcacgacatcaaggcgcaaattattttgggcaacacttatcatttgtggctgcgtccgggtttggaggtcgtcgaacagtttggagggcttcacggttttatcggctgggacaaaccgattctgaccgactcgggcggttttcaggttttttctttgtcggatatgcgcaagctgaccgaagaaggctgtacgtttaaaagcccgattaacggcgacaagctgtttttatcacctgaaatttccatgaaaatccaaacggttttgaactcggatatcgcgatgcagttggacgaatgcacgccgggcgaaacaacgcgcgaacaggcgcgaaaatccctgcaaatgagcttgcgctgggcggaacggagcaaaaaagcctttgaagatttgaaaaacccgaacgcgctgttcggcatcgtgcaaggcgcgatgtatgaggatttgcgcgaagaatctttgcgcggtttggaggaatttgattttcccggccttgccgtcggcggtttgtccgtcggcgaacccaagcccgaaatgtaccgtatgctgcacgccgtcggcccgatgctgcccgaacgcaaaccgcattacctgatgggcgtaggcacgccggaagacctcgtgtacggcgtggcgcacggcatcgatatgttcgactgcgtgatgcccacccgcaatgcacgcaacggctggctgtttacccgtttcggcgatttgaaaatcaaaaacgccaaacacaagcccgacaagcgtccgatagacgaaagctgcacctgctacgcctgccaaaatttcagccgcgcctacctgcaccatctgcaccgcgccggcgaaatcttgggcgcgcaattgaacaccatccacaacctgcatttctaccaagtcatcatggcggaaatgcgcgatgccgtcgaacaaggcaaatttgccgactggcaggcgcaattccacgaaaaccgcgcgcgcggcgtggac

SEQ ID NO: 2798 - protein, 330 aa, Neisseria gonorrhoeae
MNPQNLHDIKAQIILGNTYHLWLRPGLEVVEQFGGLHGFIGWDKPILTDSGGFQVFSLSDMRKLTEEGCTFKSPINGDKLFLSPEISMKIQTVLNSDIAMQLDECTPGETTREQARKSLQMSLRWAERSKKAFEDLKNPNALFGIVQGAMYEDLREESLRGLEEFDFPGLAVGGLSVGEPKPEMYRMLHAVGPMLPERKPHYLMGVGTPEDLVYGVAHGIDMFDCVMPTRNARNGWLFTRFGDLKIKNAKHKPDKRPIDESCTCYACQNFSRAYLHHLHRAGEILGAQLNTIHNLHFYQVIMAEMRDAVEQGKFADWQAQFHENRARGVD

SEQ ID NO: 2799 - DNA, 96 bp, Neisseria gonorrhoeae
ttgcaagagagatgtgcatttctttatgcaacattgtggcaagatttggggataccgtctgaaaaaccgtgggaattcatttataatgccgtcttt

SEQ ID NO: 2800 - protein, 32 aa, Neisseria gonorrhoeae
LQERCAFLYATLWQDLGIPSEKPWEFIYNAVF

SEQ ID NO: 2801 - DNA, 1944 bp, Neisseria gonorrhoeae
atgccgttattttttaatctttcggagcgtttgatgttgaatattaccttgccggactgttcagtccgccaatacgaatcccccgttaccgtggctcaaattgctgcgtctatcggtgccggtttggcgaaggcggcggtggcaggcaaggtaaacggcaaattggtcgatgcgtgcgacccgattgttgaggattctgctgttcaaatcattactccgaaagatcaggaaggcatcgaaatcatccgccattcctgcgcacatcttgtcgggcatgccgtcaagcaactctatcctaatgcaaaaatggttatcggccccgtcattgaagagggcttttattacgacatcgccacggaaaaaccgtttacaccggaagatgttgccgccattgaagcgcgtatgaaagaattgattgcccaagattatgatgtggtcaaaatcatgactccgcgtgcggaggcgattaaaatttttcaagagcgcggcgaagaatacaaactgcgcctgattgacgatatgcccgaagtggaagcgatggggatatatcatcaccaggaatatgtcgatatgtgccgcggtccgcacgttccgaacacccgcttcctgaaaaacttcaagctgaccaagctggcaggcgcatattggcgcggcgacagcaataatgaaatgctgcaacgtatttatggcactgcttgggcgacgaaagacgaattaaaagactatatccaacgcattgaagaagcagaaaaacgtgaccaccgcaaattgggcaagcaactggatttgttccacttgcaggacgaagcgccgggtatggtgttttggcatcccaaaggttgggctttgtggcagactatcgagcagcatatgcgtaaagagctgaacgccgccggttataaagaggtcaaaacgcctcaaattatggataaaaccttttgggaaaaatccggccactgggacaactacaaagacaatatgttcgtaaccagttcggaaaaacgcgaatatgcggttaaaccgatgaactgtccgggtcatgttcaaattttcaacaacggtttgcgttcatatcgagatttgccgatgcgtttggcggaattcggttcttgccaccgcaacgagccgagcggcgcactgcacggtctgatgagggttcgcggttttgtgcaggatgatgcgcatattttttgtaccgaagatcaaatcgtcagcgaggctcgtgcgttcaatgaattgttggttcgcatctacaaacagttcggtttccatgatgtatccgtcaggctttcccttcgccctgaaaaacgcgcaggttcagacgacgtgtgggataaggcagagcagggtttgcgcgaggcattgactgcctgcggcgtggaatggggcgaattgccgggcgagggtgcgttttacgggcctaaaatcgaatatcacgtcaaagatgccttgggtcgttcttggcaatgcggtacattacaactggattttgtcttgccggaacgcttggatgcagaatatgtaacagaaaacaacgaccgagcgcggcctgttatgttgcatcgcgccattttaggttctttggagcggtttatcggcattctgattgagaaccatgcaggctctttcccgttatggcttgcaccggttcaaatggtgattatgaacatcaccgaaaatcaggcagattattgtcgggaagttgctgccaaattgcaggcggcaggcttccgcgccgagttggatttgcgtaatgaaaaaatcggttacaaaatccgcgacaacagccaataccgtttcccttatcaaatcgttatcggtgataaagagaaacaagaaaacaaagttgcggtacgccgcaaagcggaagacttgggttctttggatttggatgatttcattgcgcaattgcagcaagaaatcactgatgccctcgtcaatcat

SEQ ID NO: 2802 - protein, 648 aa, Neisseria gonorrhoeae
MPLFFNLSERLMLNITLPDCSVRQYESPVTVAQIAASIGAGLAKAAVAGKVNGKLVDACDPIVEDSAVQIITPKDQEGIEIIRHSCAHLVGHAVKQLYPNAKMVIGPVIEEGFYYDIATEKPFTPEDVAAIEARMKELIAQDYDVVKIMTPRAEAIKIFQERGEEYKLRLIDDMPEVEAMGIYHHQEYVDMCRGPHVPNTRFLKNFKLTKLAGAYWRGDSNNEMLQRIYGTAWATKDELKDYIQRIEEAEKRDHRKLGKQLDLFHLQDEAPGMVFWHPKGWALWQTIEQHMRKELNAAGYKEVKTPQIMDKTFWEKSGHWDNYKDNMFVTSSEKREYAVKPMNCPGHVQIFNNGLRSYRDLPMRLAEFGSCHRNEPSGALHGLMRVRGFVQDDAHIFCTEDQIVSEARAFNELLVRIYKQFGFHDVSVRLSLRPEKRAGSDDVWDKAEQGLREALTACGVEWGELPGEGAFYGPKIEYHVKDALGRSWQCGTLQLDFVLPERLDAEYVTENNDRARPVMLHRAILGSLERFIGILIENHAGSFPLWLAPVQMVIMNITENQADYCREVAAKLQAAGFRAELDLRNEKIGYKIRDNSQYRFPYQIVIGDKEKQENKVAVRRKAEDLGSLDLDDFIAQLQQEITDALVNH

SEQ ID NO: 2803 - DNA, 465 bp, Neisseria gonorrhoeae
gtgcgtttaatcagtgagtcaggcgaacagcttggtgtcgtttcagttcgtgaagctttggctatggccgaagggcaggatgtcgatttggtagagatttccccaactgctaaacctcctgtgtgcaaactgatggattacggtaaatacaaataccaacaagccaagaagcgcgacgaagccaagaaaaaccaaaagcaggtgcaaattaaggaaattaaattccgtccgggtacagatgagggcgattatcaaatcaagatgcgcaacatcaaccgcttccttgccgacggcgataaagtcaaagtgacattgcgtttccgcggccgtgaaatggctcaccagcaactcggcgcgcaacttttggaacgtgtaaaagaagatttggctgaagtggcgcaaatcgagtcctttcccaaaatggaaggccgtcaaatggtgatgatgattgcaccgaagaaaaaa

SEQ ID NO: 2804 - protein, 155 aa, Neisseria gonorrhoeae
VRLISESGEQLGVVSVREALAMAEGQDVDLVEISPTAKPPVCKLMDYGKYKYQQAKKRDEAKKNQKQVQIKEIKFRPGTDEGDYQIKMRNINRFLADGDKVKVTLRFRGREMAHQQLGAQLLERVKEDLAEVAQIESFPKMEGRQMVMMIAPKKK

SEQ ID NO: 2805 - DNA, 495 bp, Neisseria gonorrhoeae
atgccacggttttttgccgcaattgaaaacttactccgaagcggcaatcggagtaagcggaaaattatagctttattttttcttcggtgcaatcatcatcaccatttgacggccttccattttgggaaaggactcgatttgcgccacttcagccaaatcttcttttacacgttccaaaagttgcgcgccgagttgctggtgagccatttcacggccgcggaaacgcaatgtcactttgactttatcgccgtcggcaaggaagcggttgatgttgcgcatcttgatttgataatcgccctcatctgtacccggacggaatttaatttccttaatttgcacctgcttttggtttttcttggcttcgtcgcgcttcttggcttgttggtatttgtatttaccgtaatccatcagtttgcacacaggaggtttagcagttggggaaatctctaccaaatcgacatcctgcccttcggccatagccaaagcttcacgaac

SEQ ID NO: 2806 - protein, 165 aa, Neisseria gonorrhoeae
MPRFFAAIENLLRSGNRSKRKIIALFFLRCNHHHHLTAFHFGKGLDLRHFSQIFFYTFQKLRAELLVSHFTAAETQCHFDFIAVGKEAVDVAHLDLIIALICTRTEFNFLNLHLLLVFLGFVALLGLLVFVFTVIHQFAHRRFSSWGNLYQIDILPFGHSQSFTN

SEQ ID NO: 2807 - DNA, 291 bp, Neisseria gonorrhoeae
ttgcggcaaaaaaccgtggcattgtgggttcaagtgtttgaaaccgatgttttaaaaccccctaatgccttatccgataacgaatggagttttcccatgcctaaaatgaaaaccaagtctagcgcgaaaaaacgctttaaagtactgggtaacggcggtgtgaaacgcgctcatgcgttcaaacgccacatcttgactaaaaagaccaccaaaaacaaacgccaactgcgcggtacctctatggtaaatgatcgcgatttggcttctgttgctaaaatgttaccctacgct

SEQ ID NO: 2808 - protein, 97 aa, Neisseria gonorrhoeae
LRQKTVALWVQVFETDVLKPPNALSDNEWSFPMPKMKTKSSAKKRFKVLGNGGVKRAHAFKRHILTKKTTKNKRQLRGTSMVNDRDLASVAKMLPYA

SEQ ID NO: 2809 - DNA, 330 bp, Neisseria gonorrhoeae
ttgccgaccggggcggaaaaaatgccgtctgaagccggattcgggtttcagacggcatccgttttgcaaaaatgctacaatccgctttttaccggaacacccgaaactatgaagaaaaacaccccgaaatcgtttgaagaggccttgtcgcgccttgaatcgctgacgcagtccatgcagggcgaaatgcccttggaagacgcgcttgccgcctatcaggaaggcaacgagctggtcaggtactgccaaaccaagctggcccaagtcgaacagaaattacaggttttggatgcggacgggacgaaggagttgaaccttgaatccgacgaa

SEQ ID NO: 2810 - protein, 110 aa, Neisseria gonorrhoeae
LPTGAEKMPSEAGFGFQTASVLQKCYNPLFTGTPETMKKNTPKSFEEALSRLESLTQSMQGEMPLEDALAAYQEGNELVRYCQTKLAQVEQKLQVLDADGTKELNLESDE

SEQ ID NO: 2811 - DNA, 630 bp, Neisseria gonorrhoeae
atgagaaaaaccaaaaccgaagccttgaaaaccaaagaacacctgatgcttgccgccttggaaaccttttaccgcaaagggattgcccgcacctcgctcaacgaaatcgcccaagccgccggcgtaacgcgcggcgcgctctattggcatttcaaaaataaggaagacttgtttgacgcgttgttccaacgtatctgcgacgacatcgaaaactgcatcgcgcaagatgccgcagatgccgaaggaggttcttggacggtattccgccacacgctgctgcactttttcgagcggctgcaaagcaacgacatccactacaaattccacaacatcctgtttttaaagtgcgaacatacggaacaaaacgccgccgttatcgccattgcccgcaagcatcaggcaatctggcgcgagaaaattaccgccgttttgaccgaagcggtggaaaatcaggatttggctgacgatttggacaaggaaacggcggtcatcttcatcaaatcgacgttggacgggctgatttggcgttggttctcttccggcgaaagtttcgatttgggcaaaaccgccccgcgcatcatcgggataatgatggacaacttggaaaaccatccctgcctgcgccggaaa

SEQ ID NO: 2812 - protein, 210 aa, Neisseria gonorrhoeae
MRKTKTEALKTKEHLMLAALETFYRKGIARTSLNEIAQAAGVTRGALYWHFKNKEDLFDALFQRICDDIENCIAQDAADAEGGSWTVFRHTLLHFFERLQSNDIHYKFHNILFLKCEHTEQNAAVIAIARKHQAIWREKITAVLTEAVENQDLADDLDKETAVIFIKSTLDGLIWRWFSSGESFDLGKTAPRIIGIMMDNLENHPCLRRK

SEQ ID NO: 2813 - DNA, 159 bp, Neisseria gonorrhoeae
ttgctgttgttccaaggtccggattcccgcctgcgcgggaatgacgaatccatccgtacggaaacctgcaccacgtcattcctacgaacctacatcccgtcattcccacgaaagtgggaatctagaaataaaaagcagcaggaatttatcggaaataac

SEQ ID NO: 2814 - protein, 53 aa, Neisseria gonorrhoeae
LLLFQGPDSRLRGNDESIRTETCTTSFLRTYIPSFPRKWESRNKKQQEFIGNN

SEQ ID NO: 2815 - DNA, 216 bp, Neisseria gonorrhoeae
gtgcgaggcccaaggcactcacacttatcggtaatctgttttgttaaagagcgttgcgaaattataaagtatcccttccgcctgtctaagatatctctcgatatttccgacattccgtgctatacttttcagttcgtccgccgcttcggcagcggcgaagaaccgaactatacgcttaaagagatttgcggtcaaccgttttttgaaaaaatttta

SEQ ID NO: 2816 - protein, 72 aa, Neisseria gonorrhoeae
VRGPRHSHLSVICFVKERCEIIKYPFRLSKISLDISDIPCYTFQFVRRFGSGEEPNYTLKEICGQPFFEKIL

SEQ ID NO: 2817 - DNA, 357 bp, Neisseria gonorrhoeae
atgccacgcgtaaaacgcggtgttaccgcccgtgcccgtcaccaaaaaatcttcgcgttagccaaaggctatcgtggtcgtcgtaaaaacgtttaccgcgttgccaagcaggcggtaatgaaagctggtcaatacgcataccgtgaccgccgccaacgcaaacgccaattccgtcaattgtggattgttcgtatcaatgcaggtgcgcgtgaaaacgggttgtcttacagcaaatttatgaacggtctgaaacgcgcctctatcgaaatcgaccgcaaagtattggctgatttggccgtgttcgataaagccgcttttgcacaattggttgaaaaagccaaagctgctttggctgct

SEQ ID NO: 2818 - protein, 119 aa, Neisseria gonorrhoeae
MPRVKRGVTARARHQKIFALAKGYRGRRKNVYRVAKQAVMKAGQYAYRDRRQRKRQFRQLWIVRINAGARENGLSYSKFMNGLKRASIEIDRKVLADLAVFDKAAFAQLVEKAKAALAA

SEQ ID NO: 2819 - DNA, 117 bp, Neisseria gonorrhoeae
ttgcggaaattctatgtgattgattttctttctttaaagtctatttttttaaataaatttgcgttaaaatacagaaaatttatccaatggattggccgtgaagaaaataaggtcgtc

SEQ ID NO: 2820 - protein, 39 aa, Neisseria gonorrhoeae
LRKFYVIDFLSLKSIFLNKFALKYRKFIQWIGREENKVV

SEQ ID NO: 2821 - DNA, 1092 bp, Neisseria gonorrhoeae
ttggccgtgaagaaaataaggtcgtctgaagagtctgatatgtcaggctatacaggcggcctcgttgtttcaggtggcatatcattaattgacaggcttgatattatggaaaatgtaaaccgtatcgttgcagaaggcattgccgcagtagaagctgcgcaagacttcaacgctctagaacaaatcaaagcccgttatcttggcaaaaccggcgagttgaccggacttctgaaaactttggggcaaatgtcgcctgaagagcgcaaaaccataggtgcgcatatcaatgaatgcaaaaaccggtttcagacggcttttaatgccaaacgcgatgccctcaacgaagccaagctgcaagcccgacttgccgccgaagccctcgacattaccctgcccggacgcgctcaggaaggcggcagcctgcatcccgtaaccctgaccttgcaacgtgtggtcgaactctttcacggaatgggtttcgaagtggcggacgggcctgaaatcgaagacgattttcacaatttccaagccctgaacatccctgcaaaccatcctgcccgtgcgatgcaggatacgttttacgttgaaaacggcgatgttttgcgtacgcacacttccccgattcaaatccgctatatgctcgataaaaaagagccgcccatccgcattatcgcccccggccgcgtttaccgtgtggacagcgatgccacgcactcgcctatgttccatcaggccgagggtttgtgggtagaagagggcgtaacttttgccgacttaaaagcagtgttcactgactttatccgtcgcttctttgaacgcgatgacctacaagtgcgtttccgtccgtctttcttcccgtttaccgagccttctgccgaaatcgacatcatgggagaaaacggcaaatggttggaagtaggcggttgcggtatggtacatcctaatgtgttgaaaaatgtcaatatcgaccctgaaaaatataccggtttcgctttcggtattggtctcgaccgctttgccatgttgcgctacaacgtcaatgacctgcgcttgttcttcgataacgatttgaacttcttgaagcagtttgaa

SEQ ID NO: 2822 - protein, 364 aa, Neisseria gonorrhoeae
LAVKKIRSSEESDMSGYTGGLVVSGGISLIDRLDIMENVNRIVAEGIAAVEAAQDFNALEQIKARYLGKTGELTGLLKTLGQMSPEERKTIGAHINECKNRFQTAFNAKRDALNEAKLQARLAAEALDITLPGRAQEGGSLHPVTLTLQRVVELFHGMGFEVADGPEIEDDFHNFQALNIPANHPARAMQDTFYVENGDVLRTHTSPIQIRYMLDKKEPPIRIIAPGRVYRVDSDATHSPMFHQAEGLWVEEGVTFADLKAVFTDFIRRFFERDDLQVRFRPSFFPFTEPSAEIDIMGENGKWLEVGGCGMVHPNVLKNVNIDPEKYTGFAFGIGLDRFAMLRYNVNDLRLFFDNDLNFLKQFE

SEQ ID NO: 2823 - DNA, 435 bp, Neisseria gonorrhoeae
ttgaataaatctcaaataaacccaatggataaattaaccccggagcagcgcaaaaaatgtatgcagtccaacaaaagtacagggacgaaacccgagcttgtgttggcgaaggcaatgtgggctttggggctcaggtatcggaaaaatagcggaagcatttttggaaaacctgatttttcatttaaaaaatataaagttgccgtatttgtcgatggggaattctggcacggtaaggattgggaacagaaaaaagcggtaataaagggaaatcgtgagttttggattgccaaaattgagcgcaatatccaaagggatatagaagtaacaggccgtctgaaagccgagggctggacggttttacgtttttggagtaacgatgtcgtcaaaaatacaacctgctgtgccgaaaaagtcaaagaaatcatccaaacaaga

SEQ ID NO: 2824 - protein, 145 aa, Neisseria gonorrhoeae
LNKSQINPMDKLTPEQRKKCMQSNKSTGTKPELVLAKAMWALGLRYRKNSGSIFGKPDFSFKKYKVAVFVDGEFWHGKDWEQKKAVIKGNREFWIAKIERNIQRDIEVTGRLKAEGWTVLRFWSNDVVKNTTCCAEKVKEIIQTR

SEQ ID NO: 2825 - DNA, 375 bp, Neisseria gonorrhoeae
gtgccgaaaaagtcaaagaaatcatccaaacaagatgaattgatttacaaaaacaagattaaggaagatgggcaggatgaacggttaaaagaaaaagcagcacaataccgcctttttgaaaacaacgatacttttcagacggccttgaaacccaaatttacctttatcgacttgttcgcaggtatcgggggcttccgcatcgcgatgcagaacttgggcggggaatacgtgttttcgagcgagtgggacgaaaaagccaaactgacgtacgaagccaatttcggagaagtgccgtttggcgatattactttggaagaaatcaaacaatacattccgaagcaatttgatgtgctgtgtgggtttaccttatcaaaa

SEQ ID NO: 2826 - protein, 125 aa, Neisseria gonorrhoeae
VPKKSKKSSKQDELIYKNKIKEDGQDERLKEKAAQYRLFENNDTFQTALKPKFTFIDLFAGIGGFRIAMQNLGGEYVFSSEWDEKAKLTYEANFGEVPFGDITLEEIKQYIPKQFDVLCGFTLSK

SEQ ID NO: 2827 - DNA, 288 bp, Neisseria gonorrhoeae
atgtgctgtgtgggtttaccttatcaaaataaagattttagaaatatgaggctttctgattatattttgaataataaaataaatataaataatttatctgataaacaggtacaagaaattattgactatttttcttcagaaatagacgactggttattggcaagcgagaaggagttaaaagattatgatgtatacctatacaaattagtactagatggacagcaatatgttcagggaataagaaaatctgtattgtacgatttccttatggaaaatcagaaagatagc

SEQ ID NO: 2828 - protein, 96 aa, Neisseria gonorrhoeae
MCCVGLPYQNKDFRNMRLSDYILNNKININNLSDKQVQEIIDYFSSEIDDWLLASEKELKDYDVYLYKLVLDGQQYVQGIRKSVLYDFLMENQKDS

SEQ ID NO: 2829 - DNA, 747 bp, Neisseria gonorrhoeae
atgaaaaaatggactagagatgaaaccctggttgccctttatctttattacatcattccttttcaaaaggttagtaaggacaatcctgttattcaagaatatgctgaaatactgggcaggacaccgtccgcactcggtatgaagataggaaatttgggtcgtttagatcctacgctgaaagtcaaaaatatttcgggattaagtaatggcagcaaaatggatgttgtcgtatggaatgagttttcaggagattgggagcaacttaataaagaatttgagggagtcatttcccaataccaatcaaatgatgagaatagtaatattgaaatagaatcacctgagattccaaagggaagggaaaggtttgcaagaatatcagtacgcgtcaatcagggctttttccgttccagtgttttggcagcatacaataatcaatgttgtattactggattaaaacaacctgaattgttagttgctagtcatatcaaaccctggggggaagataaggataaccgtttaaacccaaggaatgggctatgtttgaatgcgttacatgacaaagcttttgatagggggttgttaggaatagatgaaaatttcaaaattatattttctccactactggcaaaaacagaaggatttgatgatttatttaaaccatatgaaaatcggatgataagactgcctgaaagactaaacccaagtctggaatttttaaaatttcacagagaaaatatttttcagagt

SEQ ID NO: 2830 - protein, 249 aa, Neisseria gonorrhoeae
MKKWTRDETLVALYLYYIIPFQKVSKDNPVIQEYAEILGRTPSALGMKIGNLGRLDPTLKVKNISGLSNGSKMDVVVWNEFSGDWEQLNKEFEGVISQYQSNDENSNIEIESPEIPKGRERFARISVRVNQGFFRSSVLAAYNNQCCITGLKQPELLVASHIKPWGEDKDNRLNPRNGLCLNALHDKAFDRGLLGIDENFKIIFSPLLAKTEGFDDLFKPYENRMIRLPERLNPSLEFLKFHRENIFQS

SEQ ID NO: 2831 - DNA, 2361 bp, Neisseria gonorrhoeae
atgcaattctcctactcatggctgaaaacccaagccaatcctgatctttctgccgataaactggaacatcttttgaccatggccggtttggaagtggaagaaatcgatactgccgcccctgctttcagtggcgtggttgttgccgaagtaaaatctgttgaaaaacatcctgatgcagaccgtttgaacgttactcaagttgatgccggtacgggcgagttggttcagattgtttgtggtgcgccgaatgtcaagccgggcattaaagtgccgtgttcgttgccggttgccgttttgccgggcaattttaaaattaagccgactaaaatgcgcggcgtaccatcaaacggtatgctgtgttcgaccaatgaactgggtttgcctgatgatggtgtagacggcctgcacattctgcctgaagatgcgcctgtcggtaccaacatccgcgaatacttggatttggacgatatgctgtttacgttgaaaattacgcctaaccgcgctgattgcttgagtgttaagggcattgcgcgtgaggtttctgcgttgactcaatgtgcgtttacgcctgttgaaattcagacggcccctatcggcagtgagaaaaaacaggctgtccgtattgatgcaccggctgactgcggccgttttatcagccgcgttattgaaaatgtcaacgcgaaagcggctactcctgattggatgaaacaacgtttggaacgcagcggtatccgcagcatttccgcattggtggacattggcaactatgtgatgctggaaatcggtcagcctatgcatgttttcgatgctgataagctgtcgggcagtttgattgtccgccgtgctcaaaatggcgagactttggcgtgtctgaatgagaagacggttactttggctgacaatacactggtggtcgctgatgaaaaaggtgcgttgagcttggccggcttgatgggtggcgcggcgagcgcggtttcagacggcacgcaaaatatcgtgctggaagcggcttggtttgagcccgaaatcatcgtcggcaaatcgcgccaatacggtttcggttcggattcgtcgttccgcttcgagcgcggcgtggattaccgtttgcaggcggatgccattgaacgcgccaccgaattggttttgcagatttgcggcggtgcggcaggcgagatggtggaagcacaaggtaaattgcccgaagccaagcaggtcggattgcgtttgggtcgtctgaaaaccgtgttgggcgtggacattcctgccgaacaggtggaaaccattttgcaacacttgggtctgcagcctgagaaaacggcggaaggcttccgcattaccgcgccgagcttccgtttcgacatcgaaattgaggctgatttgattgaagaaatcggacgcgtttacggctatgaaaacatccccgacgattacacgtcaggccgtctgaaaatgtcggaactgcccgaaacacgccgtccgcgttttgccgtttacaacgaaatggcggcgcgcggctaccgcgaagtgatcagctatgccttcgttgacgagcagtgggaactcgattttgccgccaacgccgcccccatccgcctgcaaaacccgctggcggcgcaatatgccgtgatgcgttctacgttgattggcggcttagtggaaattttgcaaaacaacctgaaccgcaagcaaaaccgcgtgcgcgtgtttgaaatcgcctgcgtgttcggcaaaggttcagacggccggtttgtccaaaacgaacgcatcggcggtctgtggtacggcgcggcgatgcccgaacaatggggtgagaaaacgcgcaatgcggatttttacgacatcaaggcggacgtggaaaatctgttgaaaaacaaagcggtcgagttcgttaaaaccggacatcccgccctgcatcccggacgtgccgccaatatcgtttcagacggcaaagtcatcggctttgtcggcgaactgcatccgaaatggctgcaaaaatacgacctgccgcaagcgccgctggtatttgaaatcgatatggcggctgtgttggaatgcgggaaaacgcgctatcgggccgtatcgaaattccagccggtgcgccgcgatttggcgtttgtgatgccggaagttatgaatcatgatgatttactgcttgtcttgaaaggcgcagcaaacaagttggtacaggaaatcagcgtgtttgacgtgtatcgcggcacgggtctgcccgaagggatgaagagcgtggcggttaaagtgattttgcaggatatggaaaacacgctgacggatgaggcggtcgagccgcttattggaaaactgattggcgtggcaacggaggcaggggcgcggcttcgcagt

SEQ ID NO: 2832 - protein, 787 aa, Neisseria gonorrhoeae
MQFSYSWLKTQANPDLSADKLEHLLTMAGLEVEEIDTAAPAFSGVVVAEVKSVEKHPDADRLNVTQVDAGTGELVQIVCGAPNVKPGIKVPCSLPVAVLPGNFKIKPTKMRGVPSNGMLCSTNELGLPDDGVDGLHILPEDAPVGTNIREYLDLDDMLFTLKITPNRADCLSVKGIAREVSALTQCAFTPVEIQTAPIGSEKKQAVRIDAPADCGRFISRVIENVNAKAATPDWMKQRLERSGIRSISALVDIGNYVMLEIGQPMHVFDADKLSGSLIVRRAQNGETLACLNEKTVTLADNTLVVADEKGALSLAGLMGGAASAVSDGTQNIVLEAAWFEPEIIVGKSRQYGFGSDSSFRFERGVDYRLQADAIERATELVLQICGGAAGEMVEAQGKLPEAKQVGLRLGRLKTVLGVDIPAEQVETILQHLGLQPEKTAEGFRITAPSFRFDIEIEADLIEEIGRVYGYENIPDDYTSGRLKMSELPETRRPRFAVYNEMAARGYREVISYAFVDEQWELDFAANAAPIRLQNPLAAQYAVMRSTLIGGLVEILQNNLNRKQNRVRVFEIACVFGKGSDGRFVQNERIGGLWYGAAMPEQWGEKTRNADFYDIKADVENLLKNKAVEFVKTGHPALHPGRAANIVSDGKVIGFVGELHPKWLQKYDLPQAPLVFEIDMAAVLECGKTRYRAVSKFQPVRRDLAFVMPEVMNHDDLLLVLKGAANKLVQEISVFDVYRGTGLPEGMKSVAVKVILQDMENTLTDEAVEPLIGKLIGVATEAGARLRS

SEQ ID NO: 2833 - DNA, 288 bp, Neisseria gonorrhoeae
atgccattactttccggcctgattccacttttaggcatacttctgaaaatgctgattgtcagaatcatccttgcaacaggtctgacattcgtaacctatgccgggtatctcgccgcactggaaaagttcaaaggctacacggcaaatgcgatcaattccatgccttccgacatattgaaccttcttttaatttcgggattcggtcaggggttgggctgcctgttcggcgcattctcgttcttcattggtatgcacgcattcaaaaaactgacgtttgtctttccggga

SEQ ID NO: 2834 - protein, 96 aa, Neisseria gonorrhoeae
MPLLSGLIPLLGILLKMLIVRIILATGLTFVTYAGYLAALEKFKGYTANAINSMPSDILNLLLISGFGQGLGCLFGAFSFFIGMHAFKKLTFVFPG

SEQ ID NO: 2835 - DNA, 300 bp, Neisseria gonorrhoeae
atgacactaactaaagcagaactggccgatattttggtggataaagtcagcaacgtcaccaaaaacgatgccaaagaaattgtcgaactcttttttgaagaaatccgcagcactttggcaagcggcgaagaaatcaaaatttccggtttcggaaatttccagttgcgcgacaagccgcaacgcccgggccgtaatccgaaaaccggcgaggaagtgccgattaccgcccgccgcgtggtaactttccatgccagccagaaactcaaaggcatggtggaacactactatgacaaacaacgt

SEQ ID NO: 2836 - protein, 100 aa, Neisseria gonorrhoeae
MTLTKAELADILVDKVSNVTKNDAKEIVELFFEEIRSTLASGEEIKISGFGNFQLRDKPQRPGRNPKTGEEVPITARRVVTFHASQKLKGMVEHYYDKQR

SEQ ID NO: 2837 - DNA, 306 bp, Neisseria gonorrhoeae
atgacaaacaacgttgatttgacgattcctgcaaaacgctatttcacgctggacgagttgtgcggactgttgcaaatcagcccctatggttttgcgcaatggcaacatgatcacggtgtggttgtcggttacggcggagaacgctacacccgtttggatgtggtgaaactgttgaaactgaagagcacgtttgcaccgtatgcagaaggtgcggaatcgggttcggacggcaaccgtccggttacgcttcaggaaatcggagacggtctgaaagacctgttggaggatttggataaggagttgtgc

SEQ ID NO: 2838 - protein, 102 aa, Neisseria gonorrhoeae
MTNNVDLTIPAKRYFTLDELCGLLQISPYGFAQWQHDHGVVVGYGGERYTRLDVVKLLKLKSTFAPYAEGAESGSDGNRPVTLQEIGDGLKDLLEDLDKELC

SEQ ID NO: 2839 - DNA, 120 bp, Neisseria gonorrhoeae
ttgcgtgatttcacattgtttcggcttgaagcacatggttttgtaatcatttacaggcagctcgcttggaatcctgttcgggcggtttgctgtttacttaaatataaggatgacggtcaa

SEQ ID NO: 2840 - protein, 40 aa, Neisseria gonorrhoeae
LRDFTLFRLEAHGFVIIYRQLAWNPVRAVCCLLKYKDDGQ

SEQ ID NO: 2841 - DNA, 483 bp, Neisseria gonorrhoeae
atgagatttttcggtatcggttttttggtgctgctgtttttggaaattatgtcgattgtgtgggttgccgattggctgggcggcggttggacgctgtttctaatggcggcaacctttgccgccggtgtgctgatgctcaggcatacggggctgtccggtcttttattggctggcgcggcggtaaaaagtagtgggaaggtatctgtttatcagatgttgtggcctatccgttatacggtggcggcggtgtgtctgatgagtccgggattcgtatcctcggtgttggcggtattgctgctgctgccgtttaagggaggggcagtgttgcaggcaggaggtgcggaaaattttttcaacatgaaccaatcgggcagaaaagagggatttttccacgatgacgatattatcgagggagaatatacggttgaagagccttacggcggcaatcgttcccgaaacgccatcgaacacaaaaaagacgaa

SEQ ID NO: 2842 - protein, 161 aa, Neisseria gonorrhoeae
MRFFGIGFLVLLFLEIMSIVWVADWLGGGWTLFLMAATFAAGVLMLRHTGLSGLLLAGAAVKSSGKVSVYQMLWPIRYTVAAVCLMSPGFVSSVLAVLLLLPFKGGAVLQAGGAENFFNMNQSGRKEGFFHDDDIIEGEYTVEEPYGGNRSRNAIEHKKDE

SEQ ID NO: 2843 - DNA, 222 bp, Neisseria gonorrhoeae
atgagtgtttgggatatatgggacaggatggtggaaatctatcataagtataagaagccgtgcctggttttagcagtggattttgtgatgggtatggtattcatagagccgaatgaggagccgtgcatcggcagatgctatgcgcctatgccggagtcccctgattttgccaacgctgttgcgatggctgttgctatgatctgtatcgtatttatctatgat

SEQ ID NO: 2844 - protein, 74 aa, Neisseria gonorrhoeae
MSVWDIWDRMVEIYHKYKKPCLVLAVDFVMGMVFIEPNEEPCIGRCYAPMPESPDFANAVAMAVAMICIVFIYD

SEQ ID NO: 2845 - DNA, 297 bp, Neisseria gonorrhoeae
ttgattgaagcgttgggcggaggctgtgtgaaacggtattgggcgttgggtcgtctgattccaatcaggcttgaggaatgcgaaacggtgtgcgcttatgttgcggacgatttgtttcgcggtttttcgcccgaaacggatggaaaggtgtgggaagcggtctgtcggagtagaatacgctttttgcgtttgaatgcagtaataagaaaagagagaaacttatgccgtctgaacatcaacacacatcatcattacttaatttcgaccgtacccatctgctccatccctatacttcca

SEQ ID NO: 2846 - protein, 99 aa, Neisseria gonorrhoeae
LIEALGGGCVKRYWALGRLIPIRLEECETVCAYVADDLFRGFSPETDGKVWEAVCRSRIRFLRLNAVIRKERNLCRLNINTHHHYLISTVPICSIPILP

SEQ ID NO: 2847 - DNA, 1224 bp, Neisseria gonorrhoeae
atgaccgatccgcttcccgtttatcctgtcaaacgtgcagaaggggtgtttatcgaattggcggacggcacgcggctgattgacgggatgtcgtcttggtggtgtgcgatacacggttacaatcatcccgttttgaatcaggcggttgagaatcagatgaaacaaatggcgcacgtgatgttcggcggcctgacgcacgagccggcggtggagctgggcaagttgttggtcgggattttgccgcaggggctggaccgtattttttatgcggattcgggttcggtttcggtagaagtcgcgttgaaaatggcggtgcaataccagcaggcgcggggtctgacggcgaagcagaatattgcgacggtacggcgcgggtatcacggcgatacttggaacgcgatgtccgtttgtgatccggaaacggggatgcaccatattttcggcagcgcgttgccgcagcgttattttgtcgataatccgaaaaaccgtttcgacgatgaatgggacggggcggatttgcagcctgtccgcgccttgtttgaagcgcatcatgtggatattgccgcctttattttagaaccggtcgtgcaaggcgcgggcggcatgtatttttatcatccgcagtatcttcgcggcttgcgcgatttgtgcgacgaatttgatatcgtgttgatttttgacgaaatcgccaccggattcgggcgcacgggcaagatgtttgcctgcgaacacgcggaggtcgtgccggatattatgtgtatcggcaagggtttgagcggcggctatatgacgctggcggcggcaatcacttcgcaaaaagttaccgaaacgatttcacgcggcgaagcgggcgtgtttatgcacggcccgacatttatggcgaacccgctggcgtgtgccgttgcctgtgcttcggtcaagctgcttttatcccaagactggcaggcaaatatccgccgtatcgaaagcatcttaaaaggccgtctgaaagccgcgtgggacattcgcggcgtgaaagacgtgcgcgttttgggtgctatcggcgtgatagagttggaaaaaggcgtggatatggcgcgttttcaagcggattgtgtggcgcagggcatttgggtacgcccgttcggcaggctggtgtatctgatgccgccctatatcatttcagacggcattttgaccaaacttgccgataaaaccgtgcaaatcttgaaggaacacagcaaa

SEQ ID NO: 2848 - protein, 408 aa, Neisseria gonorrhoeae
MTDPLPVYPVKRAEGVFIELADGTRLIDGMSSWWCAIHGYNHPVLNQAVENQMKQMAHVMFGGLTHEPAVELGKLLVGILPQGLDRIFYADSGSVSVEVALKMAVQYQQARGLTAKQNIATVRRGYHGDTWNAMSVCDPETGMHHIFGSALPQRYFVDNPKNRFDDEWDGADLQPVRALFEAHHVDIAAFILEPVVQGAGGMYFYHPQYLRGLRDLCDEFDIVLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELEKGVDMARFQADCVAQGIWVRPFGRLVYLMPPYIISDGILTKLADKTVQILKEHSK

SEQ ID NO: 2849 - DNA, 894 bp, Neisseria gonorrhoeae
ttgaatccgacgaatgatttgaaagcgtggcaacagagggcgcaggcgcagacagagctgctgctggaacgctttttgccgtctggaaacgaaatcccgcacacgctgcacgaagcgatgcgctatgcggctttggacggcggcaagcgtctgcgcccgatgctggtgctggcggcttcggaattgggcggggccatggcggatgcggtcggacaggcaatggcggcaatcgaaatgatccacgtctattctttggttcacgacgatatgccggcgatggacaacgacagcctgcggcgcggcaaaccgacctgccacatcaaatatggcgaagccaccgcccttctgaccggcgacgctttacaaacccaagccttcgacgtgttgagccgtccgacagaactgcccgccgcacgccagttggcaatgttgtcggtgttggcaaaagcgggcggcagcgcgggtatggcgggcggacaggcaatcgatttggcaaatgtcggcaaacaaatggttcaagccgatttggaacggatgcacagcctgaaaacgggggcgttgatccgtgcggcggttttattgggggcgacggcgtgtcccgatctgtccgacgcggaacttgccgtattggacgcttacgcggcaaaactgggtttggcgttccaagtcatcgacgatgtgttggattgtgaagcggacacggcgactttgggcaagacggcgggcaaagatgccgacaacgacaagccgacttatgtgaaactgatgggcttggaagcggcgcgctcatacgcacacaaactggttgccgaagcagtcgcgctgctcgaacccttcggcgacaaagccctgcgcctgcggcagttggcagaatttgcagtcgcacgcaaatat

SEQ ID NO: 2850 - protein, 298 aa, Neisseria gonorrhoeae
LNPTNDLKAWQQRAQAQTELLLERFLPSGNEIPHTLHEAMRYAALDGGKRLRPMLVLAASELGGAMADAVGQAMAAIEMIHVYSLVHDDMPAMDNDSLRRGKPTCHIKYGEATALLTGDALQTQAFDVLSRPTELPAARQLAMLSVLAKAGGSAGMAGGQAIDLANVGKQMVQADLERMHSLKTGALIRAAVLLGATACPDLSDAELAVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 2851 - DNA, 297 bp, Neisseria gonorrhoeae
ttgtttgcaagaatgccggagaaaaatgcagtttacattcgaatggtattgttattaattgtaaataaatattggaaggtaaatgatatgaaaaatgaaattcaaaaaatcatggataaatatgatccatggcatgaagatgattttaagtcgtatgaagacattgccaaagatgtatcgttgatgacagataaaacgttcattgaacattatttgttagaagtttattcagaagaaaacggacattttgaccaagacaatgttcatgcgatgataggggaaattaaaaatgcaatt

SEQ ID NO: 2852 - protein, 99 aa, Neisseria gonorrhoeae
LFARMPEKNAVYIRMVLLLIVNKYWKVNDMKNEIQKIMDKYDPWHEDDFKSYEDIAKDVSLMTDKTFIEHYLLEVYSEENGHFDQDNVHAMIGEIKNAI

SEQ ID NO: 2853 - DNA, 645 bp, Neisseria gonorrhoeae
atgaaaggcgtttacttcgtcagcggtatagacacggacatcggcaaaaccgtcgccaccggtatgttggcaaaacaattgttgcagcagggcaaaagcgtgattacgcaaaagcccgtgcaaaccggttgccaagacatcgccgaagacatcgccgtccaccgtaaaatcatgggcatacccatgcaggaagctgatgaacagcgtctgactatgcctgaaatcttcagccatcccgcctcgccccaccttgccgcccgactggacggcaggggtttggacttggacaaaatccgcaccgccacacaagaattggcggcgcagtacgaagtcgttttggtcgaaggcgcgggcgggttgatggtaccactgacggaaaagctgttaaccattgatcatattcagcaacaggcttatcccgtcatccttgttaccagcggacggctgggaagcattaatcacaccctgctcagtttcgtcgtgctcaaacaatacggcattcgcctgcacagcctcgtgtttaaccacatccacgacagccgcgacgcacacgtcgcccaagacagcctgaactatctgcaatgccgtctgaaagccgattttcccgaagcggaatggatggagttggcaaaaacaggcgcggta

SEQ ID NO: 2854 - protein, 215 aa, Neisseria gonorrhoeae
MKGVYFVSGIDTDIGKTVATGMLAKQLLQQGKSVITQKPVQTGCQDIAEDIAVHRKIMGIPMQEADEQRLTMPEIFSHPASPHLAARLDGRGLDLDKIRTATQELAAQYEVVLVEGAGGLMVPLTEKLLTIDHIQQQAYPVILVTSGRLGSINHTLLSFVVLKQYGIRLHSLVFNHIHDSRDAHVAQDSLNYLQCRLKADFPEAEWMELAKTGAV

SEQ ID NO: 2855 - DNA, 522 bp, Neisseria gonorrhoeae
atggatggagttggcaaaaacaggcgcggtataaagattgggaaagatatggaacacctatttgggaaatggctgcccgacttgcccgcccccgtttcagacggcatcgacctgccgatgagccggttattgaaagcccggtcgctgaccgccgcattgtgcgccttgccgcatacattttcggtggaactgctgaaactgggcgaagcggaaacggaatacggacggcggagggtgcgcgatgtgcttctgaaactggacggcactgctgttgtgcaggcacgaagcgcgtgcagcgtcggttcggcgttttggcaaaacattttggactgcggcacacgccctttgggcgagcgtctgtttcaagccgatttggaaggggcgcgttcggcgtttgagtttgccgtttccagtgaaggatgcggacggtactttgccgcgcggcgttctcggttttcccatcaaggcgaggaaatgctgctgaccgagtattttctgcccgaactgaaacgctttatcgga

SEQ ID NO: 2856 - protein, 174 aa, Neisseria gonorrhoeae
MDGVGKNRRGIKIGKDMEHLFGKWLPDLPAPVSDGIDLPMSRLLKARSLTAALCALPHTFSVELLKLGEAETEYGRRRVRDVLLKLDGTAVVQARSACSVGSAFWQNILDCGTRPLGERLFQADLEGARSAFEFAVSSEGCGRYFAARRSRFSHQGEEMLLTEYFLPELKRFIG

SEQ ID NO: 2857 - DNA, 405 bp, Neisseria gonorrhoeae
atgaatataatagaaataataagtaggaatcgttttctaaaacaaatatatcctagtggcataatggatatttcactagtctctttttcaactgacttgtctaattgtattttaactatccgaacaagtacaaagccttctgtagaaatcgaaaaatgggggctgtggctaaaagattatgatacagttgaaattgaattaagaaatagctttattaaaggaatgaaatgtcaaaattggtcgcataacaatagaaatatatgccaagtagaaataaagaaccaagaagatggtctaaaaataataagattttacgacaataattcaaattggttattggaactagaagtttatggattagttttccaagggtgtaagacttatatgaaagagggttatgaatct

SEQ ID NO: 2858 - protein, 135 aa, Neisseria gonorrhoeae
MNIIEIISRNRFLKQIYPSGIMDISLVSFSTDLSNCILTIRTSTKPSVEIEKWGLWLKDYDTVEIELRNSFIKGMKCQNWSHNNRNICQVEIKNQEDGLKIIRFYDNNSNWLLELEVYGLVFQGCKTYMKEGYES

SEQ ID NO: 2859 - DNA, 888 bp, Neisseria gonorrhoeae
atgaatcttaaatcccctttatttttacgactgtccgatcgtttggacgtttatatcagactgatgagggcggacaagcccattgggacgctgcttttactgtggccgacctactgggcattgtggctggcttcagacggcattcccgatttggcggtattggcggcgtttacaatcggcacgtttttaatgcgcagtgccggctgcgtcatcaacgactttgccgaccgcgattttgacggtgctgtcgagcgcaccaaaaaccgtccgttcgcacagggcagggtcaagaaaaaagaagccctgctgctgacggcatttttgtgtctgcttgccgcattgtgcctgattccgctgaatcatctgacatggctgatgagcctgcccgcgctgttccttgcgctgacttacccgtttaccaaacgcttttttccgattccccaattttatctgggatttgccttttccttcggcatcccgatggcgtttgccgcagtgggcaacagcgttcccgttgaagcgtggatactctttgccgccaatgttttatggacactggcttacgataccgtctatgcaatggcggacaaagaggacgatttgaaaatcggcatcaaaacctccgccgtcacgttcgggcgttacgacatcgccgccgttatgctgtgtcatggcggctttaccctgctgatggcagtattgggtgcggttatcggtgcggcatgggcatattggacggcaatccccatcgtcctgctgctgcaataccgccaatatgccgcaatcaaaagccgcgtccggcaaatctgttttgaaacgtttttggcaaacaacagaatcggttgggtgtggtttgccgctatttttgcccatacgtttttcgcgaaa

SEQ ID NO: 2860 - protein, 296 aa, Neisseria gonorrhoeae
MNLKSPLFLRLSDRLDVYIRLMRADKPIGTLLLLWPTYWALWLASDGIPDLAVLAAFTIGTFLMRSAGCVINDFADRDFDGAVERTKNRPFAQGRVKKKEALLLTAFLCLLAALCLIPLNHLTWLMSLPALFLALTYPFTKRFFPIPQFYLGFAFSFGIPMAFAAVGNSVPVEAWILFAANVLWTLAYDTVYAMADKEDDLKIGIKTSAVTFGRYDIAAVMLCHGGFTLLMAVLGAVIGAAWAYWTAIPIVLLLQYRQYAAIKSRVRQICFETFLANNRIGWVWFAAIFAHTFFAK

SEQ ID NO: 2861 - DNA, 447 bp, Neisseria gonorrhoeae
atgagccttatcggcgaaattttgcctttgtcccatattgttttggatatggaggtgggcagtaaaaaaaggctgtttgaggaagcgggcctgcttttggaacgcgaatcctcattgtcccatgctgatgttttcgaatgtctttttgcccgtgaaaaactgggttcgaccggtttggggcagggtgtcgccatcccccacggccgccacgcgagcgtgaagcaggcgacgggcgcgttcatccgtacgcgcgaacccgtcggattcgacgcgcctgacggcaaaccggtttcactggtttttatcttgctggtgccggaaaacgcaacgggcgagcatttggaagtcttatccaaactggccggcaagttttcccaaaaaagcatcagagaatcgctgatgacggttgcttctgcggaagaagcccgcgccatcctgaccgaagaa

SEQ ID NO: 2862 - protein, 149 aa, Neisseria gonorrhoeae
MSLIGEILPLSHIVLDMEVGSKKRLFEEAGLLLERESSLSHADVFECLFAREKLGSTGLGQGVAIPHGRHASVKQATGAFIRTREPVGFDAPDGKPVSLVFILLVPENATGEHLEVLSKLAGKFSQKSIRESLMTVASAEEARAILTEE

SEQ ID NO: 2863 - DNA, 468 bp, Neisseria gonorrhoeae
atgcttttttgggaaaacttgccggccagtttggataagacttccaaatgctcgcccgttgcgttttccggcaccagcaagataaaaaccagtgaaaccggtttgccgtcaggcgcgtcgaatccgacgggttcgcgcgtacggatgaacgcgcccgtcgcctgcttcacgctcgcgtggcggccgtgggggatggcgacaccctgccccaaaccggtcgaacccagtttttcacgggcaaaaagacattcgaaaacatcagcatgggacaatgaggattcgcgttccaaaagcaggcccgcttcctcaaacagcctttttttactgcccacctccatatccaaaacaatatgggacaaaggcaaaatttcgccgataaggctcataagcttctcttttcagacatcgcaaaacagaaggattgtaccgactgccggggcaaacctcaatcccgcatacggtacgggc

SEQ ID NO: 2864 - protein, 156 aa, Neisseria gonorrhoeae
MLFWENLPASLDKTSKCSPVAFSGTSKIKTSETGLPSGASNPTGSRVRMNAPVACFTLAWRPWGMATPCPKPVEPSFSRAKRHSKTSAWDNEDSRSKSRPASSNSLFLLPTSISKTIWDKGKISPIRLISFSFQTSQNRRIVPTAGANLNPAYGTG

SEQ ID NO: 2865 - DNA, 93 bp, Neisseria gonorrhoeae
ttgcttgtttattccctgttgcgcgtgtgccaaaaataccgccgcacgaaacacgggaaggcgaaaatgaggtacaggcagacgacggtggcg

SEQ ID NO: 2866 - protein, 31 aa, Neisseria gonorrhoeae
LLVYSLLRVCQKYRRTKHGKAKMRYRQTTVA

SEQ ID NO: 2867 - DNA, 1599 bp, Neisseria gonorrhoeae
atgcactcaatatatttttttaaggagaagcagatgagtcaaaccgacgcgcgtcgtagcggacgatttttacgcacagtcgaatggctgggcaatatgttgccgcacccggttacgctttttattattttcattgtgttattgctgattgcctctgccgtcggtgcgtatttcggactatccgtccccgatccgcgtcctgttggggcgaaaggacgtgccgatgacggtttgattcacgttgtcagcctgctcgatgccgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatccccacgcaaactcactacttttatggttgtttttacagggattttatccaatacggcttctgaattgggctatgtcgtcctaatccctttgtccgccgtcatctttcattcgctcggccgccatccgcttgccggtttggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggcagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggcaggcgtggtgtttgttgccttatccgccctattggcttggagcatcgtccctgccgacggtattttgcgtcatcctgaaacaggattggttgccggttcgccgtttttaaaatcgattgttgtttttattttcttgttgtttgcgctgccgggcattgtttatggccggataacccgaagtttgcgcggcgaacgggaagtcgttaatgcgatggccgaatcgatgagtactttgggactttatttggtcatcatcttttttgccgcacagtttgtcgcattttttaattggacgaatattgggcaatatattgccgttaaaggggcggtgttcttaaaagaagtcggcttgggcggcagtgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtaatcaaatacaaaaaagatgcgggcgtaggcacgctgatttctatgatgttgccgtattccgctttcttcttaattgcatggatcgccttattctgcatttgggtatttgttttgggtctgcccgtcggtcccggcacacccacattctatccggtgcct

SEQ ID NO: 2868 - protein, 533 aa, Neisseria gonorrhoeae
MHSIYFFKEKQMSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 2869 - DNA, 960 bp, Neisseria gonorrhoeae
atgcccagtatctccgtccgccgcctgtttgacgacaaccaatacaagttgcaacttgcctgggccgccggcaattcgggtgcggacaaccgtatcggcgtagaggcggacaagcccgtcctcgccctggtcggacacctgaatttcatccatcccaaccaaatccaagtggtcggtttggcggagtcggaatatctgaaccgcctcgaatcgggggagacgggttatcagttcggagacctgttcgatatttccatgtctttggtcattgtggcaaacgatttgccggtttccccggggctgcgcgactactgccacaaaaacgacatccccctgttgacttccaaactcgaaagcccttatctgatggatgtgttgcggatttacctgcaacgcaccttggcagcatcgtccgtcaaacacggcgtatttctcgatgtgtttgaaatcggcgtgctgattaccggacattctggtttgggtaagagcgaattggcattggaactgatttcgcgcggccatagcctgattgccgacgatgcggtcgagctgttccgcatcggtccggaaacattggaagggcgttgttcgcctatgctgcgcgattttttggaagtgcgcggcttggggatactcaatatccgccatattttcggcgaaacttccatccgccccaaaaaaatcctgcaactcattatcaatttggtcgaggcggacgacgagtatatgaagcagctcgaccggttgagcatccgcaccgaaaccgaatccatcctcaacgtcaacgtccgttcggttacgctgcccgtcgccgtcggacgcaaccttgccgttttggttgaggcggcggtacgcaattacattttgcagttgcgcggcaaagacagtacgcgcgaatttttggaacgccatcagacgcaacttaaagaaaacgaacagaatcatgaaaatcgtcctgat

SEQ ID NO: 2870 - protein, 320 aa, Neisseria gonorrhoeae
MPSISVRRLFDDNQYKLQLAWAAGNSGADNRIGVEADKPVLALVGHLNFIHPNQIQVVGLAESEYLNRLESGETGYQFGDLFDISMSLVIVANDLPVSPGLRDYCHKNDIPLLTSKLESPYLMDVLRIYLQRTLAASSVKHGVFLDVFEIGVLITGHSGLGKSELALELISRGHSLIADDAVELFRIGPETLEGRCSPMLRDFLEVRGLGILNIRHIFGETSIRPKKILQLIINLVEADDEYMKQLDRLSIRTETESILNVNVRSVTLPVAVGRNLAVLVEAAVRNYILQLRGKDSTREFLERHQTQLKENEQNHENRPD

SEQ ID NO: 2871 - DNA, 1086 bp, Neisseria gonorrhoeae
ttgcccgagccggaaagcccgctaatcaggacgattttcatgattctgttcgttttctttaagttgcgtctgatggcgttccaaaaattcgcgcgtactgtctttgccgcgcaactgcaaaatgtaattgcgtaccgccgcctcaaccaaaacggcaaggttgcgtccgacggcgacgggcagcgtaaccgaacggacgttgacgttgaggatggattcggtttcggtgcggatgctcaaccggtcgagctgcttcatatactcgtcgtccgcctcgaccaaattgataatgagttgcaggatttttttggggcggatggaagtttcgccgaaaatatggcggatattgagtatccccaagccgcgcacttccaaaaaatcgcgcagcataggcgaacaacgcccttccaatgtttccggaccgatgcggaacagctcgaccgcatcgtcggcaatcaggctatggccgcgcgaaatcagttccaatgccaattcgctcttacccaaaccagaatgtccggtaatcagcacgccgatttcaaacacatcgagaaatacgccgtgtttgacggacgatgctgccaaggtgcgttgcaggtaaatccgcaacacatccatcagataagggctttcgagtttggaagtcaacagggggatgtcgtttttgtggcagtagtcgcgcagccccggggaaaccggcaaatcgtttgccacaatgaccaaagacatggaaatatcgaacaggtctccgaactgataacccgtctcccccgattcgaggcggttcagatattccgactccgccaaaccgaccacttggatttggttgggatggatgaaattcaggtgtccgaccagggcgaggacgggcttgtccgcctctacgccgatacggttgtccgcacccgaattgccggcggcccaggcaagttgcaacttgtattggttgtcgtcaaacaggcggcggacggagatactgggcatattttattcttcggtcaggatggcgcgggcttcttccgcagaagcaaccgtcatcagcgattctctgatgcttttttgggaaaacttgccggccagtttgga

SEQ ID NO: 2872 - protein, 362 aa, Neisseria gonorrhoeae
LPEPESPLIRTIFMILFVFFKLRLMAFQKFARTVFAAQLQNVIAYRRLNQNGKVASDGDGQRNRTDVDVEDGFGFGADAQPVELLHILVVRLDQIDNELQDFFGADGSFAENMADIEYPQAAHFQKIAQHRRTTPFQCFRTDAEQLDRIVGNQAMAARNQFQCQFALTQTRMSGNQHADFKHIEKYAVFDGRCCQGALQVNPQHIHQIRAFEFGSQQGDVVFVAVVAQPRGNRQIVCHNDQRHGNIEQVSELITRLPRFEAVQIFRLRQTDHLDLVGMDEIQVSDQGEDGLVRLYADTVVRTRIAGGPGKLQLVLVVVKQAADGDTGHILFFGQDGAGFFRRSNRHQRFSDAFLGKLAGQFG

SEQ ID NO: 2873 - DNA, 852 bp, Neisseria gonorrhoeae
atgaaaatcgtcctgattagcgggctttccggctcgggcaaatccgttgcactgcgccaaatggaagatttgggctatttttgcgtggacaacctgcccttggaaatgctgccgtcgctggtgtcgtaccatatcgaacgtgcggacgaaaccgaattggcggtcagcgtcgatgtgcgttccggcatagacattgcccaagcgcgcgagcagattgcctatctgcgcggactcggacacagggtggaagttttgtttgtcgaggcggaagaggccgtgctggtccgccgcttttccgaaacccggcgcggacatcctttgagcaatcaggatatgacgctgttggaaagcctgaaaaaagagcgcgaatggctgttcccgcttaaggaaatcgcctactgtatcgacacttccaagatgaatgcccaacagctccgccatgcagtccggcagtggctgaaggttgagcgtaccggactgctggtggttttggagtccttcgggttcaaatacggtgtgccgaacaacgccgattttatgttcgatatgcgcagtctgcccaacccgtattacgatcccgagttgaggccttacaccggtatggacaagcccgtttgggattatttggacggacagccgttggcgcaggaaatggttgacggcatcgaaaggtttgttacgcgttggttgccgcgtttggaggatgaaagcaggagctacgttaccgtcgccatcggctgtaccggcgggcagcatcgttcggtctatattgtcgaaaaactcgcccgaaggttgaaagggcgttatgaattgctgatacggcacaggcaggcgcaaaacctgtcgggccgc

SEQ ID NO: 2874 - protein, 284 aa, Neisseria gonorrhoeae
MKIVLISGLSGSGKSVALRQMEDLGYFCVDNLPLEMLPSLVSYHIERADETELAVSVDVRSGIDIAQAREQIAYLRGLGHRVEVLFVEAEEAVLVRRFSETRRGHPLSNQDMTLLESLKKEREWLFPLKEIAYCIDTSKMNAQQLRHAVRQWLKVERTGLLVVLESFGFKYGVPNNADFMFDMRSLPNPYYDPELRPYTGMDKPVWDYLDGQPLAQEMVDGIERFVTRWLPRLEDESRSYVTVAIGCTGGQHRSVYIVEKLARRLKGRYELLIRHRQAQNLSGR

SEQ ID NO: 2875 - DNA, 882 bp, Neisseria gonorrhoeae
ttgacgggattagcggcccgacaggttttgcgcctgcctgtgccgtatcagcaattcataacgccctttcaaccttcgggcgagtttttcgacaatatagaccgaacgatgctgcccgccggtacagccgatggcgacggtaacgtagctcctgctttcatcctccaaacgcggcaaccaacgcgtaacaaacctttcgatgccgtcaaccatttcctgcgccaacggctgtccgtccaaataatcccaaacgggcttgtccataccggtgtaaggcctcaactcgggatcgtaatacgggttgggcagactgcgcatatcgaacataaaatcggcgttgttcggcacaccgtatttgaacccgaaggactccaaaaccaccagcagtccggtacgctcaaccttcagccactgccggactgcatggcggagctgttgggcattcatcttggaagtgtcgatacagtaggcgatttccttaagcgggaacagccattcgcgctcttttttcaggctttccaacagcgtcatatcctgattgctcaaaggatgtccgcgccgggtttcggaaaagcggcggaccagcacggcctcttccgcctcgacaaacaaaacttccaccctgtgtccgagtccgcgcagataggcaatctgctcgcgcgcttgggcaatgtctatgccggaacgcacatcgacgctgaccgccaattcggtttcgtccgcacgttcgatatggtacgacaccagcgacggcagcatttccaagggcaggttgtccacgcaaaaatagcccaaatcttccatttggcgcagtgcaacggatttgcccgagccggaaagcccgctaatcaggacgattttcatgattctgttcgttttctt

SEQ ID NO: 2876 - protein, 294 aa, Neisseria gonorrhoeae
LTGLAARQVLRLPVPYQQFITPFQPSGEFFDNIDRTMLPAGTADGDGNVAPAFILQTRQPTRNKPFDAVNHFLRQRLSVQIIPNGLVHTGVRPQLGIVIRVGQTAHIEHKIGVVRHTVFEPEGLQNHQQSGTLNLQPLPDCMAELLGIHLGSVDTVGDFLKREQPFALFFQAFQQRHILIAQRMSAPGFGKAADQHGLFRLDKQNFHPVSESAQIGNLLARLGNVYAGTHIDADRQFGFVRTFDMVRHQRRQHFQGQVVHAKIAQIFHLAQCNGFARAGKPANQDDFHDSVRFL

SEQ ID NO: 2877 - DNA, 93 bp, Neisseria gonorrhoeae
atgccgtctgaaaccccgtccgccgtttcagacggcatttcaaatattgagaagaaagaacagacatggcaatccaatggtttcccggccata

SEQ ID NO: 2878 - protein, 31 aa, Neisseria gonorrhoeae
MPSETPSAVSDGISNIEKKEQTWQSNGFPAI

SEQ ID NO: 2879 - DNA, 939 bp, Neisseria gonorrhoeae
atggcaatccaatggtttcccggccatatgaacaaggcaagaaaagccatcgccgagcgtgccaaaagcgttgatatggtgattgaaatgctggacgcgcgtatgcccgcctccagcgaaaatccactgttggcgcagctttccaaaggtaagcccaaactcaaaattttaaacaagcaagaccttgccgaccctgaacgcacaaaggtctggcttgaccactacaacagccgccccgacacccgggccatcgccctcgattcctccgaaaccggcgcacacggcaaaatcacccaagcctgccgcgcgatgattccccaccggcaaggcatagacaaacccctgcgcgttttgatttgcggcattcccaacgtcggcaaatccaccctcatcaatggaatgataggcaaaaaatccgccaaaaccggcaacgaacccggcattaccaaagccgaacaacgccttttccttgccgacgacttctggctgtacgacaccccgggaatgctgtggccgaaaatcatcgtcgaagaaagcggctacaacctcgccgccggcggcgcagtcggacgcaacgcattggacgaagaagaagtcgccctcgaacttttagactacctccgccgccactacctccctatgctgcaagaacgctaccaagccgacaaagaccccagcagccactgggacgacaactcgtggctcgaatggatagccaaaaaacgcggcgcagtcctcagcggcggacgggtcaactaccaaaaagccgccgaaaacatcctcacggacttccgcgaaggcaaaatcggcagaatcacccttgaaacaccgaaccaatgggaaacttggcttaaaaaagcacgtcagaaagaagccgaactcaaagccattcgcgaagccagaaaagcagagcgcaaagggcagaagccttcggaagca

SEQ ID NO: 2880 - protein, 313 aa, Neisseria gonorrhoeae
MAIQWFPGHMNKARKAIAERAKSVDMVIEMLDARMPASSENPLLAQLSKGKPKLKILNKQDLADPERTKVWLDHYNSRPDTRAIALDSSETGAHGKITQACRAMIPHRQGIDKPLRVLICGIPNVGKSTLINGMIGKKSAKTGNEPGITKAEQRLFLADDFWLYDTPGMLWPKIIVEESGYNLAAGGAVGRNALDEEEVALELLDYLRRHYLPMLQERYQADKDPSSHWDDNSWLEWIAKKRGAVLSGGRVNYQKAAENILTDFREGKIGRITLETPNQWETWLKKARQKEAELKAIREARKAERKGQKPSEA

SEQ ID NO: 2881 - DNA, 600 bp, Neisseria gonorrhoeae
atgaccgacaaaatttctcccgacgcgctgattgaagccgcactgctgacccaaaccgaaccgctgaccgaaaaatctatgcgcgaactgtgtgtgccgccgttgtcgcaagacaaactgattgatgtgttggcgcagttgaaaacgcgttggcaggatagggcgttgcaactggtgcatacgcaggagggctggcgttttcagattgttcagacggcattcgagcggctgggcagcctgcaagaacagcgtgcgccgcgctactcccgcgccgtgatggaaacactggcgattatcgcctaccagcagcccgtaacgcgcggcgacatcgaaggtatacgcggcgtggcggtgtcgcagaacgtgatgcagaccttgcaggatcgggggtggattgaagtcatcggacatcgggacacattgggaaaacccgcattgtgggcaacaacggcaacttttctcagcgatttgcgcttggacggtttggaagaactgccgccgctgaccgaactgggcgaactggttttgcccgatttgatagaaatgccgcctacggatgaagaagagccggaaaccgtaccgtccgataccctgcccaac

SEQ ID NO: 2882 - protein, 200 aa, Neisseria gonorrhoeae
MTDKISPDALIEAALLTQTEPLTEKSMRELCVPPLSQDKLIDVLAQLKTRWQDRALQLVHTQEGWRFQIVQTAFERLGSLQEQRAPRYSRAVMETLAIIAYQQPVTRGDIEGIRGVAVSQNVMQTLQDRGWIEVIGHRDTLGKPALWATTATFLSDLRLDGLEELPPLTELGELVLPDLIEMPPTDEEEPETVPSDTLPN

SEQ ID NO: 2883 - DNA, 480 bp, Neisseria gonorrhoeae
ttggcttgcgttgccgaacacgagggcgacttcggtatagtctttctgccctttgctgactttgctgccgtaataggcggtttgggcttttttcagggcggcttcccaatcttgtttttgggcaaacgcttcggcggcggcaagcgaggttttggcaaaaaacggcagcgggcggttttgcccgatattgaaaaacgccatccattccgacaacagctgcaatgccctgtcttgcgcgatttccgccaatacttctgtttctccggattggacgataaaggtttgccgcgtttcggcttcagacggcataacggcgcaaaatatcaggtgttccaacaaaaaagccacacgttgcggcgcattgggtttgccgtaggcgtaaaacacctgaccgcagcggtacagattgcccaagctgcctttcaggatttgcccgtccgacggtatggcgtatggaaacgggggcagtttggggctgtt

SEQ ID NO: 2884 - protein, 160 aa, Neisseria gonorrhoeae
LACVAEHEGDFGIVFLPFADFAAVIGGLGFFQGGFPILFLGKRFGGGKRGFGKKRQRAVLPDIEKRHPFRQQLQCPVLRDFRQYFCFSGLDDKGLPRFGFRRHNGAKYQVFQQKSHTLRRIGFAVGVKHLTAAVQIAQAAFQDLPVRRYGVWKRGQFGAV

SEQ ID NO: 2885 - DNA, 831 bp, Neisseria gonorrhoeae
ttgtttttatctgcttatttgttgcaatgccgtctgaagcaatgtgcgtttcagacggcatttggaatttcagttgggcagggtatcggacggtacggtttccggctcttcttcatccgtaggcggcatttctatcaaatcgggcaaaaccagttcgcccagttcggtcagcggcggcagttcttccaaaccgtccaagcgcaaatcgctgagaaaagttgccgttgttgcccacaatgcgggttttcccaatgtgtcccgatgtccgatgacttcaatccacccccgatcctgcaaggtctgcatcacgttctgcgacaccgccacgccgcgtataccttcgatgtcgccgcgcgttacgggctgctggtaggcgataatcgccagtgtttccatcacggcgcgggagtagcgcggcgcacgctgttcttgcaggctgcccagccgctcgaatgccgtctgaacaatctgaaaacgccagccctcctgcgtatgcaccagttgcaacgccctatcctgccaacgcgttttcaactgcgccaacacatcaatcagtttgtcttgcgacaacggcggcacacacagttcgcgcatagatttttcggtcagcggttcggtttgggtcagcagtgcggcttcaatcagcgcgtcgggagaaattttgtcggtcatacgggtatccgtgctgaaacggcatgggtttggatatgccgtctgaaatcggttggagtagagagaagctgcctgaaaaatatttttcagacggcattctttatgcttccgaaggcttctgccctttgcgctctgcttttctggcttcgcgaatggctt

SEQ ID NO: 2886 - protein, 277 aa, Neisseria gonorrhoeae
LFLSAYLLQCRLKQCAFQTAFGISVGQGIGRYGFRLFFIRRRHFYQIGQNQFAQFGQRRQFFQTVQAQIAEKSCRCCPQCGFSQCVPMSDDFNPPPILQGLHHVLRHRHAAYTFDVAARYGLLVGDNRQCFHHGAGVARRTLFLQAAQPLECRLNNLKTPALLRMHQLQRPILPTRFQLRQHINQFVLRQRRHTQFAHRFFGQRFGLGQQCGFNQRVGRNFVGHTGIRAETAWVWICRLKSVGVERSCLKNIFQTAFFMLPKASALCALLFWLREWL

SEQ ID NO: 2887 - DNA, 1671 bp, Neisseria gonorrhoeae
atgcttctaacactttctttgcgtgattttgtcattgtcgaaaatctgaatctggattttcaaagcggttttaccgttttgaccggcgagaccggcgcgggcaagtccattactttggatgcgattggtctgctgttgggcgataaggccgattacagccaagtccgcagcggtgcaaaagaagcgcagctgtcggcattgttcgatatttcccatttgcctgctttaaaagcagaattgcgtgaacaagggctgttggatgagggcggggaagaactcagtatccgccgcattatcgatgccaaaggcaaaagccgcagttttatcaacaatcaggcggctaccttggcgcaactcaaagccgtcggcgggcagcttatcgacatccacgggcaaaacgaccatcattcgcttaatcaggaagctgcccagcgcgaattgttggacgcatttgtgggcggcagggtgcaggcggaaaccgtcaggcagctttatcaaaactgggccaatgcgaaaaaagccctccaagaggcgcaggaacacgccgatgccgtcattatcgagcgggagcgtctggaatggcagtttaacgaactgaatcagttggacattaaacaaggcgaatgggaagctttcagccaaagccacgacagccttgcccattctgccgaattgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaggccgaattgggcgaaatcagtgccaatatgcgcgatgtggcaggacacagtgacatcaaccccaatgaattggcggcacaggaacagcgtatgggcgaactgatggggatggcgcggaaataccggattgaacccgaagagttgcctgccaagttggcagaaatcgaagaacgcctgcaaagtcttcaagctgccgctgatttggacgcgctcgagcataatgttgcccacaattttgccgaatatcaggaagctgcccacatcctttctgccatgcgccatcaggcggcagggcgtttgagtagcgacacgaccgagcatatgcaacaccttgccatgaaaggcgcgcgtttcgacatcgtcctgttgccttcgtcgccgacggcacacggtttggagcaggttcaatttcaagttgccgctaacaaaggcaatccgccccgcccgctgaacaaagtcgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccatcttccgcaagtcgcatcctgcggagaaaaccactggcgggtgcgcaagcacagcgagggagagcaaaccgtcagcgaaatcagtatattggatgaaatacaacggatcgaagaggttgcccgtatgttgggcggagaagttattaccgatacgacgcggcaacatgcggcagaattgctgcaacttgcgtcgaaaaatagtttattt

SEQ ID NO: 2888 - protein, 557 aa, Neisseria gonorrhoeae
MLLTLSLRDFVIVENLNLDFQSGFTVLTGETGAGKSITLDAIGLLLGDKADYSQVRSGAKEAQLSALFDISHLPALKAELREQGLLDEGGEELSIRRIIDAKGKSRSFINNQAATLAQLKAVGGQLIDIHGQNDHHSLNQEAAQRELLDAFVGGRVQAETVRQLYQNWANAKKALQEAQEHADAVIIERERLEWQFNELNQLDIKQGEWEAFSQSHDSLAHSAELLQAAEEVGSKIDGDNGIQRHIYQCQKLLANLQNIEPRFAESLNMLASIEAELGEISANMRDVAGHSDINPNELAAQEQRMGELMGMARKYRIEPEELPAKLAEIEERLQSLQAAADLDALEHNVAHNFAEYQEAAHILSAMRHQAAGRLSSDTTEHMQHLAMKGARFDIVLLPSSPTAHGLEQVQFQVAANKGNPPRPLNKVASGGELARISLALQVVASQYTQVPTLIFDEVDTGIGGGVAEMVGKALRALGRKHQVLAVTHLPQVASCGENHWRVRKHSEGEQTVSEISILDEIQRIEEVARMLGGEVITDTTRQHAAELLQLASKNSLF

SEQ ID NO: 2889 - DNA, 198 bp, Neisseria gonorrhoeae
ttgcttcatacaagtaacagggctttttcatcccttccttatctaacagggggtacagaaaccgaagcggctggcagggttaaggaagtcttcgaatgttacggaaaattcatcttggacagcaaaggcaatttgttaggcattccttactccttattttgggaagaaaacgttatgggtgttttcgatattttaccg

SEQ ID NO: 2890 - protein, 66 aa, Neisseria gonorrhoeae
LLHTSNRAFSSLPYLTGGTETEAAGRVKEVFECYGKFILDSKGNLLGIPYSLFWEENVMGVFDILP

SEQ ID NO: 2891 - DNA, 105 bp, Neisseria gonorrhoeae
gtgttttcgatattttaccgtgaggattggtatgtttatttgaatatgattttttgtggtcgggacggcatgcggcaaaggcttaaggaatcaggttctgccttc

SEQ ID NO: 2892 - protein, 35 aa, Neisseria gonorrhoeae
VFSIFYREDWYVYLNMIFCGRDGMRQRLKESGSAF

SEQ ID NO: 2893 - DNA, 1449 bp, Neisseria gonorrhoeae
ttggatcaggcaacccagtgcctccagttcgacagcatcaacctcatcgaacacatcctgcccgatgtccgcttctggctggttcccccttcacgcacccgccgcctgcacgaacacttccaccacatttcctggcagaccgaagccatcccgcaaaccgaaagcaagtccgacaaaccctggtttgcacttccacaaacatccgaacggaaaaaaccggaacacgtcctcgtcatcggtgcaggcattgccggcgcatcgaccgcccacgccttagcatcacacggcatttccgttaccgtattggaagcccgaaaagccgctcaagccgccagcggcaaccggcaagggctgctttacgccaaaatctcgccgcacgacaccggacagaccgaactgctgcttgccggctacggctacaccaaacgcctgctcggacacatcctgcccgactccgacacttggggcggcaacggcatcatccacctcaattacagccgcaccgaacaacaacgcaatcacgaattgggtttgcaaaaacaccataaccacctctaccgcagcatcacgtctgcagaagccgaaaaaatcgccggcatcccgctgaacacgccctacgccgaaccattatgcggactctactggcaacacggcgtatggctcaatccgcccgcattcgtccgcaccctcctcagccatccgctgatcgaactatatgaaaacacaacgttaaccggcatttcccacgacggagaaaagtggattgcaagcacgccaaacggcacatttaccgccacacacatcatctactgcaccggcgcgcacagcccctgcctgcccgaaaccaacctcgccgccctacccctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagcaataccggatggaacgaagccgaagaagcctcaaaccgccaagcattggcacaccttaaccccgcccttgccgaatcattgtttgccgccaacccaaacccccaaaaacaccaagggcacgccgccatacgctgcgacagccccgaccacctccccgtcgtcggcgcactcggcgacattgccgccatgcggcagacttacgccaaacttgcactggacaaaaactaccgcatcgacaccacatgcccatatctgcccaatgcctacaccaataccgcccacggcacacgcgggcttgccaccgcccccatctgcgccgccgccgttgccgccgaaatcctaggcttgccccatctcttttcacaacgcctgcgccacgccctacaccccaaccgcaccgtcatccgcgccatcgtcagaaggcagaacctgattcct

SEQ ID NO: 2894 - protein, 483 aa, Neisseria gonorrhoeae
LDQATQCLQFDSINLIEHILPDVRFWLVPPSRTRRLHEHFHHISWQTEAIPQTESKSDKPWFALPQTSERKKPEHVLVIGAGIAGASTAHALASHGISVTVLEARKAAQAASGNRQGLLYAKISPHDTGQTELLLAGYGYTKRLLGHILPDSDTWGGNGIIHLNYSRTEQQRNHELGLQKHHNHLYRSITSAEAEKIAGIPLNTPYAEPLCGLYWQHGVWLNPPAFVRTLLSHPLIELYENTTLTGISHDGEKWIASTPNGTFTATHIIYCTGAHSPCLPETNLAALPLRQIRGQTGLTPSTPFSEQLRCAVSGESYISPSWHGLHCYGASFIPNSSNTGWNEAEEASNRQALAHLNPALAESLFAANPNPQKHQGHAAIRCDSPDHLPVVGALGDIAAMRQTYAKLALDKNYRIDTTCPYLPNAYTNTAHGTRGLATAPICAAAVAAEILGLPHLFSQRLRHALHPNRTVIRAIVRRQNLIP

SEQ ID NO: 2895 - DNA, 159 bp, Neisseria gonorrhoeae
gtgcctttaaacggcgcgtattttaacagctttatcccgataccgatattcaaacccacacttcagacggcattgatatggacaatctcgtatgggacggcattcccgacatccgcacactcgaccaaaccatccgcaaacacgcacacccgctcaacc

SEQ ID NO: 2896 - protein, 53 aa, Neisseria gonorrhoeae
VPLNGAYFNSFIPIPIFKPTLQTALIWTISYGTAFPTSAHSTKPSANTHTRST

SEQ ID NO: 2897 - DNA, 390 bp, Neisseria gonorrhoeae
ttgtatgccgaaccgaggtgttttttgaataatattcctgttgaaatccgtttgttgaaaaaccgtgccgtgttggttttgacttatggggacgaacctaaaaatctgcctgccgaatttttacgcgtctattcgccgagtgcggaagtgcgcggacacggcgtgggacaggatgttttgcagaccggtaaggcggatgtgcagattacggatttgcagcctgtcggacagtatgcgctgaaaatcagtttttcggacgggcacgacagcggtctttacgattgggcgtatctgcacagactggcatacggatacgatgcgatgtggcaggaatatttggacaaattggcggcggcgggcgcgtcgcgttttgaaaagcaatcagattgt

SEQ ID NO: 2898 - protein, 130 aa, Neisseria gonorrhoeae
LYAEPRCFLNNIPVEIRLLKNRAVLVLTYGDEPKNLPAEFLRVYSPSAEVRGHGVGQDVLQTGKADVQITDLQPVGQYALKISFSDGHDSGLYDWAYLHRLAYGYDAMWQEYLDKLAAAGASRFEKQSDC

SEQ ID NO: 2899 - DNA, 735 bp, Neisseria gonorrhoeae
atgggcggacaaaaaacgcatttcgggttcagcacggtcaacgaagatgagaaagccggaaaagtggcggaagtgtttcactccgtcgccaaaaactacgacattatgaatgatgtgatgtcggcagggctgcaccgcgtatggaagcattttaccatccatacggcgcacctgaaaaaaggcgataaagtgttggacattgcgggcggtacgggcgatttgtcgcgcggttgggcgaaacgggtcggcaaggaaggcgaggtttggctgaccgatattaattcttctatgctgaccgtcgggcgcgaccgtctgttgaacgaaggcatgattttacccgtgtcgcttgccgatgcggaaaaactgcctttccccgacaattatttcaacttggtctccgtggcgttcggcttgcggaacatgacgtataaagatgccgcgcttaaggaaatgtaccgtgttttgaaaccgggcggtacgttgctggtgttggagttttccaaaatctacaagccgctcgaaggcgcatacgatttttattctttcaagctgttgccggtaatgggcaggctgattgccaaagatgcggacagctaccagtatctcgccgaatccatccgtatgcaccccgatcaggaaactttgaaacagatgatgctggatgcaggcttcgacagcgtggattatcacaatatgagtgcgggcatcgtcgcgctgcataagggcgtgaaattt

SEQ ID NO: 2900 - protein, 245 aa, Neisseria gonorrhoeae
MGGQKTHFGFSTVNEDEKAGKVAEVFHSVAKNYDIMNDVMSAGLHRVWKHFTIHTAHLKKGDKVLDIAGGTGDLSRGWAKRVGKEGEVWLTDINSSMLTVGRDRLLNEGMILPVSLADAEKLPFPDNYFNLVSVAFGLRNMTYKDAALKEMYRVLKPGGTLLVLEFSKIYKPLEGAYDFYSFKLLPVMGRLIAKDADSYQYLAESIRMHPDQETLKQMMLDAGFDSVDYHNMSAGIVALHKGVKF

SEQ ID NO: 2901 - DNA, 399 bp, Neisseria gonorrhoeae
ttgtttgcttgtttattccctgttgcgcgtgtgccaaaaataccgccgcacgaaacacgggaaggcgaaaatgaggtacaggcagacgacggtggcgtaaaactcccaaccctgattgtgtaccgctcccgcacgggattcgaggatgtaggcaagagaggcggtcagcgcgaaacctgccgccagctcgatcaggtggtgtccgaaatgtttgcgcttgagcgcggccacgccgaacagtctggtcgtgaggaagggggcgttggcaaagatgagtgccaagaccaaaaggatgtacatggatgcggtcatgatgggctttctgtttgggcattgtcggcggcgatgccgtctgaactgcattgcggaacggcatatcttaacaaaaacggcagcctc

SEQ ID NO: 2902 - protein, 133 aa, Neisseria gonorrhoeae
LFACLFPVARVPKIPPHETREGENEVQADDGGVKLPTLIVYRSRTGFEDVGKRGGQRETCRQLDQVVSEMFALERGHAEQSGREEGGVGKDECQDQKDVHGCGHDGLSVWALSAAMPSELHCGTAYLNKNGSL

SEQ ID NO: 2903 - DNA, 3204 bp, Neisseria gonorrhoeae
atgttttacctgtaccaatccaaccgcctcgaatcgctcgctgcactgtttgcccgcattcaaaaagtcaaaccgctgaaatgtgccttgcagcccgaacagattgttgtgcagagccaggggatgcgccgctacctcaacacctgcctcgcccgcgatttgggcgtggcggcgaatttggcgttcagcctgcccgccggcctgacgtggaagttgatgaaaaaactgattcccggtattccggaactcagcccgtttgcacccgaagtcatgcgctggcggctgctggatttgttccgcagcgcagaatttcaaaacggagcggaatttgaagatgtgaggaatgtgctgcaagactatctgggcagcggagaatcggcggattaccagcttgcgggacagcttgcagacatattcgaccaatacctcgtgtaccgtcctcagtggatagacgcttggcagcagggcaggatactcggtttgggcgacgacgaaatctggcagtccaaactgtggcgttacctcgacgacggcaggcagagcgcgccgcaccgtgtcgcgttgtgggaaaaactgcttgccgcgttggacaaggataagctgcccgagcgttatttcgtgttcggcatttccacgatggcgccgatgtatttgcagcttttgcacaagctgtccgaacattgcgacgtgttcgtgttcgcacttaatccgagcgggatgcattggggcaacgtcatcgaagcggcgcaaatcctcaaaggcggcggcgatcccgatctgacgcaggcagggcatccgctgcttgcctcattgggcaagcaggggcgcgactttttcgactttttgaacgaaatggaaatagaagaagaaacgccggtatttgaagaaggcgggcgcgatacgcttttgcacgccctgcaaaccgatattcaaaacctgaaaatgccgtctgaaaatgtgggaagcgtcggtacggatgacggctcgatatgcatcgtatccgcacacagccccttgcgcgaattgcagatactcaaagacaaactgttgaaaattctgcatgaacatcccgattggcagccgcatgatatcgccgtattaaccccgaatatcgaaccctatacgccttttatcgaagccgtgttcggacaggcgcaacccggcgcgcaggcattgccgtattccgtttcggacgtgaaaatcagccgccggcaaccgtttttttatgcgttggagtgcgtgtccgacttgctggaaagccgttttgaagtcggcaaagtgctcgcgcttttggaaaccgcgcccgtgttgcgccgtttcggactgaccggggacgatttgccgcttttgcacgatatggttgccgatttgaacgtccattggggattggacggagaaatgcgcggcggcacggatcagctgtttacctggaagcaggcggcagaccgtatgatattgggctggatgctgcccgaaggcggcaacccgatgtggcaggatgtcagcgcgtggtatgccgacgtgaatcaaaccgccatgttcggacgttttgccgccttcctcgaaaccctgtcggatattgcccggatatggcggcaacctgcgacggtcggcgaatgggtggcgcgttgccgggatttgcttgaaacattgtttcaagccgggcccgatgaccaaaaggcagtccaaaacctcgaaaacgaatgggtcaaatggcaggaagagagcactttggctgggtttttcggacagttgccgcaacaaaccgtcatccgccatatccgccgcttcctcgacagcgaaagcgaggcaggctttttacgcggcggcatcaccttttgcagtatggtgccgatgcgcagcctgccctttaaagtcatctgcctgttgggtttgaacgacggagattttccccgcaataccaaagccgccgtattcgacctggttgccaaacatcccgccaaaggcgaccgcgcccgccgcgacgacgaccgctacctcttcctcgaagccctcatcagcgcgcgcgaaatcctgtatttgtcctacatcgggcgcgacatccgcaaagacgaagaactggcttcgtcttccctgttgggcgaactcatcgataccgttgccgccatgaccggcacaaacagccgccaacttgcacaaaattggatagaacagcatccgctgcaagccttctcgcgccgatatttccaagaaggcggacgttcagacggcatattcggcacgcgtaccgactacgccgccgcgctcggacaaacgcccgaaccgccgcaaccctttttcgaccaacccgtagaaaacgccgaacctgttgccgaaatcggacaggacgaatttatccgcttctggcgcaaccccgtcaaagtatggctgcagcagcttgcgtggagcgaaccccatatcggcgaagcctgggagcctgccgaacccttcgagccgcaacacgcggagcaaatcgccgaaacctatatcggggcgcgccgcgaaggacaagatttttcccaaaccgccgcccgtatcgcggcggaaagcctgctgccttccggagaattgggaaaactttggcagcagtccttccaaaccgccgccaaacaaatcgacacggcggttttaaacagccccaaactgcccccgtttccatacgccataccgtcggacgggcaaatcctgaaaggcagcttgggcaatctgtaccgctgcggtcaggtgttttacgcctacggcaaacccaatgcgccgcaacgtgtggcttttttgttggaacacctgatattttgcgccgttatgccgtctgaagccgaaacgcggcaaacctttatcgtccaatccggagaaacagaagtattggcggaaatcgcgcaagacagggcattgcagctgttgtcggaatggatggcgtttttcaatatcgggcaaaaccgcccgctgccgttttttgccaaaacctcgcttgccgccgccgaagcgtttgcccaaaaacaagattgggaagccgccctgaaaaaagcccaaaccgcctattacggcagcaaagtcagcaaagggcagaaagactataccgaagtcgccctcgtgttcggcaacgcaagccaaaacccgctcgaacagcccctgtttgaaaacctcgcccgcctgctcgccgacacgcttgccgcagcggaaaagagggaagggaccggagcagca

SEQ ID NO: 2904 - protein, 1068 aa, Neisseria gonorrhoeae
MFYLYQSNRLESLAALFARIQKVKPLKCALQPEQIVVQSQGMRRYLNTCLARDLGVAANLAFSLPAGLTWKLMKKLIPGIPELSPFAPEVMRWRLLDLFRSAEFQNGAEFEDVRNVLQDYLGSGESADYQLAGQLADIFDQYLVYRPQWIDAWQQGRILGLGDDEIWQSKLWRYLDDGRQSAPHRVALWEKLLAALDKDKLPERYFVFGISTMAPMYLQLLHKLSEHCDVFVFALNPSGMHWGNVIEAAQILKGGGDPDLTQAGHPLLASLGKQGRDFFDFLNEMEIEEETPVFEEGGRDTLLHALQTDIQNLKMPSENVGSVGTDDGSICIVSAHSPLRELQILKDKLLKILHEHPDWQPHDIAVLTPNIEPYTPFIEAVFGQAQPGAQALPYSVSDVKISRRQPFFYALECVSDLLESRFEVGKVLALLETAPVLRRFGLTGDDLPLLHDMVADLNVHWGLDGEMRGGTDQLFTWKQAADRMILGWMLPEGGNPMWQDVSAWYADVNQTAMFGRFAAFLETLSDIARIWRQPATVGEWVARCRDLLETLFQAGPDDQKAVQNLENEWVKWQEESTLAGFFGQLPQQTVIRHIRRFLDSESEAGFLRGGITFCSMVPMRSLPFKVICLLGLNDGDFPRNTKAAVFDLVAKHPAKGDRARRDDDRYLFLEALISAREILYLSYIGRDIRKDEELASSSLLGELIDTVAAMTGTNSRQLAQNWIEQHPLQAFSRRYFQEGGRSDGIFGTRTDYAAALGQTPEPPQPFFDQPVENAEPVAEIGQDEFIRFWRNPVKVWLQQLAWSEPHIGEAWEPAEPFEPQHAEQIAETYIGARREGQDFSQTAARIAAESLLPSGELGKLWQQSFQTAAKQIDTAVLNSPKLPPFPYAIPSDGQILKGSLGNLYRCGQVFYAYGKPNAPQRVAFLLEHLIFCAVMPSEAETRQTFIVQSGETEVLAEIAQDRALQLLSEWMAFFNIGQNRPLPFFAKTSLAAAEAFAQKQDWEAALKKAQTAYYGSKVSKGQKDYTEVALVFGNASQNPLEQPLFENLARLLADTLAAAEKREGTGAA

SEQ ID NO: 2905 - DNA, 927 bp, Neisseria gonorrhoeae
ttggattggaataattttgttttaaatcgttgcacatttgattggaacggcggaggttgtgcggtcaataaaggtgatgatttcagagctggggcttctttttcccttggccgcaatccgaaatacaaagaagaaatggatgccaaaaagccggaagagattttatcgttgaaagtcgatgccgatcccgacaaatacatagaggcaaccggatatcccggttattccgaaaaagtagaagtcgcacccggaacaaaagtgaatatggggcccgtcacggacaggaacgggaatcccgttcaggttgccgcaacattcggcagggacgcgcaaggcaacaccacggcggatgttcaagtaatcccgcgtcccgacctcacgcccgcaagcgcggaagcacctcacgcacagccgctgcccgaagtatcgcccgcggaaaaccccgcaaacaacccggaccccgatgagaaccccggcacgcgtcccaatcccgaacccgaccccgatttgaatcccgatgcaaatcccgatacggacggacagcccggaacaagccccgattccccggccgttccggaccgcccaaacggcaggcatcgcaaagaaaggaaagaaggcgaagacggcgggctttcgtgcgattattttccggaaatcctagcctgtcaggagatgggcaaaccttcggaccgcatgtttcacgatataagcataccgcaggttacagacgataaaacatggtcttcacataactttttaccgtctaacggcgtatgtccgcagccgaaaacctttcatgttttcggcaggcaatatcgggcaagctatgaaccgttgtgcgtgtttgccgaaaaaatccggtttgccgtactgctcgcctttatcattatgtcggcttttgtcgttttcggttcgttggggggggaa

SEQ ID NO: 2906 - protein, 309 aa, Neisseria gonorrhoeae
LDWNNFVLNRCTFDWNGGGCAVNKGDDFRAGASFSLGRNPKYKEEMDAKKPEEILSLKVDADPDKYIEATGYPGYSEKVEVAPGTKVNMGPVTDRNGNPVQVAATFGRDAQGNTTADVQVIPRPDLTPASAEAPHAQPLPEVSPAENPANNPDPDENPGTRPNPEPDPDLNPDANPDTDGQPGTSPDSPAVPDRPNGRHRKERKEGEDGGLSCDYFPEILACQEMGKPSDRMFHDISIPQVTDDKTWSSHNFLPSNGVCPQPKTFHVFGRQYRASYEPLCVFAEKIRFAVLLAFIIMSAFVVFGSLGGE

SEQ ID NO: 2907 - DNA, 477 bp, Neisseria gonorrhoeae
atgccggaaagtattttcaaacagatttcctccgatattttgaggctgcaccgtgattctgtttattccctgctagcaacctcgggttgcaactgtcaggtgcatgaagcggcatatgtcaatattgacggcaaatattatattgcgctttcgtgcgaacccgaggtgggggaagttgaaacaggtattttgttgattgaagatgaaagccgcaaccttcgtttgagctgggtcggtagtgcgagggagctcgaccgcaaggataatgcctacaaacgcgccctgtccgcgttgtccagaaagctggggcggtgtaaggacaagctgcatacggcggttcagccgtttttgttggagctggtgccggagaaaggcagattttctgtcggtgatgaagaagtttggatttctcgaaacgatttagtgagggccttatatcccgtcgggtacagtatgcggcaggcagtgttgcagatt

SEQ ID NO: 2908 - protein, 159 aa, Neisseria gonorrhoeae
MPESIFKQISSDILRLHRDSVYSLLATSGCNCQVHEAAYVNIDGKYYIALSCEPEVGEVETGILLIEDESRNLRLSWVGSARELDRKDNAYKRALSALSRKLGRCKDKLHTAVQPFLLELVPEKGRFSVGDEEVWISRNDLVRALYPVGYSMRQAVLQI

SEQ ID NO: 2909 - DNA, 474 bp, Neisseria gonorrhoeae
atgccgtccgaacaccggtttcagacggcatttttcctttgccgccaacacgcgtgcaaaaaaaatcgccccttgagaaaggggcgcaaaaggaacacaaaccactaccaaaactttaaatctgcaacactgcctgccgcatactgtacccgacgggatataaggccctcactaaatcgtttcgagaaatccaaacttcttcatcaccgacagaaaatctgcctttctccggcaccagctccaacaaaaacggctgaaccgccgtatgcagcttgtccttacaccgccccagctttctggacaacgcggacagggcgcgtttgtaggcattatccttgcggtcgagctccctcgcactaccgacccagctcaaacgaaggttgcggctttcatcttcaatcaacaaaatacctgtttcaacttcccccacctcgggttcgcacgaaagcgcaatataatatttgccgtcaatat

SEQ ID NO: 2910 - protein, 158 aa, Neisseria gonorrhoeae
MPSEHRFQTAFFLCRQHACKKNRPLRKGRKRNTNHYQNFKSATLPAAYCTRRDIRPSLNRFEKSKLLHHRQKICLSPAPAPTKTAEPPYAACPYTAPAFWTTRTGRVCRHYPCGRAPSHYRPSSNEGCGFHLQSTKYLFQLPPPRVRTKAQYNICRQY

SEQ ID NO: 2911 - DNA, 492 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggcttcctcactgtatatgaccgcacccgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacagg

SEQ ID NO: 2912 - protein, 164 aa, Neisseria gonorrhoeae
MNNRHFAVIALGSNLDNPAQQIRGALDALSSHPDIRLEQASSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 2913 - DNA, 372 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattc

SEQ ID NO: 2914 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 2915 - DNA, 444 bp, Neisseria gonorrhoeae
ttgatacgagccgaccatgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctgaaacactgccatgaacaacagacattttgccgtcatcgccttgggcagcaacct

SEQ ID NO: 2916 - protein, 148 aa, Neisseria gonorrhoeae
LIRADHAVSDCQIQPSNLRYHHHFGIQHPFFPTLEKSRKALGRLLESTAPPQRHDAAVYGIVADEDYPFLPVQRALARHKNPAPVRLHRTGHGNDARPSAFDQVLHRLPARYVLHRLHRLPCQNQSPAILKHCHEQQTFCRHRLGQQP

SEQ ID NO: 2917 - DNA, 180 bp, Neisseria gonorrhoeae
ttgccgtcctctatccgggacacgaaaacggcaaacaggaggcagaagccgtcggacaatgggcaaaaaacctgcctcaagaacagtttgccgttttacgttacggctttaccaaccggaagaatagcccaccctatcttttggcatttgaaaaactgcgtcaaaaataactgtttgcgg

SEQ ID NO: 2918 - protein, 60 aa, Neisseria gonorrhoeae
LPSSIRDTKTANRRQKPSDNGQKTCLKNSLPFYVTALPTGRIAHPIFWHLKNCVKNNCLR

SEQ ID NO: 2919 - DNA, 174 bp, Neisseria gonorrhoeae
atgcttattgccgtcctctatccgggacacgaaaacggcaaacaggaggcagaagccgtcggacaatgggcaaaaaacctgcctcaagaacagtttgccgttttacgttacggctttaccaaccggaagaatagcccaccctatcttttggcatttgaaaaactgcgtcaaaaa

SEQ ID NO: 2920 - protein, 58 aa, Neisseria gonorrhoeae
MLIAVLYPGHENGKQEAEAVGQWAKNLPQEQFAVLRYGFTNRKNSPPYLLAFEKLRQK

SEQ ID NO: 2921 - DNA, 285 bp, Neisseria gonorrhoeae
ttccctgttgcgcgtgtgccaaaaataccgccgcacgaaacacgggaaggcgaaaatgaggtacaggcagacgacggtggcgtaaaactcccaaccctgattgtgtaccgctcccgcacgggattcgaggatgtaggcaagagaggcggtcagcgcgaaacctgccgccagctcgatcaggtggtgtccgaaatgtttgcgcttgagcgcggccacgccgaacagtctggtcgtgaggaagggggcgttggcaaagatgagtgccaagaccaaaaggatgtacat

SEQ ID NO: 2922 - protein, 95 aa, Neisseria gonorrhoeae
FPVARVPKIPPHETREGENEVQADDGGVKLPTLIVYRSRTGFEDVGKRGGQRETCRQLDQVVSEMFALERGHAEQSGREEGGVGKDECQDQKDVH

SEQ ID NO: 2923 - DNA, 90 bp, Neisseria gonorrhoeae
atgacccgatgccgtctgaagcgttcagacggcattttgtttgcgggcggcttgcccgagaagctatataattccgcatcactgtcattt

SEQ ID NO: 2924 - protein, 30 aa, Neisseria gonorrhoeae
MTRCRLKRSDGILFAGGLPEKLYNSASLSF

SEQ ID NO: 2925 - DNA, 165 bp, Neisseria gonorrhoeae
ttgctccgcattcgcggcgcggcagcgctgtggggacaccccctcgcgcttatcgccaatccccccgcgcttctcggctgtttgcggcttcgcccgcaaagtgcggtacttcgcctgccttggcacaaggtaccgaagcccggcggtacttcgcctgcctttggc

SEQ ID NO: 2926 - protein, 55 aa, Neisseria gonorrhoeae
LLRIRGAAALWGHPLALIANPPALLGCLRLRPQSAVLRLPWHKVPKPGGTSPAFG

SEQ ID NO: 2927 - DNA, 414 bp, Neisseria gonorrhoeae
gtgtcccggatagaggacggcaataagcataccgtcttctttcagcagggagagggttgctcaaagggcgggaatgctggtttccttgtcggtggtcagattcttgtcgcctccgggcaaccagccgaaattgaaaacggctgcatccagcggctccggaatatattgcttcaggttttcatgtccgtccaagatgagccgtacattgctgtaacctgcttcctgcagacggcatcgggtgttgttcagggcttgcggctggatgtcgaatgcccacactttccccctgttgcctgcggtttgtgcgaggaaaagggtgtcgtgtccgttgccggcggtgccgtccagcgcattgccgccttcgggaagtgcctcccgcaaaaggcaatgggcgaatggaaggatgtttttcaa

SEQ ID NO: 2928 - protein, 138 aa, Neisseria gonorrhoeae
VSRIEDGNKHTVFFQQGEGCSKGGNAGFLVGGQILVASGQPAEIENGCIQRLRNILLQVFMSVQDEPYIAVTCFLQTASGVVQGLRLDVECPHFPPVACGLCEEKGVVSVAGGAVQRIAAFGKCLPQKAMGEWKDVFQ

SEQ ID NO: 2929 - DNA, 351 bp, Neisseria gonorrhoeae
ttgaaaaacatccttccattcgcccattgccttttgcgggaggcacttcccgaaggcggcaatgcgctggacggcaccgccggcaacggacacgacacccttttcctcgcacaaaccgcaggcaacagggggaaagtgtgggcattcgacatccagccgcaagccctgaacaacacccgatgccgtctgcaggaagcaggttacagcaatgtacggctcatcttggacggacatgaaaacctgaagcaatatattccggagccgctggatgcagccgttttcaatttcggctggttgcccggaggcgacaagaatctgaccaccgacaaggaaaccagcattcccgccctt

SEQ ID NO: 2930 - protein, 117 aa, Neisseria gonorrhoeae
LKNILPFAHCLLREALPEGGNALDGTAGNGHDTLFLAQTAGNRGKVWAFDIQPQALNNTRCRLQEAGYSNVRLILDGHENLKQYIPEPLDAAVFNFGWLPGGDKNLTTDKETSIPAL

SEQ ID NO: 2931 - DNA, 129 bp, Neisseria gonorrhoeae
atgcccggcggaaaaccgcccaaacacaaaaaaattggtaatttttcctattccaggctacaattcgacacgcacagggcatctgcccgatttcacaatcataatagcggagttaaaaaatatgacagc

SEQ ID NO: 2932 - protein, 43 aa, Neisseria gonorrhoeae
MPGGKPPKHKKIGNFSYSRLQFDTHRASARFHNHNSGVKKYDS

SEQ ID NO: 2933 - DNA, 444 bp, Neisseria gonorrhoeae
gtggatgctgcagcaacgctcctgacatacaaatgcccggcggaaaaccgcccaaacacaaaaaaattggtaatttttcctattccaggctacaattcgacacgcacagggcatctgcccgatttcacaatcataatagcggagttaaaaaatatgacagctaaaggacaaatgttgcaagatcccttcctgaacgcattgcgtaaagagcatgttccggtttcgatttacttagttaacggtatcaaattgcaaggtcaggtcgaatctttcgaccaatacgtcgttcttctgagaaacacttccgtaacccaaatggtttacaaacacgccatttccaccatcgtaccggctcgctccgtcaacctccaacatgaaaacaaaccccaagccgcaccggcttcgacccttgtccaagtggaaaccgtccagcagcctgccgaa

SEQ ID NO: 2934 - protein, 148 aa, Neisseria gonorrhoeae
VDAAATLLTYKCPAENRPNTKKLVIFPIPGYNSTRTGHLPDFTIIIAELKNMTAKGQMLQDPFLNALRKEHVPVSIYLVNGIKLQGQVESFDQYVVLLRNTSVTQMVYKHAISTIVPARSVNLQHENKPQAAPASTLVQVETVQQPAE

SEQ ID NO: 2935 - DNA, 1107 bp, Neisseria gonorrhoeae
atgtcaaaccacaaaatatgttccgatttaaaaacagaatgttataaaacccaactccaaaaacacaacaagaccgcccgcctacgggcagtctcctgtcagacgacatactttacagatggctgttttttcaacaaaataacgccaatactcaaaaatacggaaccaaaaatgtccatccgcaccctgaaacgcctgccctcatcgctgctgctcggcctctgcctttccctgccgtcagcccacctttttgccgacaacgacattttagggcaatttttagaacagaacatgcttacctcctccgatccgatagaaatattcgccgaaagcacgatatatcccgccgatacccaggccattacgggcgggctgattctgtcctcccaatccgcactggtcgtcaacaacaaaacagggcaaatactgtatcagaaaaacgccgacaggattatgcccattgcctccatttccaagctcatgagcgcgatggtcgttttggatgcaaacttggacatgaacgaaaccgttaccatcacacccgacgaaatcgaccgcctcaaagggaccggcagccgtcttgccataggtacggcacttacacgtaaagaactgctgcaccttagcctgatgagcagcgaaaaccgcgccacccatgcattgggcagaacctaccccggcggcatgggcgcatttgtcgccgccatgaaccgcaaagcccaaagcctgggcatgtacggcagccgcttttacgaaccgaccggactcaacttccaaaacgtttccaccgccaaagacctgagcctcatggtcaacgccgccgcccaatatccgcaaatccgcaccaactcgacttccaactacgcctcggtacaaaccaaaaacgggcagcaaaactataaaaactccaatgccctggtcagggaaggcatgtggaacatcgaattgcagaaaaccggctacatccgcgaggcaggcaggtctatggttgtcaaagccaacattcaaaaccaacccgttaccatcgtattgctgaactcgcccacatccgccacacgcgtcaacgacgcccgcaaaatcgaatcgtggatgctgcagcaacgctcc

SEQ ID NO: 2936 - protein, 369 aa, Neisseria gonorrhoeae
MSNHKICSDLKTECYKTQLQKHNKTARLRAVSCQTTYFTDGCFFNKITPILKNTEPKMSIRTLKRLPSSLLLGLCLSLPSAHLFADNDILGQFLEQNMLTSSDPIEIFAESTIYPADTQAITGGLILSSQSALVVNNKTGQILYQKNADRIMPIASISKLMSAMVVLDANLDMNETVTITPDEIDRLKGTGSRLAIGTALTRKELLHLSLMSSENRATHALGRTYPGGMGAFVAAMNRKAQSLGMYGSRFYEPTGLNFQNVSTAKDLSLMVNAAAQYPQIRTNSTSNYASVQTKNGQQNYKNSNALVREGMWNIELQKTGYIREAGRSMVVKANIQNQPVTIVLLNSPTSATRVNDARKIESWMLQQRS

SEQ ID NO: 2937 - DNA, 123 bp, Neisseria gonorrhoeae
ttggtacaggtaaaacatggcttgctttttcaaaatgacagtgatgcggaattatatagcttctcgggcaagccgcccgcaaacaaaatgccgtctgaacgcttcagacggcatcgggtcatt

SEQ ID NO: 2938 - protein, 41 aa, Neisseria gonorrhoeae
LVQVKHGLLFQNDSDAELYSFSGKPPANKMPSERFRRHRVI

SEQ ID NO: 2939 - DNA, 90 bp, Neisseria gonorrhoeae
ttgaggcgcgcccgttatgctatgggttatcgcctgttgaaaatgggctgccaatctatctacacccgcataggtaacagccatcaagcc

SEQ ID NO: 2940 - protein, 30 aa, Neisseria gonorrhoeae
LRRARYAMGYRLLKMGCQSIYTRIGNSHQA

SEQ ID NO: 2941 - DNA, 501 bp, Neisseria gonorrhoeae
ttggcaattgcggcggtgcgtctgcgtgccgttttgaataatgggaatatcgggagtaggactatggatatgaaatatgaatttaccctgccttcgagcagcggtgcggattttcattcggcagaacatctgcctttggtcgtgtatttttatccgaaagacagtacgccgggctgtacgacggaaggcttggattttaatgcgcgtttggaacagtttgaggcattgggttataccgtggtcggtatttcccgcgacggcgtaaaggcgcatcagaatttttgcgccaagcagggtttccggttcgagctgttgagcgacaaggatgaaacggtgtgccgcctgtttgatgtcatcaaattgaaaaaactgtatgggaaagagtcgttaggcatcgagcgcagtacgttcgttctgaacaaggacggcgaaattgtccgggagtggcggaaagtcaaagtggcgggtcatgcacaggaagtgttggaaacgctttcccga

SEQ ID NO: 2942 - protein, 167 aa, Neisseria gonorrhoeae
LAIAAVRLRAVLNNGNIGSRTMDMKYEFTLPSSSGADFHSAEHLPLVVYFYPKDSTPGCTTEGLDFNARLEQFEALGYTVVGISRDGVKAHQNFCAKQGFRFELLSDKDETVCRLFDVIKLKKLYGKESLGIERSTFVLNKDGEIVREWRKVKVAGHAQEVLETLSR

SEQ ID NO: 2943 - DNA, 888 bp, Neisseria gonorrhoeae
ttggtttggaacgctatggaaaacggtttgattgacaggctgctggaaactttgtggttggatcggcggctcagtcggaatactttggacagctaccggcgggatttggaaaagatcgcccgccggctgtctttgtgcggcagaacgctgaaggatgcggacgaagcagatttggcggcggcggtttatgttgacggggagcaacggagttcgcaggcacgcgcactgtcggcgtgcaaacgcctgtatgtgtggatggaacgggaagggatgagggcggacaatcccacccgcctgctgaaaccgccaaaaatcgacagaaacatcccgacactgattacagaacagcagatttcccgactgcttgccgcaccggataccgacacgccgcacggtttgcgggataaggccctgctcgaattgatgtacgcgaccggcttgcgcgtcagcgaggcggtcgggctgaatttcggcaatgtggatttggacaggggttgtattaccacgctgggcaagggcgacaagcagaggatggtcccgatgggacaggagtcagcgtattgggtggaacgctattatacggaggcacgcccgcttctgctgaaaggcaggagttgcgacgcattgtttgtcagtcagaaaaaaacgggcatttcccggcagttggcgtggatgattgtcaaagaatatgccggcagggcaggcatcgggcacatcagcccgcacagcctgcgccacgcctttgccacgcatctggtgcggcacggattggatttgcgcgtagttcaggatatgttgggacacgccgatttgaacacgactcagatttatacccatgttgccaatgtgcggctgcatagcgtggttaaggaacaccattcccgaaac

SEQ ID NO: 2944 - protein, 296 aa, Neisseria gonorrhoeae
LVWNAMENGLIDRLLETLWLDRRLSRNTLDSYRRDLEKIARRLSLCGRTLKDADEADLAAAVYVDGEQRSSQARALSACKRLYVWMEREGMRADNPTRLLKPPKIDRNIPTLITEQQISRLLAAPDTDTPHGLRDKALLELMYATGLRVSEAVGLNFGNVDLDRGCITTLGKGDKQRMVPMGQESAYWVERYYTEARPLLLKGRSCDALFVSQKKTGISRQLAWMIVKEYAGRAGIGHISPHSLRHAFATHLVRHGLDLRVVQDMLGHADLNTTQIYTHVANVRLHSVVKEHHSRN

SEQ ID NO: 2945 - DNA, 198 bp, Neisseria gonorrhoeae
atgtttgtctgcatctgcaatgccgttaccgaccatcaaatcaaggaaaccatcgctgccggcgcgaccacaatgggcgatttgcagtcgcaattgggcgtggcgagctgctgcggctgctgcggggagcttgccgcttcgtttctgacggcgcacaatgcgcaaccgacggttacggcgggtatcaacgttcaagcg

SEQ ID NO: 2946 - protein, 66 aa, Neisseria gonorrhoeae
MFVCICNAVTDHQIKETIAAGATTMGDLQSQLGVASCCGCCGELAASFLTAHNAQPTVTAGINVQA

SEQ ID NO: 2947 - DNA, 390 bp, Neisseria gonorrhoeae
ttgataaaaaattaccaagacaaaccgtgtatgccgaccttgcaatgcgaaccgtttttatttatatttgcatacgataataaaagccgctatcggtacgatagtttgagaacacacggagcacaaaatgtttgtctgcatctgcaatgccgttaccgaccatcaaatcaaggaaaccatcgctgccggcgcgaccacaatgggcgatttgcagtcgcaattgggcgtggcgagctgctgcggctgctgcggggagcttgccgcttcgtttctgacggcgcacaatgcgcaaccgacggttacggcgggtatcaacgttcaagcgtaaaacggttttggaaatgccgtctgaactgttcagacggcatttttgctgtttttggcaggact

SEQ ID NO: 2948 - protein, 130 aa, Neisseria gonorrhoeae
LIKNYQDKPCMPTLQCEPFLFIFAYDNKSRYRYDSLRTHGAQNVCLHLQCRYRPSNQGNHRCRRDHNGRFAVAIGRGELLRLLRGACRFVSDGAQCATDGYGGYQRSSVKRFWKCRLNCSDGIFAVFGRT

SEQ ID NO: 2949 - DNA, 261 bp, Neisseria gonorrhoeae
gtgtgcaaattgacagataaggaaacgcggatgaaattgaccttgatgtttcgtgaatattgcagcttgtgccacaaaatgcgcgatgcactcaaaccttttcaggatgaatacgggttcgggctggaagtggtcgatgtggatgaaaatcctgttttggaagaaaaatacaatgagctgattcccgttttgttggcgggagatgaggaaatttgccactggtttttggatgaggacaggttgaaacagtttctcgaacgg

SEQ ID NO: 2950 - protein, 87 aa, Neisseria gonorrhoeae
VCKLTDKETRMKLTLMFREYCSLCHKMRDALKPFQDEYGFGLEVVDVDENPVLEEKYNELIPVLLAGDEEICHWFLDEDRLKQFLER

SEQ ID NO: 2951 - DNA, 351 bp, Neisseria gonorrhoeae
atgtcttcgaggaagatgatactcaagtcctgccaaaaacagcaaaaatgccgtctgaacagttcagacggcatttccaaaaccgttttacgcttgaacgttgatacccgccgtaaccgtcggttgcgcattgtgcgccgtcagaaacgaagcggcaagctccccgcagcagccgcagcagctcgccacgcccaattgcgactgcaaatcgcccattgtggtcgcgccggcagcgatggtttccttgatttgatggtcggtaacggcattgcagatgcagacaaacattttgtgctccgtgtgttctcaaactatcgtaccgatagcggcttttattatcgtatgcaaata

SEQ ID NO: 2952 - protein, 117 aa, Neisseria gonorrhoeae
MSSRKMILKSCQKQQKCRLNSSDGISKTVLRLNVDTRRNRRLRIVRRQKRSGKLPAAAAAARHAQLRLQIAHCGRAGSDGFLDLMVGNGIADADKHFVLRVFSNYRTDSGFYYRMQI

SEQ ID NO: 2953 - DNA, 267 bp, Neisseria gonorrhoeae
gtgcttcctttaccggcaggtcatcagccccacaaaaacgtaaagaacgttgatttgaaaaaaatgccgtctgaagtcctgcttcagacggcattttttaccgttcgagaaactgtttcaacctgtcctcatccaaaaaccagtggcaaatttcctcatctcccgccaacaaaacgggaatcagctcattgtatttttcttccaaaacaggattttcatccacatcgaccacttccagcccgaacccgtattcatcctgaaaaggtt

SEQ ID NO: 2954 - protein, 89 aa, Neisseria gonorrhoeae
VLPLPAGHQPHKNVKNVDLKKMPSEVLLQTAFFTVRETVSTCPHPKTSGKFPHLPPTKRESAHCIFLPKQDFHPHRPLPARTRIHPEKV

SEQ ID NO: 2955 - DNA, 132 bp, Neisseria gonorrhoeae
ttgaccctttctttattttatttgtcggttgggagaattcttaatttattgattttttcaataaaaattagaaaatttattgtgagatgtcattgttggcaatcatatcatgttttgctgttgatggaagca

SEQ ID NO: 2956 - protein, 44 aa, Neisseria gonorrhoeae
LTLSLFYLSVGRILNLLIFSIKIRKFIVRCHCWQSYHVLLLMEA

SEQ ID NO: 2957 - DNA, 318 bp, Neisseria gonorrhoeae
atgaggcaaacgtgccttttaagaaagggagagcaaatgaaattgttggccgcattgattccgctcttgatgagcgtcgcaggccgtatattgactgcattaggcttgatggctgttacctatgcgggtgtagatagattggcagcccattttcaacaggcgataacccatagcataacgggcgcgcctcaagcaatgttacagcttttctatataagcggcggtggtactgttctaaacattcttttcggcgcaatcgcctttattctgtcctttaaacaaatgacaaaactcgcaacctcaatcgggaagaaaaaa

SEQ ID NO: 2958 - protein, 106 aa, Neisseria gonorrhoeae
MRQTCLLRKGEQMKLLAALIPLLMSVAGRILTALGLMAVTYAGVDRLAAHFQQAITHSITGAPQAMLQLFYISGGGTVLNILFGAIAFILSFKQMTKLATSIGKKK

SEQ ID NO: 2959 - DNA, 861 bp, Neisseria gonorrhoeae
atgagaatcctattgacaggctcgaaaagccaactggcacactgcctgcgcgaccgtcttcctgaagactgggaaaccattgcgacggattccgcatccctagacattaccgatgccgatgccgtctgcaacatggtcaaaagtttccaacccgacgctattgtcaacacggctgcctatactgccgtcgacaaagcggaaggcgatgcggcagcggcatttgccgtcaatgcttccgccgtttacaaccttgccttggcagcacatcgcgcccatgcccgattcatccacatctcaaccgactatgtctttgacggaaaagggaaaataccctatcaggaaagcgactttaccaacccttccaatgtatacggacaatccaaaaccgccggcgaactgctcgcactgtctgccaatcccgacagccttatcctgcggacttcttggctgtttagcgaatacggggacaactttgtccgcacgatgctgaaccttgcgcgggaacgttccccgctgtccgccgtccacaaccaaatcggctgcccgacctatgccggcgacttgtccgccgccatcatccgcctgttgcagcagtccaatcccgttcgcggcatttaccactacgccggcggcaaatccgtatcctggtacgaatttgcccggcacatctttcagacggcattgcaacaggatgcctcttttcccgttcccgaactgaaagccgtttcggatgaaggctctgcggctgccgcccccaggcccgcatacagcattttggactgccgcaaaatcgaaaacgacttcggcatcaaaccgtcagactggcaaaaagcccttgcacaggtcgtttccaagctgctc

SEQ ID NO: 2960 - protein, 287 aa, Neisseria gonorrhoeae
MRILLTGSKSQLAHCLRDRLPEDWETIATDSASLDITDADAVCNMVKSFQPDAIVNTAAYTAVDKAEGDAAAAFAVNASAVYNLALAAHRAHARFIHISTDYVFDGKGKIPYQESDFTNPSNVYGQSKTAGELLALSANPDSLILRTSWLFSEYGDNFVRTMLNLARERSPLSAVHNQIGCPTYAGDLSAAIIRLLQQSNPVRGIYHYAGGKSVSWYEFARHIFQTALQQDASFPVPELKAVSDEGSAAAAPRPAYSILDCRKIENDFGIKPSDWQKALAQVVSKLL

SEQ ID NO: 2961 - DNA, 1041 bp, Neisseria gonorrhoeae
ttggtgaaagtgtattgtaggacttgctgtcggtattatagtgccaaaactttgccgacggttgacgggttggctttttgtgccatgggtattgttttgcgccgacttcggctagaatatcggtttgcgattcaaacctgtcgggtcggtattttcaagatattttcaggggggtgcgaaatgagtgagattggtttggtaaagatttattccggaaaagtgcgcgatttatatgaaatcgacgataaacgtatgctgatggtcgcttccgaccgcctgtccgcgtttgatgtgattttggacgccccgattccgggtaagggcgaaatcctgacgcagatttccaatttttggtttaaaaaactggcgcatattatgcccaaccatttcaccggcgataccgtgtacgatgttttgcctgaaaacgaagccaaagctttggaaaaacgcgccgttgtagctaaaaaactcactccggtgaaagtggaggccattgtgcgcggttatctggcaggcagcggttggaaagattatcaaaaaaccggctcggtttgcggtattcggctgcccgaaggtatgcgggaagcgcaacaactacccgaagtgatttttacgccctcaactaaagccgcagtcggcgatcacgatgaaaacatcagctttgaagaatgcggacgcattatcggtaaagaattggcggaagaagtgcgcgacaaagcggttcggctttacaccgaagcggcggaatatgccaaatcgcgcggcatcatcatttgcgataccaaatttgaattcggtttggatgaagaaggtacgctgacgctgatggatgaggtattgactcccgattcgagccgcttctggccggcggatcaatatgaagtcggcaccaatccgccgtcttttgacaaacaattcgtccgcgactggctggaacaaagcggttggaacaaaaaagcccctgcgcctaaagtgcctgccgatgtaattcggaaaacggtcgagaaatatcaggaagcattgactttactgacacaagat

SEQ ID NO: 2962 - protein, 347 aa, Neisseria gonorrhoeae
LVKVYCRTCCRYYSAKTLPTVDGLAFCAMGIVLRRLRLEYRFAIQTCRVGIFKIFSGGCEMSEIGLVKIYSGKVRDLYEIDDKRMLMVASDRLSAFDVILDAPIPGKGEILTQISNFWFKKLAHIMPNHFTGDTVYDVLPENEAKALEKRAVVAKKLTPVKVEAIVRGYLAGSGWKDYQKTGSVCGIRLPEGMREAQQLPEVIFTPSTKAAVGDHDENISFEECGRIIGKELAEEVRDKAVRLYTEAAEYAKSRGIIICDTKFEFGLDEEGTLTLMDEVLTPDSSRFWPADQYEVGTNPPSFDKQFVRDWLEQSGWNKKAPAPKVPADVIRKTVEKYQEALTLLTQD

SEQ ID NO: 2963 - DNA, 213 bp, Neisseria gonorrhoeae
atgtttcagacggcctttttattgtatcaatactggattttaaggatggttgcctttataatccgcaattgctttcagcgtccgaaatgccgtctgaaagcttgtttacaacctgccgcacggtctgaaaccctaactatgcacattcggattttagtgtgcattattagtgttttagcagtgcggtattttgaaaggaacaatgatgttcaa

SEQ ID NO: 2964 - protein, 71 aa, Neisseria gonorrhoeae
MFQTAFLLYQYWILRMVAFIIRNCFQRPKCRLKACLQPAARSETLTMHIRILVCIISVLAVRYFERNNDVQ

SEQ ID NO: 2965 - DNA, 2133 bp, Neisseria gonorrhoeae
ttgaaaggaacaatgatgttcaataaatacgttaagaccttccaatacggtaatcaaaccgttactttggaaaccggcgaaattgcccgccaagctgccgctgccgttaaagtatcgatgggcgacactgttgtttttgttgccgttaccaccaacaaagaggtcaaagaaggtcaggacttcttcccgttggccgtcgattatttggaacgcacttatgccgcaggcaaaatccccggcggcttcttcaaacgcgaaggcaaacaaagcgaaaaagaaatcctgaccagccgtctgatcgaccgcccgattcgtccgctgttccccgaaggtttctaccacgacatccaaatcgtagcgatggttgtgtccgtcgatcccgaaatcgattccgacattcctgcaatgttgggcgcgtccgccgcgctggtgttgagcggcgtaccgttcgccggcccgattggcgcggcgcgcgtgggttatataaacggcgtgtacgttttgaacccgactaaagccgagttggcgaaatcacaattggacttggtggtcgccggtacttccaaagccgtgttgatggtggaatccgaagccaaaatcctgcccgaagacgtgatgttgggcgcggtggtttacggccacgatcaaatgcaggttgccatcaatgcaatcaatgaatttgccgacgaagtgaatccggaagtttgggattggaaagcacctgaaaccaatgaagaactggttgccaaagtacgcgggattgccggcgaaaccattaaagaagcgttcaaaatccgtcaaaaacaagcgcgttccgccaaattggacgaggcttggaatgcggtaaaagaagccttgattaccgaagaaaccgacacgctggcagccaacgaaatcaaaggtattttcaaacgcttggaagccgatgtcgtccgcagccaaattttggacggacaaccgcgcatcgacggccgcgacacccgcaccgtccgtccgctgaacatccaaaccggcgtattgccgcgcacgcacggttccgcactgtttacccgtggcgaaacccaagcccttgccgtagcgactttgggtacttcgcgcgacgaacaaatcatcgacgcgttgtccggcgaatataccgaccgctttatgctgcactacaactttccgccgtactctaccggcgaagtgggccgcatgggcgcgccgaaacgccgtgaaatcggtcacggccgtttagctaaacgtgcgttgttggccgtattgccgaaacctgaagatttcagctacaccatgcgcgtggtctccgaaattaccgaatccaacggctcttcctctatggcttctgtctgcggcggctgtttgagcctgctgtctgccggcgtgcctttgaaagcacacgttgccggtatcgcgatgggtctgattttggaaggcaataagtttgccgtcctgaccgacattttgggcgacgaagaccacttgggcgatatggactttaaagtggccggtacgaccgaaggcgttaccgcgctgcaaatggacatcaaaatccaaggcattaccaaagagattatgcaaattgctttggcacaggccaaagaagcgcgtttgcacatcttggatcagatgaaagctgccgttgcgggtccgcaagagctgtccgcacacgcgccgcgtttgttcaccatgaaaatcagccaagacaaaatccgtgatgtgattggtaaaggcggcgaaaccattcgttcgattaccgctgaaaccggtactgaaatcaatatcgctgaagacggtaccatcactatcgctgcgactactcaagaagcgggcgatgcagcgaaaaaacgcatcgaagaaatcactgccgaagtggaagtgggcaaagtgtacgaaggtactgtggttaaaatcctcgacaacaacgtcggcgcgattgtcagcgtgatgccgggcaaagacggtttggtacacatcagccaaatcgcacacgagcgcgtacgcaatgtcggcgattacctgcaagtcggtcaggtggtgaacgtgaaagcattggaagtggatgacagaggccgtgtccgtctgtccatcaaagccctgctggatgcgcctgtccgtgaagaaaatgccgccgag

SEQ ID NO: 2966 - protein, 711 aa, Neisseria gonorrhoeae
LKGTMMFNKYVKTFQYGNQTVTLETGEIARQAAAAVKVSMGDTVVFVAVTTNKEVKEGQDFFPLAVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYINGVYVLNPTKAELAKSQLDLVVAGTSKAVLMVESEAKILPEDVMLGAVVYGHDQMQVAINAINEFADEVNPEVWDWKAPETNEELVAKVRGIAGETIKEAFKIRQKQARSAKLDEAWNAVKEALITEETDTLAANEIKGIFKRLEADVVRSQILDGQPRIDGRDTRTVRPLNIQTGVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKISQDKIRDVIGKGGETIRSITAETGTEINIAEDGTITIAATTQEAGDAAKKRIEEITAEVEVGKVYEGTVVKILDNNVGAIVSVMPGKDGLVHISQIAHERVRNVGDYLQVGQVVNVKALEVDDRGRVRLSIKALLDAPVREENAAE

SEQ ID NO: 2967 - DNA, 597 bp, Neisseria gonorrhoeae
atgtgcggcggattaagcagcgcgtttgcgctccaactccccccgcatatcaaccgcttttggctgattctgctgcttaacacaggacggataagcagctatacggcaatcggcctgatgctcggattaatcggacaactcggcatttcactcgaccaaacccgcgtcctgcaaaatattttatacacagcctccaacctcctgctgctctttttaggcttatacttgagcggtatttcttccttggcggcaaaaatcgagaaaatcggcaaaccgatatggcgcaacctgaacccgatactcaaccggctgctgcccataaaatccatacccgcctgccttgctgtcggaatattatggggctggctgccgtgcggactggtttacagcgcatcactttacgcgctgggaagcggtagtgcgacaaccggcggactgtatatgcttgcctttgcactgggtacgctgcccaatcttttggcaatcggcattttttccctgcaactgaaaaaaatcatgcaaaaccgatatatccgcctgtgtacaggattatccgtatcattatgggcattatggaagcttgccgtcctgtggctg

SEQ ID NO: 2968 - protein, 199 aa, Neisseria gonorrhoeae
MCGGLSSAFALQLPPHINRFWLILLLNTGRISSYTAIGLMLGLIGQLGISLDQTRVLQNILYTASNLLLLFLGLYLSGISSLAAKIEKIGKPIWRNLNPILNRLLPIKSIPACLAVGILWGWLPCGLVYSASLYALGSGSATTGGLYMLAFALGTLPNLLAIGIFSLQLKKIMQNRYIRLCTGLSVSLWALWKLAVLWL

SEQ ID NO: 2969 - DNA, 336 bp, Neisseria gonorrhoeae
ttgttaccccttacaagaaacacaatgtcccgcctgttcctgctgcttttcccttgggcaacccttgccgcctgcacccgaaacataccggcaagccccgccgtttcaaattgcgcgcatcttcacaaccgcaccgtcctgtattttgacgcacacggcaaacccgccgacagcacagcaaagggcggattttacaggaccgtcgaaattcatgacacaaaccgcatccttattcaagactttaacagcacggggaatgccctcgtcaaaccctattggtcggactgccggaaattgtccgttttccccgacaaacatctgaccatgagccatcca

SEQ ID NO: 2970 - protein, 112 aa, Neisseria gonorrhoeae
LLPLTRNTMSRLFLLLFPWATLAACTRNIPASPAVSNCAHLHNRTVLYFDAHGKPADSTAKGGFYRTVEIHDTNRILIQDFNSTGNALVKPYWSDCRKLSVFPDKHLTMSHP

SEQ ID NO: 2971 - DNA, 405 bp, Neisseria gonorrhoeae
ttgcttccgaatccgaaatccccgagcccgaagggaaatgcttccatctcccgccgcctgaggattaaaatgagccattatactgtttgttaccccttacaagaaacacaatgtcccgcctgttcctgctgcttttcccttgggcaacccttgccgcctgcacccgaaacataccggcaagccccgccgtttcaaattgcgcgcatcttcacaaccgcaccgtcctgtattttgacgcacacggcaaacccgccgacagcacagcaaagggcggattttacaggaccgtcgaaattcatgacacaaaccgcatccttattcaagactttaacagcacggggaatgccctcgtcaaaccctattggtcggactgccggaaattgtccgttttccccgacaaacatc

SEQ ID NO: 2972 - protein, 135 aa, Neisseria gonorrhoeae
LLPNPKSPSPKGNASISRRLRIKMSHYTVCYPLQETQCPACSCCFSLGQPLPPAPETYRQAPPFQIARIFTTAPSCILTHTANPPTAQQRADFTGPSKFMTQTASLFKTLTARGMPSSNPIGRTAGNCPFSPTNI

SEQ ID NO: 2973 - DNA, 90 bp, Neisseria gonorrhoeae
ttgttccgaaatcccgtattgtctgttgcttccgaatccgaaatccccgagcccgaagggaaatgcttccatctcccgccgcctgaggat

SEQ ID NO: 2974 - protein, 30 aa, Neisseria gonorrhoeae
LFRNPVLSVASESEIPEPEGKCFHLPPPED

SEQ ID NO: 2975 - DNA, 1443 bp, Neisseria gonorrhoeae
cagcgtgttctccaacgccttggcgcaccagtcgataacggtttgcggcataatgccccacagcaccaacagcagcgcgttgacgcttaagagggattttgcggcattgttgccgccggcggcgggacgggcgcggccggattcgtcaaaatacatgactttgaccacgcgcaggtagtagaacgcgccaaccagcgacatcacgacggcaaacaccgacaaccatacatagccttgtttcaaaagcgccataataacgccgaatttggcgtaaaaacccatcagcggcggaatgcccgccatagagaacataaccagcagcatcaaaaaggcaagccatacgcggtgttggttcaaccctgccaaatcgctgatgttttcgcactcgttgtccccgtccgacaacaccatcaacacgccgaaccctgccgccgccatcagcgcgtaggtaatggcgtaatagaggcccgccgcaaagccgaccgcgcccgccataaacgccaacaggatgaaacccatatgcgatacggtggaataggcgagcatacgtttgatattggtctgcatgatggcggcaaggttgccgaccagcagcgaggcggcggcaagcagggcaaacatcagagaccagtcatgatgcacggttcccagcccggtaacgaggatgcggaaagcgaaaacgacggcggcgattttcggggcagtgccgaccaaggcggtaacagaagtgggcgcgccgtgatacacgtcgggcatccacatatggaacggtaccgcgccgagtttgaacgcaacggcgacgacgataaacaccagacccagtttcaacagccattcgttagcttcttcattgaaggaagaggcgagcacgccggcaaattccagcgaaccggttgcgccgtaaaccatagaaataccgtagagcagcaggccggatgccagcgcgcccagaacaaaatatttcaaggcggcttcggcggcaaaaccggaatcgcggcgcagggcaatcagggcgtaaagggcgagcgacaagagttccaaaccgatataggcagttaaaaaatgccccgcgctcaccatcacgctcatgcccaagagggcaaacagcgacagggtgtaaaactcgcctttgaaaataccgcgcacttggttgtagggcttggcatagacaaacaggacaaacgtcaaggcatataaaaccatttttgccaaacgcgacataccgtccgcaatatacatcccgttgaacgaagacgtgctgccctgttcccacacggcaagctgcaccgccgccgtaaccgccaccgttgccaacgcgccgtaatgcgtccaacggcatttgtcatcactggcccacaagtccgccggcaacaataacaccagcagcgacagcagcgcgacttcgggcagtgcgggcattaaattcaaatctgaccaattcat

SEQ ID NO: 2976 - protein, 29 aa, Neisseria gonorrhoeae
QRVLQRLGAPVDNGLRHNAPQHQQQRVDA

SEQ ID NO: 2977 - DNA, 1407 bp, Neisseria gonorrhoeae
atggatacacaaatcaaaactgaagccggtcagcagaataaccggcattatctgagcgtttggaggtggcatttttatgccggtttattggttatgcccttcttgaccctgcttgccgttacaggtttgggtatgctgttgtttgccaatattaccggtaaagagggagagcgtattcacgtcttccctcaggcagtggtgcaacccctctctgttcaggcagaagcggcacgcggtgccattaatccggagacttcgtccgtcgtccaatatattgcaccgcgtgccgatgatatggttgctgtgttccgtgtcaacaatgagggtaaggcaaccatggttgcggtggatccttatacggcaaaagtggtcaacaccatgccgcgcaatcagggttggtatcacactatggatgaaatccacggcgatatgatgctcggtgcggcaggcgattatcttttggaaacggcagcttcactgaccattattatggttgtcagcggcttgtacctttggtgggcgaaacagcgcggcattaaagcgatgctgctgccgccaaaaggcagggcgcgttcttggtggcggaatctgcacggcgcgtttggaacttgggtgtcgttgattttactgttgttctgcctgtcgggtattgcttgggcaggtatttggggcggcaagttcgtgcaggcttggagtcagttcccggccggcaaatggggtgtcgaaccgaaccccgtttcagtcgtgccgacccacggcgaggtattgaatgacggcaaggttaaggaagtgccgtggattttggagcttatgcctatgcctgtctcagggacgactgtgggtgaaaacggcattaaccccagcgagccgatgacattggaaaccgtcgaccgtttcgcgcgggaaatcggtttcaaagggcgttatcagttgaatttgcccaaaggcgaggacggggtatggactttgtcgcaggattctatgagttatgacatgatcagcccgtttgccgaccgcacggtacatatcgaccagtacagcggcaagattcttgccgacatccgttttgacgattacaacccgttcggcaaatttatggcggcaagcattgcgctgcatatggggactttgggctggtggagcgtgttggcgaacgtcgtgttctgccttgccgtgatttttatcggcatcagcggctgcgtgatgtggtggaaacgccgtccgtccggcgtggcgggcattgttcctccggcgcaaaaaatcaaactgcccgtctggtgggcgatggcattgccgctgctgttgattgcactgcttttcccgaccgcgctgcttgccattgccgtgatttggctgttggataccttgctgctgtcgcggattcctgtgttgaggaaatggtttaaa

SEQ ID NO: 2978 - protein, 469 aa, Neisseria gonorrhoeae
MDTQIKTEAGQQNNRHYLSVWRWHFYAGLLVMPFLTLLAVTGLGMLLFANITGKEGERIHVFPQAVVQPLSVQAEAARGAINPETSSVVQYIAPRADDMVAVFRVNNEGKATMVAVDPYTAKVVNTMPRNQGWYHTMDEIHGDMMLGAAGDYLLETAASLTIIMVVSGLYLWWAKQRGIKAMLLPPKGRARSWWRNLHGAFGTWVSLILLLFCLSGIAWAGIWGGKFVQAWSQFPAGKWGVEPNPVSVVPTHGEVLNDGKVKEVPWILELMPMPVSGTTVGENGINPSEPMTLETVDRFAREIGFKGRYQLNLPKGEDGVWTLSQDSMSYDMISPFADRTVHIDQYSGKILADIRFDDYNPFGKFMAASIALHMGTLGWWSVLANVVFCLAVIFIGISGCVMWWKRRPSGVAGIVPPAQKIKLPVWWAMALPLLLIALLFPTALLAIAVIWLLDTLLLSRIPVLRKWFK

SEQ ID NO: 2979 - DNA, 849 bp, Neisseria gonorrhoeae
atgaaaactttgaaatttaccaaaatgcacggtttgggcaacgattttatggtgattgacgcggtcagtcaggattttacccccgaggacgtgccgattgcggcatgggcggaccgcttccggggcgtgggcttcgaccagcttttggtggtcgggtgttcggaaaccgaaggcgtggatttccgttaccgtattttcaatgccgacggtagcgaggtcgggcaatgcggcaacggagcgcgttgttttgcccgttttgttgcagacaagggtttgaccgataagaaagaaatttgtgttgaaacggccaagggcattatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaatcctcatgctgtgattgtagtcgatgacgtggaatgcgcgccggtgcgcgaaaccggttcgcgtatcgaaccgcacaggcagtttcccgaacgcgtcaacgtcggctttatgcaggttgtcggacggacggcaatccgtttgcgcgtgttcgagcgcggcgtgggcgaaacccaagcgtgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaaaccgtgtttgaaggcgagttggcgtattca

SEQ ID NO: 2980 - protein, 283 aa, Neisseria gonorrhoeae
MKTLKFTKMHGLGNDFMVIDAVSQDFTPEDVPIAAWADRFRGVGFDQLLVVGCSETEGVDFRYRIFNADGSEVGQCGNGARCFARFVADKGLTDKKEICVETAKGIIFPKLSDNGMVTVNMGKPKFMPSEIPFVPESGEGDDACIYGVHLESGIQPVSCVNMGNPHAVIVVDDVECAPVRETGSRIEPHRQFPERVNVGFMQVVGRTAIRLRVFERGVGETQACGTGACAAVVAGIRLGLLDEGKTVEVVLPGGTLYIEWACGGDVMMTGPAETVFEGELAYS

SEQ ID NO: 2981 - DNA, 603 bp, Neisseria gonorrhoeae
atgattttgctgcatttggattttttgtctgccttactgtatgcggcggtttttctgtttctgatattccgcgcaggaatgttgcaatggttttgggcgagtattgcgttgtggctcggcatctcggttttaggggtaaagctgatgccggggatgtggggaatgacccgcgccgcgcctttgttcatcccccatttttacctgactttgggcagcatattttttttcatcgggtattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcattgctcaaactttatgcgctgaagccggtttattggttcgtgttgcagtttgtattgatggcggttgcctatgtccaccgctgcggtatagaccggcagccgccgtcaacgttcggcggttcgcagctgcgactcggcgtgttggcggcgatgttgatgcaggttgcggtaacggcgatgctgcttgccgaaatcggcaga

SEQ ID NO: 2982 - protein, 201 aa, Neisseria gonorrhoeae
MILLHLDFLSALLYAAVFLFLIFRAGMLQWFWASIALWLGISVLGVKLMPGMWGMTRAAPLFIPHFYLTLGSIFFFIGYWNRKTDGNGWQADPEHPLLGLFAVSNVSMTLAFVGICALVHYCFSGTVQVFVFAALLKLYALKPVYWFVLQFVLMAVAYVHRCGIDRQPPSTFGGSQLRLGVLAAMLMQVAVTAMLLAEIGR

SEQ ID NO: 2983 - DNA, 216 bp, Neisseria gonorrhoeae
ttgccgaaatcggcagatgattgtgatgccgtctgtatcggaacaaaaagttataaagaaataaattttgggtattggttttttaggcggcataggtttaggataaagccatatccgaaatttgtttatggttcggcgcaaatcccctgcaatcggacaggataccgatggggattgcgccttactgtcgaaaccttattattcaggagcagaaga

SEQ ID NO: 2984 - protein, 72 aa, Neisseria gonorrhoeae
LPKSADDCDAVCIGTKSYKEINFGYWFFRRHRFRIKPYPKFVYGSAQIPCNRTGYRWGLRLTVETLLFRSRR

SEQ ID NO: 2985 - DNA, 591 bp, Neisseria gonorrhoeae
atgaaaattgcaaacagcatcaccgaattgatcggcaacacgcctttggtcaaactgaaccgtttgaccaaaggtttgaaggcagaggttgccgtgaaactggaattttttaatccgggcagcagcgtcaaagaccgcattgccgaagcaatgatcgaggccgccgaaaaagcgggaaaaatcaacaaaaacaccgtcattgtcgaagcaaccagcggcaatacgggtatcggtttggcaatggtatgtgccgcacgcggctacaaactggcgattaccatgccggaaagcatgagcaaagagcgcaaaatgctgttgcgcacgtttggcgcggaactgattctaacccccgccgccgaaggtatggcgggcgcgattgccaaagcgcaatccttggtggacgctcatccagacacttattttatgccgcgccagttcgacaatgaggcaaatcccgaagtccaccgcaaaacaaccgccgaggaaatttggaacgataccgacggtgaagtcgatgtcttcgttgccggcgtcggcacgggcggtacgattaccggcgtgggcgaagtgttgaaaaaatacaaaccaaat

SEQ ID NO: 2986 - protein, 197 aa, Neisseria gonorrhoeae
MKIANSITELIGNTPLVKLNRLTKGLKAEVAVKLEFFNPGSSVKDRIAEAMIEAAEKAGKINKNTVIVEATSGNTGIGLAMVCAARGYKLAITMPESMSKERKMLLRTFGAELILTPAAEGMAGAIAKAQSLVDAHPDTYFMPRQFDNEANPEVHRKTTAEEIWNDTDGEVDVFVAGVGTGGTITGVGEVLKKYKPN

SEQ ID NO: 2987 - DNA, 300 bp, Neisseria gonorrhoeae
ttgagcggcggcgaaaaaggtccgcacccgattcaaggtatcggcgcaggttttattccgaccgttttgaataccaaaatctacgacagcattgccaaagtgccgaacgaagcggcttttgaaaccgcccgtgcaatggcggaaaaagaaggcattttggcgggcatttcttccggtgcggcggtttggagcgcgttgcagcttgccaaacagcctgaaaacgaaggcaagctgatagtcgtgctgctgccttcttatggcgaacgctatctttctacgccactttttgcagatttggca

SEQ ID NO: 2988 - protein, 100 aa, Neisseria gonorrhoeae
LSGGEKGPHPIQGIGAGFIPTVLNTKIYDSIAKVPNEAAFETARAMAEKEGILAGISSGAAVWSALQLAKQPENEGKLIVVLLPSYGERYLSTPLFADLA

SEQ ID NO: 2989 - DNA, 99 bp, Neisseria gonorrhoeae
ttgcaacatatgaaaaaagattcaattttgaagaaacaaacctatatgccgtctgaaagcatcaaacaatgctgtccgacacccaactgcaccattctt

SEQ ID NO: 2990 - protein, 33 aa, Neisseria gonorrhoeae
LQHMKKDSILKKQTYMPSESIKQCCPTPNCTIL

SEQ ID NO: 2991 - DNA, 1185 bp, Neisseria gonorrhoeae
atggcagaaatctgtttgataaccggcacgcccggttcagggaaaacattaaaaatggtttccatgatggcaaacgatgaaatgtttaagccagatgaaaacggcgtacgccgtaaagtatttacgaacatcaaaggtttgaagataccgcacacccacatagaaacagacgcaaagaagctgccgaaatcaaccgatgaacagctttcggcgcatgatatgtatgaatggatcaagaagcctgaaaacgtcggcgcaatcgttattgtcgatgaggcgcaagacgtatggcccgcacgctccgcaggttcgaaaatccccgaaaacgtccaatggctgaacacacacaggcatcagggcatagatatatttgtattgacacaaggtcctaaactcttagatcagaacttgcgaacattggttaaaagacattaccacattgcggccaacaaaatgggtttgcgtaccctgcttgaatggaaagtatgcgcggatgacccggtaaaaatggcatcaagtgcattttccagtatctacacactggataaaaaagtttatgacttgtacgaatccgcagaaattcacacggtaaacaaagtcaagcgttcaaaatggttttatgcattgcccgtcatcatattattgattccgctatttgtcggtttgtcttacaaaatgttgggcagttacggaaaaaaacaggaagaacccgcagcacaagaatcggcggcaacagaacagcaggcagtacttccggataaaacagaaggagaatcggtgaataacggaaaccttacggcagatatgtttgttccgacattgcccgaaaaacccgaaagcaagccgatttataacggtgtaaggcaggtaaggacctttgaatatatagcaggctgtatagaaggcggaagaaccggatgcacctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccaccttgggcggaaaaccgcagcagaacctaatgtacgacaattgggaagaacgcgggaaaccgtttgaaggaatcggcgggggcgtggtcggatcggcaaac

SEQ ID NO: 2992 - protein, 395 aa, Neisseria gonorrhoeae
MAEICLITGTPGSGKTLKMVSMMANDEMFKPDENGVRRKVFTNIKGLKIPHTHIETDAKKLPKSTDEQLSAHDMYEWIKKPENVGAIVIVDEAQDVWPARSAGSKIPENVQWLNTHRHQGIDIFVLTQGPKLLDQNLRTLVKRHYHIAANKMGLRTLLEWKVCADDPVKMASSAFSSIYTLDKKVYDLYESAEIHTVNKVKRSKWFYALPVIILLIPLFVGLSYKMLGSYGKKQEEPAAQESAATEQQAVLPDKTEGESVNNGNLTADMFVPTLPEKPESKPIYNGVRQVRTFEYIAGCIEGGRTGCTCYSHQGTALKEVTELMCKDYVKNGLPFNPYKEESQGQEVQQSAQQHSDRAQVATLGGKPQQNLMYDNWEERGKPFEGIGGGVVGSAN

SEQ ID NO: 2993 - DNA, 177 bp, Neisseria gonorrhoeae
gtgcttgggcgccttagggaaccgttccctttgagccggggcggggcaacgccgtaccggtttttgttaatccgccatattgtgttgaaacaccgcccggaacccgatataatccgcccttcaacatcagtgaaaatcttttttttaaccggtcaaaccgatataaggagccgaaaa

SEQ ID NO: 2994 - protein, 59 aa, Neisseria gonorrhoeae
VLGRLREPFPLSRGGATPYRFLLIRHIVLKHRPEPDIIRPSTSVKIFFLTGQTDIRSRK

SEQ ID NO: 2995 - DNA, 693 bp, Neisseria gonorrhoeae
ttgaaaaaattttataaaaatatttatcatattgttttaattgatttatatctattaacctgcttttgccatataaaattcttccagtgcatgagagatattttcggcctgccatgcatttttcaaaggtgcggtaatttcgatttcttgttgttgataggtaaattgtatttttcacgcatacaggaacatagtttcggattctgttcctctatacaggctgtccccaaatatagagctgcccagactcttcattaccaccctcaactgatgtgtcttacccgtatgtggctcaaggatgaacagccgcattttttcactgatgcggatactgaaaaaccgggtaacggcaatattttccatattgcgcgtcagcttccacatcccgcgcctggatttttccatgccgccttttatccatccttgttttttggacggtttgcggtcggacaaagccaaatagcttttcttcattttcctttcggcaaactgtgcggcaagaacagcggcactttgggaattaagggcaaacagcaatatgcctccggcctgcttgtccaacctgtgcagcaaccataccttttctacgcccaactgtgccgcaagtgttgccgtcagactgacttcgccgccggaacggtggacggatatgccttgaggtttattgatggcgacaaaatcttggtgtctgaa

SEQ ID NO: 2996 - protein, 231 aa, Neisseria gonorrhoeae
LKKFYKNIYHIVLIDLYLLTCFCHIKFFQCMRDIFGLPCIFQRCGNFDFLLLIGKLYFSRIQEHSFGFCSSIQAVPKYRAAQTLHYHPQLMCLTRMWLKDEQPHFFTDADTEKPGNGNIFHIARQLPHPAPGFFHAAFYPSLFFGRFAVGQSQIAFLHFPFGKLCGKNSGTLGIKGKQQYASGLLVQPVQQPYLFYAQLCRKCCRQTDFAAGTVDGYALRFIDGDKILVSE

SEQ ID NO: 2997 - DNA, 996 bp, Neisseria gonorrhoeae
ccttgccgcagccttgccgtaaatgccttcaagacatgcggctatgcggccggaggcgtctttgtccgcatatccccgcaacacttcgagggctgcgacggatcttttcaggattgaacgggtttcgtgccaaaccgtccacatcgtaaccgcctgtttgcagccgagctgcttcagcggcgcggaaacgtctttgcccaattcgatcatccgtgtgccgtaataaaccatagcggcaatgtcggccaaagcgttgccgcttatgggcagggcgggttgcggcgcgggcaacggttcgcggtcggggacttcgccggccaaacccgtgtgcagtgtcaatgcgtggacgtaggcgacggcttcgggcagtttgtcggcggggatgccttcgacggcttcgacgttgaagcgttggtgtatcatactgtacgcggaggagtagcctatgcgtttgcgcccgacaagcgcggcaaccgcccggcgcaatccggtacggtcgtcggcggtggttttgggagtaatttggtagccgcctgttttgcggatttgagggataacctcttcaaatatccagtcttggaatttgacggcttcggctttgcgtgaacggaagatgactcggtagagattcggctcgttgatgaaaagtaattcttggttgcctttttttgttgcaacgctggatttttgaatgccctggtcttttaatggcaactgacgggcattttgaatttgaagaatttccgcaacatcgccaaggcaaaaccaaggttcagcccccaagatttgagtacggacattttgagatttgaaagaaaatacagaaatggtgttttgcattttaagctccacgaaagtttgaaagcctctcttcgaccaagaagaggtaggcggacgtttcaggttggtcgactgctcgtggaaacagcacatccggagatgtcccgaaagtccgcccgttggctttttcagcaagggtgtatgtttaacatacac

SEQ ID NO: 2998 - protein, 38 aa, Neisseria gonorrhoeae
PCRSLAVNAFKTCGYAAGGVFVRISPQHFEGCDGSFQD

SEQ ID NO: 2999 - DNA, 666 bp, Neisseria gonorrhoeae
atgcaaaaacgcattttccggcacggcgttacaccgataccgaaaaatgcgtctgaatgtttcgacaatccgattaaagcattatgccaaatctgcaaaaagtggcgtagaaagatagcgttcgccataagaaggcagcagcacgactatcagcttgccttcgttttcaggctgtttggcaagctgcaacgcgctccaaaccgccgcaccggaagaaatgcccgccaaaatgccttctttttccgccattgcacgggcggtttcaaaagccgcttcgttcggcactttggcaatgctgtcgtagattttggtattcaaaacggtcggaataaaacctgcgccgataccttgaatcgggtgcggacctttttcgccgccgctcaatacgggggaagcctcagcttcgacggcaacactttaatttggtttgtattttttcaacacttcgcccacgccggtaatcgtaccgcccgtgccgacgccggcaacgaagacatcgacttcaccgtcggtatcgttccaaatttcctcggcggttgttttgcggtggacttcgggatttgcctcattgtcgaactggcgcggcataaaataagtgtctggatgagcgtccaccaaggattgcgctttggcaatcgcgcccgccataccttcggcggcgggggt

SEQ ID NO: 3000 - protein, 222 aa, Neisseria gonorrhoeae
MQKRIFRHGVTPIPKNASECFDNPIKALCQICKKWRRKIAFAIRRQQHDYQLAFVFRLFGKLQRAPNRRTGRNARQNAFFFRHCTGGFKSRFVRHFGNAVVDFGIQNGRNKTCADTLNRVRTFFAAAQYGGSLSFDGNTLIWFVFFQHFAHAGNRTARADAGNEDIDFTVGIVPNFLGGCFAVDFGICLIVELARHKISVWMSVHQGLRFGNRARHTFGGGG

SEQ ID NO: 3001 - DNA, 345 bp, Neisseria gonorrhoeae
gtgccggaaaatgcgtttttgcatatataccgaaaacgccggttgtgttttaatcaggtgttggcgccgccgcattgcttgagggaaatattttttattcgggttttatccggcaggacggattttgccccaacggaaaatagccggcctgcccgtaaagtcagccgtttgtccgggcgcagccggggctttgggcttcagacggcatattttcggaatggcggcacttttgccggcggcgcggcagccatatggggaagggaggggatattgtggtcggtaacggaaaaaaatatgccgcaccattgctggtgctgggttgcgcggtgttcggattgggcagcc

SEQ ID NO: 3002 - protein, 115 aa, Neisseria gonorrhoeae
VPENAFLHIYRKRRLCFNQVLAPPHCLREIFFIRVLSGRTDFAPTENSRPARKVSRLSGRSRGFGLQTAYFRNGGTFAGGAAAIWGREGILWSVTEKNMPHHCWCWVARCSDWAA

SEQ ID NO: 3003 - DNA, 618 bp, Neisseria gonorrhoeae
gtgttcggattgggcagcctgattgtcagatccgtccccgtcggcccgtatgcaatcgcattttggcggttgctgatttcggtattggtattttggtttttggcacggtttttcggacaaaaattcccaaaaaacagaaaaaccgtccgatatgccctgacggcgggcgtgtttctcgctttcgatttggcactttggcacgaaagcatacacgcggtcgggccgggtatttccaccctgctcaacagcctgcaaatctttttcttgtcggcaatcggtgttttctttttcggcgagcgtttgggcaggctgcaggcggcaagcttgatgtcggcggttgtgggcgtggcgatgattgccggtgcggaattcggctacaacggtaatgcggtttggggattcgccagcggtttggtgtccgggctgatgcttgccctatctatggtgttcgtccgcaagactcatgaagtcgaacaggtggcgcttttcccttcaatgatgattttgagtttgggcggcgcggcatcgccgattgttccggcattgctgatggacggcggcgcactttatccgaccacttggaaagattcgggtttggtgcttgtgtacggggcgtgg

SEQ ID NO: 3004 - protein, 206 aa, Neisseria gonorrhoeae
VFGLGSLIVRSVPVGPYAIAFWRLLISVLVFWFLARFFGQKFPKNRKTVRYALTAGVFLAFDLALWHESIHAVGPGISTLLNSLQIFFLSAIGVFFFGERLGRLQAASLMSAVVGVAMIAGAEFGYNGNAVWGFASGLVSGLMLALSMVFVRKTHEVEQVALFPSMMILSLGGAASPIVPALLMDGGALYPTTWKDSGLVLVYGAW

SEQ ID NO: 3005 - DNA, 216 bp, Neisseria gonorrhoeae
gtggtgatgcagtgttttgcgtgggcgatggttgcctatgcgattccgctgctttccctgtcgctgacggggctgttgcttttgtccgaaccggtcgccgccctgttcatcgattatttcggattgggcaaaacgattgaaggcgtgcagtgggcaggggtggtgctgacgctttcggcgatttacctcggttcgctgaaacagccgtccgagctt

SEQ ID NO: 3006 - protein, 72 aa, Neisseria gonorrhoeae
VVMQCFAWAMVAYAIPLLSLSLTGLLLLSEPVAALFIDYFGLGKTIEGVQWAGVVLTLSAIYLGSLKQPSEL

SEQ ID NO: 3007 - DNA, 147 bp, Neisseria gonorrhoeae
ttggactggcaggcagtcaaaaccggcaagaccaaacatgccgacaacggcgcggagcggaaaatgccgtctgaagccctttcagacggcatcggggcgggcagaatcaaaaaagccgcctccgcaggaatggcaatgcaactaaaa

SEQ ID NO: 3008 - protein, 49 aa, Neisseria gonorrhoeae
LDWQAVKTGKTKHADNGAERKMPSEALSDGIGAGRIKKAASAGMAMQLK

SEQ ID NO: 3009 - DNA, 255 bp, Neisseria gonorrhoeae
gtgggcggcatatggaaatacggacattattttagttgcattgccattcctgcggaggcggcttttttgattctgcccgccccgatgccgtctgaaagggcttcagacggcattttccgctccgcgccgttgtcggcatgtttggtcttgccggttttgactgcctgccagtccaatcgtacgcaggtttgccacggcagaaaatctgatgccgaccggagtcaaagctcggacggctgtttcagcgaaccgagg

SEQ ID NO: 3010 - protein, 85 aa, Neisseria gonorrhoeae
VGGIWKYGHYFSCIAIPAEAAFLILPAPMPSERASDGIFRSAPLSACLVLPVLTACQSNRTQVCHGRKSDADRSQSSDGCFSEPR

SEQ ID NO: 3011 - DNA, 234 bp, Neisseria gonorrhoeae
atgtccgtatttccatatgccgcccacaccgtcagtcggacgaaatgccctttattcaatgggatgggtttccacacaaacggaaataaccggcttttcacttgccgacggataaaatcaaccgatgatttaaacacaggcaaatcatacgccgcccgaacgcatcatttttccaggcaatccatatgtgccgcccatatcgataatgccggcaaggcggtgcatatagtggat

SEQ ID NO: 3012 - protein, 78 aa, Neisseria gonorrhoeae
MSVFPYAAHTVSRTKCPLFNGMGFHTNGNNRLFTCRRIKSTDDLNTGKSYAARTHHFSRQSICAAHIDNAGKAVHIVD

SEQ ID NO: 3013 - DNA, 96 bp, Neisseria gonorrhoeae
ttgaatttaatccactatatgcaccgccttgccggcattatcgatatgggcggcacatatggattgcctggaaaaatgatgcgttcgggcggcgta

SEQ ID NO: 3014 - protein, 32 aa, Neisseria gonorrhoeae
LNLIHYMHRLAGIIDMGGTYGLPGKMMRSGGV

SEQ ID NO: 3015 - DNA, 216 bp, Neisseria gonorrhoeae
ttgtcggatgcagaaatccggattcatatcgaatccggattttttattttgaacggaaatcctgtttttgatttatgccgtctgaaagtggggattttgatgcttaagcagtcagaccgactgatatttttgtatggtttaaagaatggtgcagttgggtgtcggacagcattgtttgatgctttcagacggcatataggtttgtttcttcaaaat

SEQ ID NO: 3016 - protein, 72 aa, Neisseria gonorrhoeae
LSDAEIRIHIESGFFILNGNPVFDLCRLKVGILMLKQSDRLIFLYGLKNGAVGCRTALFDAFRRHIGLFLQN

SEQ ID NO: 3017 - DNA, 1017 bp, Neisseria gonorrhoeae
atgaacacaatgctaatgtcgggcgcggctgccgcgctgcttgccggcatcatcctttatttcaaaagcgacaagaaacggcaggaaaacggtgaatggagttccggcctcgaatacgcctatatcctgacggcggtcggtgtgtttgccgctttgtccctgtttatgagctttaccgccgttttcctgattttcgttgtattgtgcggtacggcttggggggtatataaataccgcctgaagactcatcccgaaatctcggaaagcagccacttcggcgattatttcggcagtttcttccctaccgttttggtattgttcctcatccggtcgtttattgccgaaccgttccaaatcccgtccagctcgatgcgcccgggattaatcaagggcgatttcattttggtcggcaaattttcctacggcctgcgcgtacccgttttaaacaatgtattcatccccacgggcaaaatcgaacggggcgatgtcgttgtttttaactatcctttgcagccggagatgacctacatcaagcgtattgtcggcatcccgggcgacattgtcgaatatcgagataaagttttgacggtaaacggaaaaccggcttccgacattcctgacggcacataccgttatcctgacgataccgacccatccgaaatccacaacacggatatgttccgcagcggtctggacggcaaatccttcaatattctgaaaaaagaaggacagcctgccgtttccctgcccgtattgggcaaatatacctccgatattatgtctgaaaacggatattccatagatcaaagcggtctgaaccattgccaatatgccgacgacggcagcggtttcgtgtgcaaagttcccgaaggacgctatttcgctatgggcgacaaccgcgacaacagtgccgattcgcgctactggggctttgtggatgacaagctggttgtcggcaaggcaatgttcattttgatgaacttcggcgatttcggcagggccggcacggcaatccgt

SEQ ID NO: 3018 - protein, 339 aa, Neisseria gonorrhoeae
MNTMLMSGAAAALLAGIILYFKSDKKRQENGEWSSGLEYAYILTAVGVFAALSLFMSFTAVFLIFVVLCGTAWGVYKYRLKTHPEISESSHFGDYFGSFFPTVLVLFLIRSFIAEPFQIPSSSMRPGLIKGDFILVGKFSYGLRVPVLNNVFIPTGKIERGDVVVFNYPLQPEMTYIKRIVGIPGDIVEYRDKVLTVNGKPASDIPDGTYRYPDDTDPSEIHNTDMFRSGLDGKSFNILKKEGQPAVSLPVLGKYTSDIMSENGYSIDQSGLNHCQYADDGSGFVCKVPEGRYFAMGDNRDNSADSRYWGFVDDKLVVGKAMFILMNFGDFGRAGTAIR

SEQ ID NO: 3019 - DNA, 1791 bp, Neisseria gonorrhoeae
atgaaaaatatccgaaatttctccatcatcgcccacatcgaccacggcaaatcgacgcttgccgaccgcttcatccaatattgcggcggtttggatttgcgcgaaatgagtacgcaggtgctcgattccatggacatcgaaaaagagcgcggcatcaccatcaaagcgcaaaccgccgcactcaactacaaagcacgcgacgggcaggtgtatcagcttaatttgattgacacgccgggacacgtcgacttctcttacgaagtttcccgttcgctgtcggcttgcgaaggcgcgcttttggtcgttgacgcgtcgcagggcgtggaagcgcaaaccgtggcgaactgctataccgcgattgatttgggcgtggaagtcgtgcccgttttgaacaaaatcgacctgcccgccgccgaccccgagcgtgtggaacaggaaatcgaagacatcatcggcatcgatgccgtcggcgcggtgcagtgttcagccaaaagcggcatcggcgtggaagacgttttggaagaaatcgttgccaaaatccctgcgccgaccggcgatgaaaacgcgccgctgcaagccgttatcgtcgattcgtggtttgacaactacgtcggcgtggtcatgctgattcgagtgaaaaacggcaccatcaaactgaaagacaaagtccgctttatgagcaccaaggcggaaacgcaggtcgaacagctgggcgtattcacaccgaaatcggttcaaaaacaagaactaaaagccggcgaagtgggttttttgattaccggcgtgaaagaattgggacaggcgaaagtcggcgatacggttactttggttgccaaccctgccactgagccgctgcccggtttccaagaagtacaaagccaagtatttgcgggtctctatcctgtggaaagccacgattacgaagccttgcgcgacgctttggaaaaattgcagctgaacgatgcttcgttgaaattcgagcctgaagtttctcaagcattgggcttcggcttccgctgcggcttcttaggcctgctgcatttagaaatcgtgcaggaacgcttggaacgcgagttcgacatggatttgattaccaccgcgccgacggtggtttacgaagtcgtgttgaaaagcggcgaaaaaatcgaagttgaaaacccgtccaaactgcccgacatcggcagcatcgaaaccattctcgagccgattattaccgcgaccatccttgtgccgcaggaatacgtcggcaacgtcatgactttgtgtaaccaaaagcgcggcgtgcaggtcaatatgcagtatatgggccgccaagtgatgctgacttacgacttgccgatgaacgaagtcgtaatggactttttcgacaaactcaaatccacttcgcgcggttatgcttcgttggactaccatttcaaagaattccaaccgtctgatttgattaagctcgacattatggttaacggcgaaaaagtcgatgccttaagcctgattgtacaccgtcaaagcgcggttcacaaaggccgcgagctggcatcgaaaatgcgcgaactgattccgcgccaaatgttcgacatcgccgtccaagccgccatcggcagccggattatcgcccgagaaaacgttaaagccctgcgtaaaaacgttttggcgaaatgttacggcggcgatattacgcgtaagaaaaaactgcttgaaaaacaaaaagcaggcaaacgccgtatgaaacaagtgggcaacgtggaaattccgcaaagcgcgttcttggcgattttgcaggtgagcgacaaa

SEQ ID NO: 3020 - protein, 597 aa, Neisseria gonorrhoeae
MKNIRNFSIIAHIDHGKSTLADRFIQYCGGLDLREMSTQVLDSMDIEKERGITIKAQTAALNYKARDGQVYQLNLIDTPGHVDFSYEVSRSLSACEGALLVVDASQGVEAQTVANCYTAIDLGVEVVPVLNKIDLPAADPERVEQEIEDIIGIDAVGAVQCSAKSGIGVEDVLEEIVAKIPAPTGDENAPLQAVIVDSWFDNYVGVVMLIRVKNGTIKLKDKVRFMSTKAETQVEQLGVFTPKSVQKQELKAGEVGFLITGVKELGQAKVGDTVTLVANPATEPLPGFQEVQSQVFAGLYPVESHDYEALRDALEKLQLNDASLKFEPEVSQALGFGFRCGFLGLLHLEIVQERLEREFDMDLITTAPTVVYEVVLKSGEKIEVENPSKLPDIGSIETILEPIITATILVPQEYVGNVMTLCNQKRGVQVNMQYMGRQVMLTYDLPMNEVVMDFFDKLKSTSRGYASLDYHFKEFQPSDLIKLDIMVNGEKVDALSLIVHRQSAVHKGRELASKMRELIPRQMFDIAVQAAIGSRIIARENVKALRKNVLAKCYGGDITRKKKLLEKQKAGKRRMKQVGNVEIPQSAFLAILQVSDK

SEQ ID NO: 3021 - DNA, 810 bp, Neisseria gonorrhoeae
gtgctgtctgaaaccgtttcagacggcacggacaaaccgcctccactcaatcctgccgtgttagcgtgtataattcggcgttctatccgaaattcacagcaggttagcaatatgtctttgaaaacagtagccgttatcggcgcgatggaacaggaaatcgagcttttgcgcgagatgatggaaaatgtcaaagccgtctctttcggcagattttccgcctatgaaggcgaattggcgggaaaacgcatagtgcttgcattgagcggcatcggcaaggtcaacgcggcggttgcaacggcttggcttatccgtcaattcgcaccggactgcgtcatcaacaccggcagcgcaggcggtttgggcaagggtttgaaagtcggcgacgtggtgatcggcacggaaaccgagcaccacgatgtcgatgtaaccgcattcggctatgcccgggggcaagtgccgcaactgccggcaaggttcgcttcagacggcatattgattgaaacggcaaaacgggcggcgcggacgtttgaaggcgcggaggtagaacaaggcctgattgtcagcggcgaccgcttcgtccacagcagcgaaggcgtggcggaaatccgcaagcacttccccgaagtcaaagcagtggaaatggaagcggcggcgattgcccaaacctgtcatcagttggaaacgccgttcgtcatcatccgcgctgtttccgattcggcggacgaaaaggcagacatcagctttgaagagtttttgaaaacggcggcggcaagttctgcaaaaatggtggcagaaatcgtcaaatcttta

SEQ ID NO: 3022 - protein, 270 aa, Neisseria gonorrhoeae
VLSETVSDGTDKPPPLNPAVLACIIRRSIRNSQQVSNMSLKTVAVIGAMEQEIELLREMMENVKAVSFGRFSAYEGELAGKRIVLALSGIGKVNAAVATAWLIRQFAPDCVINTGSAGGLGKGLKVGDVVIGTETEHHDVDVTAFGYARGQVPQLPARFASDGILIETAKRAARTFEGAEVEQGLIVSGDRFVHSSEGVAEIRKHFPEVKAVEMEAAAIAQTCHQLETPFVIIRAVSDSADEKADISFEEFLKTAAASSAKMVAEIVKSL

SEQ ID NO: 3023 - DNA, 1230 bp, Neisseria gonorrhoeae
gtggaggcggtttgtccgtgccgtctgaaacggtttcagacagcacggcggatttttggtagaatgggaaggtacagattgtttgaagattgggggacgaggatgtttaccgatgaaaatatgactgcaaaggaagaactgttcgcatggctgcgccatatgaacaaaaacaaaggttccgacctgtttgtgacgacccatttcccgcccgctatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggtgcgacggcgttggtattccgcgcgattaccagcaagattcccaagtttgaaagcctgaacctgccgccggccttgaaggatgttgcgctgaaaaaacgcgggctggttatttttgtcggcggcaccggctcgggcaaatcgacttcgctcgcctcgcttatcgactaccgcaatgaaaattcgttcggacacatcatcaccatcgaagatccgatcgagtttgtccacgaacacaaaaactgcatcattacccagcgcgaggtcggcgtggacacggaaaactggatggcggcgttgaaaaatacgctgcgtcaggcgccggatgtgatccttatcggcgaaatccgcgaccgtgaaacaatggactacgccatcgcctttgccgaaacggggcatttgtgtatggcgacgctgcacgccaacagcaccaatcaggcgctcgaccgcatcatcaacttcttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgaccaacacctttaccaattgtatgaaaaaggcgagatttccttgcaggatgccttgaaaaatgccgattccgcacatgatttgcgtttggcggtacagttgcgcagccgcagggcacaaagttccgaccccgatttggaactgctc

SEQ ID NO: 3024 - protein, 410 aa, Neisseria gonorrhoeae
VEAVCPCRLKRFQTARRIFGRMGRYRLFEDWGTRMFTDENMTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPALKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRRAQSSDPDLELL

SEQ ID NO: 3025 - DNA, 975 bp, Neisseria gonorrhoeae
atgatttatccgtggcatcaggaacaatggcggcagattgccgagcattggacgagccgtcctaatgcgtggctgtttgttggcaaaaaggggacggggaagactgcgtttgcccgctttgcggcgaaggcgctgttgtgcgaaacccctgcaccgggctgcaaaccctgtggcgaatgtatgtcctgccatctgtttggacggggaagccatcccgatttttacgaaatcacgcctctggcggacgaacccgaaaacggacgcaaactgttgcggatcaaaatcgatgccgtcagggaaatcatcgataatgtgtacctgacttcggtacggggcggtttgcgcgtgatcctgattcatcctgcggaaagtatgaatgtccaagccgccaacagtttgttgaaagtgttggaagagccgccgccacaagtggtctttttgctggtaagccacgcggcggacaaggttttaccgaccattaaaagccgctgccggaagatggttttgcccgctccttcgcatggggaagcattggcgtatctgcgcgacaggggtgtggcggagcctgaggaacgtctggctttccattcgggtgcgccgctgtttcaggaggaaggcgagcttcgggaattgagggcaaagctgctggagatattggcagagccgagattgttgaagattttggattacgccgcgcttttcgataaggaaaaacttccgctcgccgtatttgtcgggtggatgcagaaatggctggtcgatttaggcttgtgcctgcaacacatgaaacccgtctattatcccgcttatgaagacaggctgcttcagacggcatcgggtttccgtccgcgcaatgtatttgcggcggaggatatgctcaaacagcttgccccttacgggtttcatactttaaatgtcaaaatgcagatcgagcatctgctcatcaactatttggaattgaagaaagagaacagg

SEQ ID NO: 3026 - protein, 325 aa, Neisseria gonorrhoeae
MIYPWHQEQWRQIAEHWTSRPNAWLFVGKKGTGKTAFARFAAKALLCETPAPGCKPCGECMSCHLFGRGSHPDFYEITPLADEPENGRKLLRIKIDAVREIIDNVYLTSVRGGLRVILIHPAESMNVQAANSLLKVLEEPPPQVVFLLVSHAADKVLPTIKSRCRKMVLPAPSHGEALAYLRDRGVAEPEERLAFHSGAPLFQEEGELRELRAKLLEILAEPRLLKILDYAALFDKEKLPLAVFVGWMQKWLVDLGLCLQHMKPVYYPAYEDRLLQTASGFRPRNVFAAEDMLKQLAPYGFHTLNVKMQIEHLLINYLELKKENR

SEQ ID NO: 3027 - DNA, 348 bp, Neisseria gonorrhoeae
atgtcagacggacaaaatattccggcaaaaatgatgtcgttgcagctgaaagacatgaatctgctgtacagctcctatatgccgtttttggaacacggcggtctgtttgtgcagaccgacgacgtattttccatcggggacgatattctgcttgccgtagaaatcctcaacttccccaaactgttcctgccgaccaaggtcgcctggattaatcctgcgagtacttcctccaaacccaaaggggtggggctggcattcacaaaacacgaaaactgcctgaaagtcaaagaccagatcgaagtcgaactgggcagcacaatcagcggcagcagacctacgtttaccatg

SEQ ID NO: 3028 - protein, 116 aa, Neisseria gonorrhoeae
MSDGQNIPAKMMSLQLKDMNLLYSSYMPFLEHGGLFVQTDDVFSIGDDILLAVEILNFPKLFLPTKVAWINPASTSSKPKGVGLAFTKHENCLKVKDQIEVELGSTISGSRPTFTM

SEQ ID NO: 3029 - DNA, 138 bp, Neisseria gonorrhoeae
ttgtttcgcgcaaagcaagggctaaggcagtcaggcagcaaatcccgcaatgtattaaaacagacgcgtagaaatgccggctgcctttatccatcctcaaaattgaatatcatcctagccgtatcaaggctgtataaa

SEQ ID NO: 3030 - protein, 46 aa, Neisseria gonorrhoeae
LFRAKQGLRQSGSKSRNVLKQTRRNAGCLYPSSKLNIILAVSRLYK

SEQ ID NO: 3031 - DNA, 1617 bp, Neisseria gonorrhoeae
aatcttgctttgcgccacatgggcaatcaaatcgtttgccgcctgatgcaccacttcgataaatgcgttcggatacaggcccatccccaaaacagcaaccgccaaaaccgccagaatcgcaaactcgcggcaattgatgtctttcatttcggcaacgtgcggattgtgaatcgcgccgaaaatcacgcgcttgtacatccacagggtataagacgcgccgtaaatcagcgtcatagccgccagcgcgcccacccagaaattcactttgaccgcgcccataaccaccataaactcgcccacgaagccggaagtcgcaggcaggccggcgttcgccataccgaacaacatcataaacgccgcaaacttgggcatcacattgaccacgccgccgtaatcggcaatattgcgcgtgtgcaggcggtcgtacatcacgccgatgcacataaacatcgccgccgacacgaagccgtgcgaaatcatctgaatgaccgcgcctttcaacgcccagtcgtccaactgcccgtcaacaaacaaaaacatcccaagcgttacaaaacccatatggctgatggacgaatacgccaccagtttcttcatatcggtttgcaccagggccaccataccgatataaattacggcaatcaggctcaatacgatgattacgggggcaaaatagcgagccgcgtccggcataatcggcaggataaagcgcaagaaaccatacgcacccagtttcagcgtaattgccgccaacaccatcgaaccgccggtcggcgcttcaacgtgggcatccggcagccaagtgtgtacggggaacatcggcacttttacggcaaatgacaggaagaacgctacaaacaaaagctgttgtacgcccaacggaatctgtttgatgttttggaaatcgacaatagagaagctgcctgtctgatagtacaggtaaaccatggcaaccaacatcaagagcgaacccgtcagcgtatagaggaacagcttgaccgacgcatagacgcggcgcgggccgccccatacaccgataatcaggtacagcggaatcagcataccctcgaagaacacataaaacagaatcgcatcctgcgcggcaaacgcgccgttaatcaaacccgacatcatcaggaatgccgccatatactgcgccggacgtttctgaatgacttcccaaccggccaataccaccagcagcgtaataaacgcattcaagatgataaagagcactgaaataccgtccacgcccaatgcgtagttgattttcagaagcggaatccactcgtggaactcggtaaattgatagccgccgctcaaacggtcgaaaccggtaaacaggggcagcgttaccaagaaaccggcaagcgctcccatgaaggcaagcacacgcgccagcggcgcacggctgtctttaccggtcgccaaaaccagcacgcctgcggcgatgggtatccatattgccaagctgagtaggtagttggaaaacatagtggttaacctgtggttaaaataaaaaatatagttgtatgggttggtctttacagacagcgttttaggaagtcgtctgaaagaaggaatgaatactctccccccttctttacttattcccaa

SEQ ID NO: 3032 - protein, 279 aa, Neisseria gonorrhoeae
NLALRHMGNQIVCRLMHHFDKCVRIQAHPQNSNRQNRQNRKLAAIDVFHFGNVRIVNRAENHALVHPQGIRRAVNQRHSRQRAHPEIHFDRAHNHHKLAHEAGSRRQAGVRHTEQHHKRRKLGHHIDHAAVIGNIARVQAVVHHADAHKHRRRHEAVRNHLNDRAFQRPVVQLPVNKQKHPKRYKTHMADGRIRHQFLHIGLHQGHHTDINYGNQAQYDDYGGKIASRVRHNRQDKAQETIRTQFQRNCRQHHRTAGRRFNVGIRQPSVYGEHRHFYGK

SEQ ID NO: 3033 - DNA, 1317 bp, Neisseria gonorrhoeae
atgaacgcaacatcccaatttaccagtaatttctggaatatatatattgcagttattgtcttactgagctttatcgctttggcttggctgctgctgtctcaaaatgttgtcaaacgtccgaagaagggcgaagaagtacaaactacgggtcacgagtgggacggcattgccgaatacgacaatccgctgccccgctggtggttttggctgtgtgttttgacgtggctgttcggtatcggttatctggttatgtatccgggtgtcggcgactacaaaggtctgctgaaatggaccagccataaccaatatgaaaaagaggtcaaaaaagccgatgagcaatacggcaaactgtatgccaagtttgcggatatgccgattgaaaaagtggcaaaagacccacaggccaagcaaatcgcccaaaacctgtttaacacttattgtatccagtgccacggctctgatgccaaaggttctaaaggttttccgaatctgaccgatagcgattggttgtggggcggcgatcccgataaaatccacgagaccatcgaaaaaggccgtgttgcgactatgcctgcctggggtcctgctttgggcgaagaaggcgtgaaagacgttgcccattatgtgatgtccctttcaaaacccaaaggtcagtatgatgaggaacgtgccgcgcgcggacaagccttgttcagcggtccgcctgccaactgtttcacttgccacggcgataagggacaaggtatccaaggtttgggtccgaacctgactgatgacgtgtggttgtggggcggtacgcaaaaatccattatcgaaaccattaccaacggtcgcagcagccaaatgcccgcttggggacatttcttggataaagacaaactgcatatcatgactgcttatgtatggggtctttccaataaagacggtaaagctccggtgaaaaaagccgagcctgcaccggcggcagaacccgcaccatctgctcctgcagaagcagcacaagccgcttctgaagccaaacctgccgcagcagaacctaaagccgaggaaaaagccgcacctgccgccaaagcggatggcaaacaggtttatgaaaccgtttgtgccgcctgccatggcaatgcaattccaggtattccccatgtaggcaccaaagccgactgggccgaccgcatcaaaaaaggtaaggacacgttgcacaaacacgcgatcgaaggttttaatacgatgcccgcaaaaggaggtcgcggcgatttgagcgatgatgaggtcaaagctgcggttgactatatggtcaaccagtcaggcggtaagttc

SEQ ID NO: 3034 - protein, 439 aa, Neisseria gonorrhoeae
MNATSQFTSNFWNIYIAVIVLLSFIALAWLLLSQNVVKRPKKGEEVQTTGHEWDGIAEYDNPLPRWWFWLCVLTWLFGIGYLVMYPGVGDYKGLLKWTSHNQYEKEVKKADEQYGKLYAKFADMPIEKVAKDPQAKQIAQNLFNTYCIQCHGSDAKGSKGFPNLTDSDWLWGGDPDKIHETIEKGRVATMPAWGPALGEEGVKDVAHYVMSLSKPKGQYDEERAARGQALFSGPPANCFTCHGDKGQGIQGLGPNLTDDVWLWGGTQKSIIETITNGRSSQMPAWGHFLDKDKLHIMTAYVWGLSNKDGKAPVKKAEPAPAAEPAPSAPAEAAQAASEAKPAAAEPKAEEKAAPAAKADGKQVYETVCAACHGNAIPGIPHVGTKADWADRIKKGKDTLHKHAIEGFNTMPAKGGRGDLSDDEVKAAVDYMVNQSGGKF

SEQ ID NO: 3035 - DNA, 777 bp, Neisseria gonorrhoeae
atgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccgtcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcttggcagcacaaacgctttgcagaccacatcgaagcagccaatcaaaccggactgcccgttatcgtccatacgcgcgatgcggcggcggacaccttggcgattttaaaagaatgtaaaaccaattcgggtgtgattcactgtttttccgaggatgtcggttttgcccgggctgccatggatttggggctttatatttctttctcgggaatcgttacctttaaaaacgcccccttggttcaggaggcggcgaaatacgttccggacgaccgcattttagtggaaaccgatgcgccgttccttgcccccgttcccaaacgaggcaggcagaacgaaccggcttttgtgcgtcatactgccgaacatattgccaaattgcggaatcaaacattggaacaggttgcggcatatacgacggaaaacttttaccggctgtttaaaaaagtacccgatatgcgggtcgtc

SEQ ID NO: 3036 - protein, 259 aa, Neisseria gonorrhoeae
MHIIDSHCHLNFEGLKERLPEVLSNMEANGVGQALAISVSRESFSEVFAVAEAHEHIYCTIGVHPDSKEAEEFSIAEMVEAAAHPKVVGIGETGLDYYWCKGDLSWQHKRFADHIEAANQTGLPVIVHTRDAAADTLAILKECKTNSGVIHCFSEDVGFARAAMDLGLYISFSGIVTFKNAPLVQEAAKYVPDDRILVETDAPFLAPVPKRGRQNEPAFVRHTAEHIAKLRNQTLEQVAAYTTENFYRLFKKVPDMRVV

SEQ ID NO: 3037 - DNA, 234 bp, Neisseria gonorrhoeae
gtgccgacgataaggaaaaccatgaaggcaattcatccgtatgcatgtccgcgctgctgccggctgcctgccaacacgtttcggacaggcatggcaaattccgcttccaaattctgcattgccaaaggcggcagacgggaagtaaaaaaagacgaaagcggcggcggatatgccctgtgccatttgccggacagcaggattgtcgaggagtgggaatattgccgttcgcaacat

SEQ ID NO: 3038 - protein, 78 aa, Neisseria gonorrhoeae
VPTIRKTMKAIHPYACPRCCRLPANTFRTGMANSASKFCIAKGGRREVKKDESGGGYALCHLPDSRIVEEWEYCRSQH

SEQ ID NO: 3039 - DNA, 309 bp, Neisseria gonorrhoeae
atggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttgctgtcaacgtattggaaaatcccgaagtacgccaaggcattaaggaatacagcgactggccgaccatcccccaactttatgtgaacggcgagtttgtcggcggttcggacatcctgatggaaatgtatgaggcaggcgagctgcaagagctgctgaaagcc

SEQ ID NO: 3040 - protein, 103 aa, Neisseria gonorrhoeae
MASIHDQIKEVVTTHRVVLFMKGTKQFPQCGFSSRAVQILNAAGCTDYVAVNVLENPEVRQGIKEYSDWPTIPQLYVNGEFVGGSDILMEMYEAGELQELLKA

SEQ ID NO: 3041 - DNA, 363 bp, Neisseria gonorrhoeae
ttgccgaatccatcaggctttcagcagctcttgcagctcgcctgcctcatacatttccatcaggatgtccgaaccgccgacaaactcgccgttcacataaagttgggggatggtcggccagtcgctgtattccttaatgccttggcgtacttcgggattttccaatacgttgacagcaacgtaatcggtgcagcctgccgcgttcaggatttgcacggcgcgggaagagaaaccgcattgcggaaactgcttcgtacctttcataaacaatacgacgcggtgtgtcgttactacttctttaatttggtcgtggatggaagccatcgcttattccttttgataaagttgacaaaatttgtcagg

SEQ ID NO: 3042 - protein, 121 aa, Neisseria gonorrhoeae
LPNPSGFQQLLQLACLIHFHQDVRTADKLAVHIKLGDGRPVAVFLNALAYFGIFQYVDSNVIGAACRVQDLHGAGRETALRKLLRTFHKQYDAVCRYYFFNLVVDGSHRLFLLIKLTKFVR

SEQ ID NO: 3043 - DNA, 114 bp, Neisseria gonorrhoeae
atggattcggcaatgccgtctgaacgtgtttcagacggcattttcttttccggcaaattaaaaaaaagtataatgacgcgtctcaaaatcacactggaacaccgcgatgaacgt

SEQ ID NO: 3044 - protein, 38 aa, Neisseria gonorrhoeae
MDSAMPSERVSDGIFFSGKLKKSIMTRLKITLEHRDER

SEQ ID NO: 3045 - DNA, 954 bp, Neisseria gonorrhoeae
atgaatataatcgggccggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactataccgtttacgttatcaatcccttaaaaatcaaggactacggaaaaagcaggtttaaccgcaccaaaaccgacaaagcagattcaaacctgatagcagattacataaaaaggcatcaagatacattgataccgtatcagatacccaaaaacaaagcactgcaaaaactgattaatcttaaaaaccaattacagcaacagcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccaatttgtatcctatgccggattaagtcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaattatcgttgccatcatgcgcaaactggcgaagcccgcctattacattgttaaaaccggccagccttacgatgcggaaagacaccgattgaatcaa

SEQ ID NO: 3046 - protein, 318 aa, Neisseria gonorrhoeae
MNIIGPDISKDTIDATLHKTNGSIHYIKFKNNDDGLKQFRLWIKGNRIRKVYIGMEATGIYYEKAADMLSSYYTVYVINPLKIKDYGKSRFNRTKTDKADSNLIADYIKRHQDTLIPYQIPKNKALQKLINLKNQLQQQQKQIKNRLHSTEEDFIRNIHQDLIDTIQDKMEQVKIAISEQIKKQTDNNHYRNLQTIPSIGKDTASVLYAQLTEKHFKTANQFVSYAGLSPAIIQSGTSVRGRGRLSRYGNRRLKSTLYMPALCAYRFNAFPKLINNLKKAGKPKMVIIVAIMRKLAKPAYYIVKTGQPYDAERHRLNQ

SEQ ID NO: 3047 - DNA, 1014 bp, Neisseria gonorrhoeae
ttcccaatcaatatctgtacgattgcgatattctgcctgtactaaaacatctaattcagccaaatcttttatttctgactgcatagctagtaaagctcttaacttcatacttaaatcaatatatttggagccttcgcttgctccttttgcagacttaaatttattttcttctaaaaattttttaatgggagcatttaaaacaggatatctatctggatattcttgacaaagcatttcagaaaaaactgaaccacgagtggaaaccccacattcttttagccaatcaatttgcttggcaaccacattatctctctcagtaagtggagcatcaaaaactgattggatggcaatgcataattttctaaaatctgaagacttacccgtccttttccacgttttatcttgaaaacgattgcctaccccttctcctttattttcgcttttccaagaccataatttattaaattccccataaaaatcattattgtctatttttcctgctgcacattgcttaataagattttttaattgattacacacagtttgatggtttctcatctgctttctccgtgccgcaatcagttcttgattataatttggcatctccataaataacttatccatcactgattgtctaacagttgatttcttatagttaatttcagcttcctgatactcctcaagccaatcttccgataccgggatagatttcatcgcaatttcatcagcccaagatttgacttttataaaatcctgctcggaaattttagtcaaaatatttgcttcataattgctattaaacgcagcatgagtcaaatttgaagaaccgattaaagcataatattcattcttatcattcttccaaaatacagctttaggatgaaaaccctgaatgccttgagctaccatcagtgtgaatttcaaatgggacggaagccatttcaacactttccgaatagcctcttttttagacaatccgaaatcttgtccaaaaataaatttaaactcttgcaa

SEQ ID NO: 3048 - protein, 14 aa, Neisseria gonorrhoeae
FPINICTIAIFCLY

SEQ ID NO: 3049 - DNA, 624 bp, Neisseria gonorrhoeae
atgaacgttaacgttatcaaccatccgctcgtccgccacaaactgaccctgatgagggaggcggattgcagcacctacaaattccgtacgctgaccaccgagttggcgcgcctgatggcatacgaggcaagccgtgattttgaaattgaaaaataccttatcgacggatggtgcggacagattgaaggcgaccgcatcaaaggcaaaaccctgaccgtcgtccccatcctgcgcgccggtttgggtatgctcgacggcgtgctcgacctgattccgactgccaaaatcagcgtggtcggtttgcagcgcgacgaggaaacgctgaagcctatttcctattttgagaaatttgtggacagtatggacgagcgtccggctttgattatcgatcctatgctggcgacaggcggttcgatggtggccaccatcgacctgttgaaagaaaaaggttgccgcaacatcaaagccttagtcttggttgccgcccctgagggcgtgaaggctgttaatgatgcgcatcccgatgttacgatttataccgccgcgctggatagccgtttgaacgaaaacggctatattattcccggtctgggcgatgcgggcgacaagattttcggcacgcgc

SEQ ID NO: 3050 - protein, 208 aa, Neisseria gonorrhoeae
MNVNVINHPLVRHKLTLMREADCSTYKFRTLTTELARLMAYEASRDFEIEKYLIDGWCGQIEGDRIKGKTLTVVPILRAGLGMLDGVLDLIPTAKISVVGLQRDEETLKPISYFEKFVDSMDERPALIIDPMLATGGSMVATIDLLKEKGCRNIKALVLVAAPEGVKAVNDAHPDVTIYTAALDSRLNENGYIIPGLGDAGDKIFGTR

SEQ ID NO: 3051 - DNA, 318 bp, Neisseria gonorrhoeae
atgaatttccaagactatctcgccacatttccttcaatcgaccatctgggcggtttggatgttcaggatgccgaaggcaaaacggttcaccacattcccgccgttcagggcaagctcggttcgctcaagctgtacaatgccttggcggaacgttttgatggaaaattgggtaaagaagcggcagaacagggtttgatatggtttgccgaacatgttgccgacgcgcgcgcccatccggggaagcatccgaacatcgatttgctggaaaatgtcgtgcaaagcggcgaaaccctcctgctcaaaccgcttgccgcgcaa

SEQ ID NO: 3052 - protein, 106 aa, Neisseria gonorrhoeae
MNFQDYLATFPSIDHLGGLDVQDAEGKTVHHIPAVQGKLGSLKLYNALAERFDGKLGKEAAEQGLIWFAEHVADARAHPGKHPNIDLLENVVQSGETLLLKPLAAQ

SEQ ID NO: 3053 - DNA, 324 bp, Neisseria gonorrhoeae
atgccgtctgaaacgaatttcagacggcatggtcgaaaattattgcgcggcaagcggtttgagcaggagggtttcgccgctttgcacgacattttccagcaaatcgatgttcggatgcttccccggatgggcgcgcgcgtcggcaacatgttcggcaaaccatatcaaaccctgttctgccgcttctttacccaattttccatcaaaacgttccgccaaggcattgtacagcttgagcgaaccgagcttgccctgaacggcgggaatgtggtgaaccgttttgccttcggcatcctgaacatccaaaccgcccagatggtcgat

SEQ ID NO: 3054 - protein, 108 aa, Neisseria gonorrhoeae
MPSETNFRRHGRKLLRGKRFEQEGFAALHDIFQQIDVRMLPRMGARVGNMFGKPYQTLFCRFFTQFSIKTFRQGIVQLERTELALNGGNVVNRFAFGILNIQTAQMVD

SEQ ID NO: 3055 - DNA, 108 bp, Neisseria gonorrhoeae
ttgatttttgcactaatttttgataaaatcccttataacaaattgaactataagggattttataatgtcgggcgtaacaaaagaattagacattttaaaacaactttt

SEQ ID NO: 3056 - protein, 36 aa, Neisseria gonorrhoeae
LIFALIFDKIPYNKLNYKGFYNVGRNKRIRHFKTTF

SEQ ID NO: 3057 - DNA, 594 bp, Neisseria gonorrhoeae; identical to SEQ ID NO: 161

SEQ ID NO: 3058 - protein, 198 aa, Neisseria gonorrhoeae; identical to SEQ ID NO: 162

SEQ ID NO: 3059 - DNA, 822 bp, Neisseria gonorrhoeae; identical to SEQ ID NO: 163

SEQ ID NO: 3060 - protein, 274 aa, Neisseria gonorrhoeae; identical to SEQ ID NO: 164

SEQ ID NO: 3061 - DNA, 966 bp, Neisseria gonorrhoeae; identical to SEQ ID NO: 165

SEQ ID NO: 3062 - protein, 322 aa, Neisseria gonorrhoeae; identical to SEQ ID NO: 166

SEQ ID NO: 3063 - DNA, 90 bp, Neisseria gonorrhoeae
ttgttaaaacacagccttctatttcaggatacgggcaatgatgtttcaacacacaggacgacacataaagcgccgccctatgtgttgccc

SEQ ID NO: 3064 - protein, 30 aa, Neisseria gonorrhoeae
LLKHSLLFQDTGNDVSTHRTTHKAPPYVLP

SEQ ID NO: 3065 - DNA, 423 bp, Neisseria gonorrhoeae
atgatgaaaaaaatgttcctttctgccgcattgcttctgtcggctgccgcccaaaccgtgtgggcggatacggtattttcctgtaaaacggacaacaacaaatacatagaagttcaaaaaatcaaccgcaatctttacgaatattcgttcggcagtgcggcaaaaaaagaaattgccatacgcaacagcaaagctgacctgttggggcgttccgacaggtggcaaggcatgggcagcggacgccgggcaacgatgaaattccaaaacggcgaatttatgtacaccgtatggacaggcttcgattccgtgactcatacggaaagcagcggtgtcgttgtggagcgtaggggcaaggaagtcgcacgggtaggctgtacgccgaaaaccgcgcaggcgaatttcaacgatgacgatttttcccgg

SEQ ID NO: 3066 - protein, 141 aa, Neisseria gonorrhoeae
MMKKMFLSAALLLSAAAQTVWADTVFSCKTDNNKYIEVQKINRNLYEYSFGSAAKKEIAIRNSKADLLGRSDRWQGMGSGRRATMKFQNGEFMYTVWTGFDSVTHTESSGVVVERRGKEVARVGCTPKTAQANFNDDDFSR

SEQ ID NO: 3067 - DNA, 147 bp, Neisseria gonorrhoeae
ttggtgtatctgaatgtaaaaataactgtgtcatcccttttgactcctctatatttgttgagattgcctaaaaaatttaggaaacagataatttgcatgttggctatttcacgcctgttgggtaccattttgttccaccctttgact

SEQ ID NO: 3068 - protein, 49 aa, Neisseria gonorrhoeae
LVYLNVKITVSSLLTPLYLLRLPKKFRKQIICMLAISRLLGTILFHPLT

SEQ ID NO: 3069 - DNA, 168 bp, Neisseria gonorrhoeae
atggatattaacggtattcgcgctcttttcacggtatggatctttatctgtttcctgttagtactctatatcgtcttcaacaggcggaataagaaaaactacgatgatgccgcaaacagcatttttgctgaaaaccaagatgcgcaagataagaaaagcgaaaaccgt

SEQ ID NO: 3070 - protein, 56 aa, Neisseria gonorrhoeae
MDINGIRALFTVWIFICFLLVLYIVFNRRNKKNYDDAANSIFAENQDAQDKKSENR

SEQ ID NO: 3071 - DNA, 90 bp, Neisseria gonorrhoeae
ttgttatttttatttacgtttatttacgatatgcaaatgcacggttacacaaatatattcgcgcaaccgtttaattttgttgaattttat

SEQ ID NO: 3072 - protein, 30 aa, Neisseria gonorrhoeae
LLFLFTFIYDMQMHGYTNIFAQPFNFVEFY

SEQ ID NO: 3073 - DNA, 762 bp, Neisseria gonorrhoeae
atggaaacagcgaagcccgtcatgctgattgtccgcccgtcgggcagggcgaaggacgatgtggaagtctgccgtcgtgccggatggcaggcggaagtgttgagtccgattgaaatcgaaaccgacgaagcaagcctgaaacggctgccggaaatgtatgcccgtgcggatgccgtgttttgggtcagtccggccgccgttgaaaccgccgtcccgtaccttaacctttcagacggcataaaggcgcacattgccgtagggcaaggcagccgccgtgccttggcgcgttatgcgggcgcgggcgtgtttgcacctgaagacggcaacgacagcgaggcggttttgcgcctgccggtttggaacagtctgcccgaaggtgcgcgcgtattgtctgtgcgcggacacggcgggcgggattttctgatgaatgccttgcaggagaaaggttttcggacggaggtggcagaagtctatttcagacggcataaacctttgaactttcaaaatttccaaaccgaaaatattgccgccgcctatattacgtccacagaacttgtgcagtcgctgtttgcacagcttccgccgcaattttcccgattcttcaaatccttgctatactttacccatcatccgcgcattgcggaggcattgaagcgcgaaggcgtgtgttcggtcgaaaccgtccctacgctggaagccgcgctttcctattcttccatttccgtttcagacggcatggtctttcccggaacctcaaaccaa

SEQ ID NO: 3074 - protein, 254 aa, Neisseria gonorrhoeae
METAKPVMLIVRPSGRAKDDVEVCRRAGWQAEVLSPIEIETDEASLKRLPEMYARADAVFWVSPAAVETAVPYLNLSDGIKAHIAVGQGSRRALARYAGAGVFAPEDGNDSEAVLRLPVWNSLPEGARVLSVRGHGGRDFLMNALQEKGFRTEVAEVYFRRHKPLNFQNFQTENIAAAYITSTELVQSLFAQLPPQFSRFFKSLLYFTHHPRIAEALKREGVCSVETVPTLEAALSYSSISVSDGMVFPGTSNQ

SEQ ID NO: 3075 - DNA, 1332 bp, Neisseria gonorrhoeae
gtgggcgaacctgaaaacaaatcatccgaacccgtacgcgagatacaggcatcaaaagaaatgccgtctgaaacctcttccccacgcaaagaaaacgaaacagaagtacacattcccgccgctccttttatcgtcaaacagtccggcagcaacgctttggcggcctgcgccttggtattggcggcattgggtttgggtgcaagtggttttttgtttgtccaaggacagaatgtcttgaaaaaccaagagctggcattcaaccagaaaatcgacaaagccgccttgggcgagtcggaaaacgccgccctgctcaaagacaacctcaaccgccaaagtgccatacagtccgaactcgaccgtttggacagcggtgtcaaagccaacggcgaacaaatcctgatgacgcaaaaagcctatcgcgagctgaccaaagggcgtgccgattggctggtggacgaaaccgagaccatactcaatctggcggcgcaacagctggtgttgaccggcaatatccaaacggcagtcggcgtgttggagcatatcgacagccgcctgtcccgtttcgatcaggcagagcttctgccgatcaaacaggcggtcagcagcgatttggcggaactgaaaaaccgtccctatgtcgatatttccggcacggcattgcgcctcgaccggttggaaaccgccgtatccggactgccgctgattttggacggcgtattgaaaccgggcgtacaggcccgcaacgaagccgtttccgcttcatggtggcagaacgtatgggaaaaatccctcggcacattgaaggggctggtcgaaatccgccgtttggaaaacaacgatgccatgctgatttctcccgaacaggcatattttgtgcgtgaaaacctgcgtctgcgcctgttggatgcgcgcaccgcattgatgcagcgcaacggcgaagtctatcagggcgatttgaacaatgccgaagccgccgtcagacagtatttcgatgccaagtcgcccgccacgcagtcgtggctgaaagaactggcggaattgaaaacactggatgtacgcatgacggcggatgacggcttgaagaccagtttaaatgccgtccgcgcctatcgcgacggtacgcgcatgacggcggcggaaaatcaagaagcggaacaggcggcttccgaaccggcaaacgaaaacacagcttccgaaccggctgccgcatcggatgtgaaggccatagaagcaccgtccctgccttcggaacgcaaaccggaacagcctgcaaaaaaacagcccgcaccggaaaaggcagggcgttcgccgtccgctaaaggagaacgcgca

SEQ ID NO: 3076 - protein, 444 aa, Neisseria gonorrhoeae
VGEPENKSSEPVREIQASKEMPSETSSPRKENETEVHIPAAPFIVKQSGSNALAACALVLAALGLGASGFLFVQGQNVLKNQELAFNQKIDKAALGESENAALLKDNLNRQSAIQSELDRLDSGVKANGEQILMTQKAYRELTKGRADWLVDETETILNLAAQQLVLTGNIQTAVGVLEHIDSRLSRFDQAELLPIKQAVSSDLAELKNRPYVDISGTALRLDRLETAVSGLPLILDGVLKPGVQARNEAVSASWWQNVWEKSLGTLKGLVEIRRLENNDAMLISPEQAYFVRENLRLRLLDARTALMQRNGEVYQGDLNNAEAAVRQYFDAKSPATQSWLKELAELKTLDVRMTADDGLKTSLNAVRAYRDGTRMTAAENQEAEQAASEPANENTASEPAAASDVKAIEAPSLPSERKPEQPAKKQPAPEKAGRSPSAKGERA

SEQ ID NO: 3077 - DNA, 1215 bp, Neisseria gonorrhoeae
atgaaaacggtagtctggattgttgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcctgtttaaattcatcatcggcgtactcaatatccccgaaaatatgcggcgttccggttcggcgcggaaaggccgcaaggccgcgcttgccttgaataaggcgggtttggcgtatttcgaagggcgttttgaaaaggcggaactcgaagcctctcgagtgttgggcaacaaagaggccggagacaaccggactttggcattgatgctgggcgcgcacgcggcaggacagatggaaaatatcgagctgcgcgaccgttatcttgcggaaatcgccaaactgccggaaaaacagcagctttcccgctatcttctgctggcggaatcggcgttaaaccggcgcgattacgaagcggcggaagccaatcttcatgcggcggcgaagatgaatgccaaccttacgcgcctcgtgcgtctgcaacttcgttacgccttcgatcggggcgatgcgttgcaggttctggcaaaaaccgaaaaactttccaaggcgggcgcgttgggcaaatcggaaatggaacggtatcaaaattgggcataccgccgccagatggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgattcttggctgaaagaacagcccgataacgcgcttctgctgatgtatctcggccggctcgcctacggccgcaaactttggggtaaggcaaaaggctaccttgaagcgagtattgcactgaagccgagtattccggcgcgtttggtgttggcaaaggtttttgacgaaaccgcacagtcgcaaaaagccgaagcacagcgcaacttggttttggcaagcgttgccggggaaaaccgcccttccgccgaaacccgt

SEQ ID NO: 3078 - protein, 405 aa, Neisseria gonorrhoeae
MKTVVWIVVLFAAAVGLALASGIYTGDVYIVLGQTMLRINLHAFVLGSLIAVVVWYFLFKFIIGVLNIPENMRRSGSARKGRKAALALNKAGLAYFEGRFEKAELEASRVLGNKEAGDNRTLALMLGAHAAGQMENIELRDRYLAEIAKLPEKQQLSRYLLLAESALNRRDYEAAEANLHAAAKMNANLTRLVRLQLRYAFDRGDALQVLAKTEKLSKAGALGKSEMERYQNWAYRRQMADAADAAALKTCLKRIPDSLKNGELSVSVAEKYERLGLYADAVKWVKQHYPHNRRPELLEAFVESVRFLGEREQQKAIDFADSWLKEQPDNALLLMYLGRLAYGRKLWGKAKGYLEASIALKPSIPARLVLAKVFDETAQSQKAEAQRNLVLASVAGENRPSAETR

SEQ ID NO: 3079 - DNA, 1062 bp, Neisseria gonorrhoeae
atgactcttttaaaaaacgataccttcctccgcgccctgctcaaacagcccgtcgaatacacaccgatttggatgatgcgccaggcggggcgttatctgcccgaatacaaagccacgcgcacgaaagcgggcagcttcctcgatttgtgcaaaaacaccggattggcgaccgaagtcaccatccagcctttggaacgcttcgatttggacgcggcgattttgttttccgacatcttgaccgttcccgatgcaatgggcttggggctgtattttgccgaaggcgaaggcccgaaattcaaacgcgccttgcaacacgaatccgacatcgccaagctgcacgttcccgacatggaaaaactgcaatacgttttcgacgcggtaacttccatccgtaaagcattggacggccgcgtaccgcttatcggcttctccggcagcccgttcacgctcgcctgttatatggtcgaaggcggcggcagcaaagaattccgcaccatcaaaaccatgatgtactcgcgccccgatttgctgtacaaaatcctcgataccaacgcccaagccgttaccgcctacctcaacgcccaaatcgacgcgggcgcgcaggcggtgcagattttcgacacttggggcggcgtgttgagcgacgcggcgtttaaagagttcagcctcaaatacatccgccaaatcgttgccggactcaaacgtgaaagcgaaggtcgccgcgtgcctgttatcgtgtttgccaaaggcggcgggctgtggctggaaagcatggcccaaatcggcgcagacgcattgggcttggactggacgtgcaacatcggcgaagcacgccgccgcgtcggcaaccaagtcgccctgcaaggcaacttcgacccgtccgccctcttcggtacgcccgaatccatccgcaccgaggtcgcacgtatcctgaccggctacggacacggcagcggccatgtcttcaacctcggacacggcatcaaccaacacgccgaccccgaacacgccaaaatcttagtcgacaccgtacacgagctgtcgcggcagtatcacggcggg

SEQ ID NO: 3080 - protein, 354 aa, Neisseria gonorrhoeae
MTLLKNDTFLRALLKQPVEYTPIWMMRQAGRYLPEYKATRTKAGSFLDLCKNTGLATEVTIQPLERFDLDAAILFSDILTVPDAMGLGLYFAEGEGPKFKRALQHESDIAKLHVPDMEKLQYVFDAVTSIRKALDGRVPLIGFSGSPFTLACYMVEGGGSKEFRTIKTMMYSRPDLLYKILDTNAQAVTAYLNAQIDAGAQAVQIFDTWGGVLSDAAFKEFSLKYIRQIVAGLKRESEGRRVPVIVFAKGGGLWLESMAQIGADALGLDWTCNIGEARRRVGNQVALQGNFDPSALFGTPESIRTEVARILTGYGHGSGHVFNLGHGINQHADPEHAKILVDTVHELSRQYHGG

SEQ ID NO: 3081 - DNA, 609 bp, Neisseria gonorrhoeae
atgatgttaccttacgtttttcaaagccagacccaatccttgcagataggcgactacagcatccagctcggatttgtttgccaaagcctcaggcgctttcgcaatttcctcatcactgtaaggagtacctactttacgcaaagccttcatgttggcaacggttgcatcgacatcgactttattgcgtgcaagccacgggaatgccggcatattggactcaggcacgacatcacggggattcagcaggtggatgcggtgccattcgtcggaatagcggccgcccacacgtgccaaatcaggaccggtacgtttggaaccccattggaacggatggtcgtaaaccgactctccggcaacagagtaatgaccgtaacgctcggtttccgcacggaacggacgaatcatttgagagtggcagttgtaacagccctcacggatgtaaatatcgcgtccggcaacctgcagggcattgtaaggcttcacgcccggcgccggctgtgttgccgccttggtaaaggccaagggcacaacttcaatcaacagaccgacactgactacaagcagcgtgaacacaatcagaacgccgattttttcttcagccaattgttg

SEQ ID NO: 3082 - protein, 203 aa, Neisseria gonorrhoeae
MMLPYVFQSQTQSLQIGDYSIQLGFVCQSLRRFRNFLITVRSTYFTQSLHVGNGCIDIDFIACKPRECRHIGLRHDITGIQQVDAVPFVGIAAAHTCQIRTGTFGTPLERMVVNRLSGNRVMTVTLGFRTERTNHLRVAVVTALTDVNIASGNLQGIVRLHARRRLCCRLGKGQGHNFNQQTDTDYKQREHNQNADFFFSQLL

SEQ ID NO: 3083 - DNA, 1887 bp, Neisseria gonorrhoeae; identical to SEQ ID NO: 249

SEQ ID NO: 3084 - protein, 629 aa, Neisseria gonorrhoeae; identical to SEQ ID NO: 250

SEQ ID NO: 3085 - DNA, 1035 bp, Neisseria gonorrhoeae; identical to SEQ ID NO: 251

SEQ ID NO: 3086 - protein, 345 aa, Neisseria gonorrhoeae; identical to SEQ ID NO: 252

SEQ ID NO: 3087 - DNA, 1122 bp, Neisseria gonorrhoeae
atgctatctaaacaaatctcaaatcttaattcttctagtaacaaaccaaaaatcctatctctattttcaggatgtggcggtttggatttgggctttcatcaagctggttgtgaaactgtttgggcgaacgatttctcccattgggcttgcgaaagtttccgtaaaaatatcggcgatgtcatcgtagaaggtgatattgaacaaattaatccgaatgatccaactattcccgattgcgacatcattttaggcggattcccttgtcaagatttttccatgatttggaaacagccgggcttagagggtgagcgcggcaatctttataaaagctttttacgttttgtaaatgcaaaaaaaccgaaagtttttgttgctgagaatgtgaaaggtttattgactgccaacaagaaaaaagccatccagcaaattattaccgactttgaaaattgcggttattacgttcaggcgaagctgtataactttgcagaatttggcgtacctcaatttcgtgaacgtgtgctgattgtcggagtacgtttggatacaggatttgattttcgccatccggaaccgacgcacaatgaaactggcgaaaacggcttaaaaccatatgtaacagcaggtcaggccatatccaatattccacaaaatgccagtaataatgaattactgaaaatcagcgataaaacacgccgtatgttggaattaattcctgaaggtggaaattttaccgatattcctaaagatcatcctttatatgtgaaaggtatgattagccacgtttatcgtcgtatgcatcggaacgagccatcaaaaacaattattgcagcaggtggcggtggtacttggggctatcacttccctgaaccgcgtgcttttactaatagagaacgagcaaggcttcaaagttttcctgatgattttgagtttgtcggatcaacaactgaagtacgtcgccagattggtaatgctgttcctcctcagggcgtggttgaactggcaaaaagcattttaccgattttttcagacaactatgagaaagtagatttgcatgagaaattagtcgaagaaaaagaaattttattccatgaccgactaagcaaaattcgagggggaaaacaa

SEQ ID NO: 3088 - protein, 374 aa, Neisseria gonorrhoeae
MLSKQISNLNSSSNKPKILSLFSGCGGLDLGFHQAGCETVWANDFSHWACESFRKNIGDVIVEGDIEQINPNDPTIPDCDIILGGFPCQDFSMIWKQPGLEGERGNLYKSFLRFVNAKKPKVFVAENVKGLLTANKKKAIQQIITDFENCGYYVQAKLYNFAEFGVPQFRERVLIVGVRLDTGFDFRHPEPTHNETGENGLKPYVTAGQAISNIPQNASNNELLKISDKTRRMLELIPEGGNFTDIPKDHPLYVKGMISHVYRRMHRNEPSKTIIAAGGGGTWGYHFPEPRAFTNRERARLQSFPDDFEFVGSTTEVRRQIGNAVPPQGVVELAKSILPIFSDNYEKVDLHEKLVEEKEILFHDRLSKIRGGKQ

SEQ ID NO: 3089 - DNA, 255 bp, Neisseria gonorrhoeae
ttgataaaaatccttgtatggattttaaaggtgaactatgctctgaacgcaacgcaacgcaacgcaacgcaacgcaacgcaacgcaacgcaacgcaacgcaacgcaacgcaacgcaacgcaacgcaacgcaacgcaacgcaacgcaacgcaattctaccattatatttaatgggaaagtcattgtttgggattcctgttttgtattttccgtcattatgccgcaaaataacagaaagccacccttgtttgtatcg

SEQ ID NO: 3090 - protein, 85 aa, Neisseria gonorrhoeae
LIKILVWILKVNYALNATQRNATQRNATQRNATQRNATQRNATQRNATQRNSTIIFNGKVIVWDSCFVFSVIMPQNNRKPPLFVS

SEQ ID NO: 3091 - DNA, 1377 bp, Neisseria gonorrhoeae
atggcaaaaacgcttaaaaccctttaccaatgcaccgaatgcggcggcacttccccgaaatggcagggcaaatgtccgcattgcggcgagtggaacacgcttcaggaaagctttgccgcgcccgagccgaaaaacgcccgattccaatcttgggcggcggacgcttcgaccgtccaatccctctccgccgttaccgctgccgaagtgccgcgcaatccgaccggtatgggcgaactcgaccgcgtattgggcggcggtttggtcgatggcgcggtcatcctgctcggcggcgatcccggcatcggcaaatccacgctgttgttgcaaaccatcgccaaaatggcgcaaagccgcaaagtgctgtacgtttccggcgaagaatccgcccaacaggtcgccctgcgctcgcaacgtttggaactgcacgccgaaggcgtaaacctgcttgccgaaatccgcatggaagcgattcaggcggccttgaaacagcatcagcccgaagtcgtcgttatcgattccatccaaaccatgtattccgaccaaatcacgtccgcccccggttccgtgtcgcaggtgcgcgaatgtgccgcccaactgacgcgtatggcgaaacaaatgggtatcgccatgatactggtcggacacgttaccaaagacggagcgattgccggcccgcgcgtgctggaacatatggtcgataccgtgctgtatttcgagggcgaccaacattccaactaccgcatgatacgcgccatcaaaaaccgtttcggcgcggcaaacgaattgggcgtgttcgcgatgaccgaaaacggtttgaaaggcgtatccaacccgtccgccatcttcctcgccagctaccgcgacgacacgcccggttcgtgcgttttggttacacaggaaggcagccgcccgcttttggtcgaaattcaggcattggtcgatgacgcgcacggcttcacacccaaacgcctcagcgtcggattggaacaaaaccgccttgcgatgctgcttgccgtgttaaaccggcacggcggcatcgcctgtttcgatcaggatgtttttttaaacgccgtcggcggcgtgaaaatcggcgaaccggcggcggatttggcggtcatcctcgcgatgctttccagcttccgcaaccgccctatgcctgaaaaaaccgtggtcttcggtgaaatcggcctaagcggcgaagtccgccccgtcgcacgcggacaagagcggctcaaagaagcggaaaagctcggcttcaaacgcgccatcgtccccaaagccaatatgccgcgcaatgccaaagagtttccgaacctgaaaatccacggcgtttcaagtttgcaggaagccatcgatatttgccgcgacagcagggaa

SEQ ID NO: 3092 - protein, 459 aa, Neisseria gonorrhoeae
MAKTLKTLYQCTECGGTSPKWQGKCPHCGEWNTLQESFAAPEPKNARFQSWAADASTVQSLSAVTAAEVPRNPTGMGELDRVLGGGLVDGAVILLGGDPGIGKSTLLLQTIAKMAQSRKVLYVSGEESAQQVALRSQRLELHAEGVNLLAEIRMEAIQAALKQHQPEVVVIDSIQTMYSDQITSAPGSVSQVRECAAQLTRMAKQMGIAMILVGHVTKDGAIAGPRVLEHMVDTVLYFEGDQHSNYRMIRAIKNRFGAANELGVFAMTENGLKGVSNPSAIFLASYRDDTPGSCVLVTQEGSRPLLVEIQALVDDAHGFTPKRLSVGLEQNRLAMLLAVLNRHGGIACFDQDVFLNAVGGVKIGEPAADLAVILAMLSSFRNRPMPEKTVVFGEIGLSGEVRPVARGQERLKEAEKLGFKRAIVPKANMPRNAKEFPNLKIHGVSSLQEAIDICRDSRE

SEQ ID NO: 3093 - DNA, 153 bp, Neisseria gonorrhoeae
ttggtttgtggcggattgaaacaagaaggcataccggcgacagataagatttgcggcaaagttgcctgtgatatggcaaaacgcatacgcccgtcatccctgcgaaggcgggaatccggaatcgtccgtttcggcaatgattggaaatcacgg

SEQ ID NO: 3094 - protein, 51 aa, Neisseria gonorrhoeae
LVCGGLKQEGIPATDKICGKVACDMAKRIRPSSLRRRESGIVRFGNDWKSR

SEQ ID NO: 3095 - DNA, 144 bp, Neisseria gonorrhoeae
ttgcctgtgatatggcaaaacgcatacgcccgtcatccctgcgaaggcgggaatccggaatcgtccgtttcggcaatgattggaaatcacggtaacccaaccgcttggattcccgacttcgggggaatgaggggcgtgtgcatt

SEQ ID NO: 3096 - protein, 48 aa, Neisseria gonorrhoeae
LPVIWQNAYARHPCEGGNPESSVSAMIGNHGNPTAWIPDFGGMRGVCI

SEQ ID NO: 3097 - DNA, 2022 bp, Neisseria gonorrhoeae
tctgaacaagccccagaaggtcatgccgagcaagaccaatacgccgaacaccatagcggcggcgtaggtgtagataaagccggtttgggctttgcgtacctgagcggcaatcgcgccgaccagtttggcggagccgttgacgatgccgttgtcgataatggcggtatcgccgactttccagaagaagtttcccaatgcgcgcgtgcctttggcgaagacgttgaaatacaaggcgtcgaggtagtatttgttttcaaacaaaacgtaaaccggacggaacgcctgcgcgattttagcgggcaggtgcggcagtttgacgtacaaaagccacgcggcggcaacaccggcagccgccaaatacaaaacaggcgatgtcaagctgtgcgacaccattgccaatgcgccgtggaactcttctttcatgatgtgcatggtcggatgcgcgtcggcgttgacgaaaatcacgtctttgaagaaatcgccgtagagcatgggttcgatggcgatgtagccgatgatgacggacggaatcgcaagcagaatcagcggcagggtaacgaccagcgggctttcgtgcggattgtcgtttttgcccaagccgtgatgttcttcaccatggccgtctgaatggtgttcgggcaggctgcgccatttttcttcgccgtggaacaccataaagtattggcggaacgcgtaaaacgcggtaacgaacacgctggcgaggacggcaaaataggcaacgccgctgcccggcagggtgctgtatttcactgcttcgataatcgaatctttggagtagaagccggagaagaacggcgtaccgatcagagacaaattgccgatcagcatagtcagccaagtaatcggcatgtattttttcaggttgcccatatggcgcatatcttgatcgtggtgcataccgataatcgcactgcccgccgccaagaacagcaaggctttaaagaaggcgtgggtcatgacgtggaacatcgccacagaataggcggacgcgcccagagccacggtcatgtagcccagttgcgacagggtagaatacgcaaccacacgtttgatgtcgttttgaatcacacccaagaagcccataaacagggcggtaatcgcgccgattaccataatgaccgacagcgcggtgctgctcatctcataaatcggcgacatacgcgacaccataaacaaaccggcggtaaccatcgtcgcggcgtgaatcaatgcagaaatcggagtcgggccttccatcgaatcaggcagccagacgtgcagcgggaattgtgccgatttacccatcgcaccgacaaacaggagcaaacaggttacggtaatcaaagaccattccacgccggggaaaagctggatagtggcattttgtacgttgggcagataggcgaatacgtcctgataacgcaggctgccgccgaaataggcaagcaccaagccgataccgagcaaaaagccgaagtcgccgacacggttgatcaaaaaggctttcaggttggcaaatgtcgcgctcggacgtttgaaatagaaaccgatcaagagatacgacaccaagcccaccgcttcccaaccgaagaagagctggatgaagttgttgctcataatcagcatcaacatgctgaaagtaaacaaagaaatatagctgaagaagcgttggtagccgactttttcatcgtgcatataaccgatggtatagatatgcaccatcaacgacacgcccgttaccacgaccatcatcatcgccgtcatcgtatcgaccaagaagccgacggaaaaatccaagccgcccattgtcagccaggtatagacgttttcgtcaaacttggtacggctgccattgaggaatccccacagcacataagccgacagcacggcagatacagcgacaccgagtatcgtaaccgtatgcgcgccggcacgcccgattttgttgccgaacaaacccgcaatcagcgagcctgccaacggaacaagggcaattatcaaatataaagtcatatcgttcat

SEQ ID NO: 3098 - protein, 208 aa, Neisseria gonorrhoeae
SEQAPEGHAEQDQYAEHHSGGVGVDKAGLGFAYLSGNRADQFGGAVDDAVVDNGGIADFPEEVSQCARAFGEDVEIQGVEVVFVFKQNVNRTERLRDFSGQVRQFDVQKPRGGNTGSRQIQNRRCQAVRHHCQCAVELFFHDVHGRMRVGVDENHVFEEIAVEHGFDGDVADDDGRNRKQNQRQGNDQRAFVRIVVFAQAVMFFTMAV

SEQ ID NO: 3099 - DNA, 609 bp, Neisseria gonorrhoeae
atgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactctcaaatgattcgtccgttccgtgcggaaaccgagcgttacggtcattactctgttgccggagagtcggtttacgaccatccgttccaatggggttccaaacgtaccggtcctgatttggcacgtgtgggcggccgctattccgacgaatggcaccgcatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcgcctgaggctttggcaaacaaatccgagctggatgctgtagtcgcctatctgcaaggattgggtctggctttgaaaaacgtaagg

SEQ ID NO: 3100 - protein, 203 aa, Neisseria gonorrhoeae
MKLQQLAEEKIGVLIVFTLLVVSVGLLIEVVPLAFTKAATQPAPGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 3101 - DNA, 129 bp, Neisseria gonorrhoeae
atgatatgttgcccgtcaacacaaaataaaaaacaaagttgcaacatgctgatttatattgttatttttatttacgtttatttacgatatgcaaatgcacggttacacaaatatattcgcgcaaccgtt

SEQ ID NO: 3102 - protein, 43 aa, Neisseria gonorrhoeae
MICCPSTQNKKQSCNMLIYIVIFIYVYLRYANARLHKYIRATV

SEQ ID NO: 3103 - DNA, 471 bp, Neisseria gonorrhoeae
gtgcatttgatttccatccgccatatgtcggcgacgggcttattcgcctacggttttttgtatcagtttttcggcgtttgccaaagtgtttgccacttcgtcgaaactgatgcggctgccgacgatgagggcgcgcgtatcggtataggcggtgcgtactttgccgtccgtttcggtaacgaggacgcgcaggggcagttgcagggcgaaggcggggtctttgaccatcagcggcgtaccggccttgggcgtgccgaagacgatgacttttgccggctgcatggtcaggccgtttcggcgtgccgcttcctgatggtcgatgacggcaaaaatgtccatccctttgctttttatggcggtttcaaggcggctgacggtttcgtcaaaactgtatttcgaggtgagggtgtgcgtggtcatagcggtttcgttttgggtgggcggtttgccggcagggtgtgccgaagcggt

SEQ ID NO: 3104 - protein, 157 aa, Neisseria gonorrhoeae
VHLISIRHMSATGLFAYGFLYQFFGVCQSVCHFVETDAAADDEGARIGIGGAYFAVRFGNEDAQGQLQGEGGVFDHQRRTGLGRAEDDDFCRLHGQAVSACRFLMVDDGKNVHPFAFYGGFKAADGFVKTVFRGEGVRGHSGFVLGGRFAGRVCRSG

SEQ ID NO: 3105 - DNA, 378 bp, Neisseria gonorrhoeae
atgaccacgcacaccctcacctcgaaatacagttttgacgaaaccgtcagccgccttgaaaccgccataaaaagcaaagggatggacatttttgccgtcatcgaccatcaggaagcggcacgccgaaacggcctgaccatgcagccggcaaaagtcatcgtcttcggcacgcccaaggccggtacgccgctgatggtcaaagaccccgccttcgccctgcaactgcccctgcgcgtcctcgttaccgaaacggacggcaaagtacgcaccgcctataccgatacgcgcgccctcatcgtcggcagccgcatcagtttcgacgaagtggcaaacactttggcaaacgccgaaaaactgatacaaaaaaccgtaggcgaa

SEQ ID NO: 3106 - protein, 126 aa, Neisseria gonorrhoeae
MTTHTLTSKYSFDETVSRLETAIKSKGMDIFAVIDHQEAARRNGLTMQPAKVIVFGTPKAGTPLMVKDPAFALQLPLRVLVTETDGKVRTAYTDTRALIVGSRISFDEVANTLANAEKLIQKTVGE

SEQ ID NO: 3107 - DNA, 216 bp, Neisseria gonorrhoeae
gtgccgaagcggttgaaatgcagagtgcggatgcggcgatcagggggagtatgtgtttcatcgtatttccttatcggtttgtttatcgggcttcggacggggcggcacgcgccgcgcctgatgccgtgccgcgtgccggaacgccgtatgccgtctgaaagcctgtcctttcagacggcattgcgtcatttcatcccttttttgagcaggtcttca

SEQ ID NO: 3108 - protein, 72 aa, Neisseria gonorrhoeae
VPKRLKCRVRMRRSGGVCVSSYFLIGLFIGLRTGRHAPRLMPCRVPERRMPSESLSFQTALRHFIPFLSRSS

SEQ ID NO: 3109 - DNA, 441 bp, Neisseria gonorrhoeae
ttggcgttgggacatagatgccgccgctttggaacagataaaataacttcccgtcccttaagacgacaaccgcaggagaaccctatgaatatcaaacaattgattaccgccgcactcattgcctcagccgcctttgccacgcaggcagccccgcaaaaacccgtatccgccgcccaaaccgcgcaacattcagccgtttggatcgatgtccgttccgaacaggaatttagcgaaggtcatttgcacaacgcggtcaacatccccgtcgaccaaatcgtccgccgcatatacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaa

SEQ ID NO: 3110 - protein, 147 aa, Neisseria gonorrhoeae
LALGHRCRRFGTDKITSRPLRRQPQENPMNIKQLITAALIASAAFATQAAPQKPVSAAQTAQHSAVWIDVRSEQEFSEGHLHNAVNIPVDQIVRRIYEAAPDKDTPVNLYCRSGRRAEAALQELKKAGYTNVANHGGYEDLLKKGMK

SEQ ID NO: 3111 - DNA, 3474 bp, Neisseria gonorrhoeae
ttggaacaaaaaagcgtcgagcgcgtattggtcgttaccttcaccaaagccgccactgccgagctgaaaacacgcctgcgcgcgcgtttggacgatgtgttgcaggttttggaaagcaaagaaattgccgaacttggagacgacacgctttcagacggcattgccgcctactgcgccgaacaccacgaaggcgacaccttcctgcccgcactcttggaacaggctttgcaaaaagaaagccggacgcgtctgattgtccgcctcaaggccgccatcgggcaattcgacaacgccgccatctacaccatccacggcttctgccagcgcatcctgcgcgactacgccttcctgtgccaagcaccgttcgatgtcgaactgaccgaagaagacggcgaccgcctgcttgtcccggctcaagatttttggcgggaacgcgtcagcggcgacccggtgcttgccgcattggcgtttaaacgcaaagctgtgccgcaaaccgtccttgcccaaatccgcgcctacctgtcccgcccgtacctgaatttccgccgtccgcaggcggatttgaaacaggcgcagcgcgacgccgaaacctcatggcaaaccgtctgccgcctgctgcccgagctggaagccggcttttggcgcatccatcccgacctcaacggcaacagttaccgcaaaaacagcttcggcaacctttttaaagaactggcacaaaaatccgccgccggacaactgccctgtctggacaaagacacgcacgaacggctcttgaaactctcatccgacaaacttgaagccggactgaaaaaaggcaaaacgcccgatgcggcagtatttgccgaattgcagaaactggcagacttcgggcgcgatttgaacgcactcgaagaagcggaagaaacaacaatgatccggctgcaactggatttaatcgaatatctcaacagcagccttgccgaaatgaaaaaatcgcgccgcgaacgcggtttcgacgacctgctgctcgatgtccacaccgcgctgaccgacaatccgcacgccgaaacccccgcccgcgccgttgccgaaaactgggaaatcgcgctgatcgacgagttccaagacaccgacccgctgcaatacgaaatcttccaaaagattttcatcgcccgaaaccgcccgctgttcctcgtcggcgaccccaaacaggcgatttacagctttcgcggtgcggacatttacgcctaccttcaggcggcggaagacgcgcggcaccgctacacgctcgccaccaactaccgcagccacgccgcgcttatcggcagcatcggcgcgctgttccgcctcaaagaacgcccgttcgttttggaaaacatcggctattcggaagtcggtgcggcgcgtgccgaaagcaggttgtcgcccaaacgtcctgccgtacagctccgttggctgcacgaaaacgacaatgaaaaagccaacaaagacgttttgcgccgccgtgccgccgactattgcgccgacgaaatcgcccgcgcgctcaacgaagcctccggaggccgtctgaatttcaaagaccgcccgttgcagtcgggcgatattgccgttctggtacgcacgcacaacgaggcggtgatgatttccgccgcactgaaaaaacggcaggtgcaaagcgtcctgctttcgcgcgaatccgtgttcgcctcgcccgaagccgccgccctgtccgcgctcatcggcttctggctcgaaccgcgccgcgccggaacgctgcgctttgtcctgacaagcggcatattcggttatgacgcgcagcaattgcacgacttcaaccaaaacgaaagcgagattttgcattgggcggaatctgcccgaaccgcgctcgacatatggcaaaaatacggcattttcgccgctatgcagcagttttcccaaacacacggcatcgaaacgcgcctcttaagccggaacaacgggcgcagcctgaccaattatttccaactgctcgaactgcttgccgccgaagacgcgcaaaaccgcaaccccgccgcactgcacaaatggctgcgcgatcaaatcagcctggccggcaacaacggcggcgacaaccgcgccatccgtttggaaagcgacgaagatttggtcaaaatcgttaccatgcacgcctcgaaaggtttgcagtatccgctggtgtactgcccgtttgcgtgggacgcgcaagataccggaccgtccgactggcaaatcctccaccaaggcgcaaaccgggccgaacttttggcaaaggcgcaactgtcggaaagcgaacagaagcaatacgccgacgaagaaatggcggaacgcctgcgcctgctttatgtcgcgctgacgcgtgccgaggaacagctcaacatctacgccgcctattcttccgataccgccgacaaccccctcgcctacctgatcgaaggcttgccgcaagacagccgcgaaaccgtccgccgtacctatgcgtgtgaaaaagacggcataacgatgctcaaacgcaactggcggcgcgtggcggacaatgccccggccggcacggatttcaccttcacagaagatgcgccgccccctgccgcctatcgcggcaacgccgatcaagccgccgaatttgccgcaaacagcattcccgaacgcggattccgatttgtccgccacaccagctttaccgccttaagccgccatacccaaacgcccgacggcggcgaagaagatgcctgcccgtccttggatgccgccgaaacctcggtgccggcgatgccgtctgaaacgccgacggcttcagacggcatatcgatacacgactttccgaaaggcacgcaggcggggctgtgcctgcacgaaattcttgaagatttcaaattcggacaagcagccgccgaacaggaaaccctcattgccgacaagctgaaaaaatacggttttgaagaaatatggctgcccgccgttgccgaaatggcggaagcctgccgcaaaacgccgctgactggggcatacggcctgtccgacatcccgcccgggtgccgccgtcccgaaatgggctttaccctccacaccgaagacttcggcctcaaacggctgcgcgactggcttgcccgcgacgacatcaggctgcccgaagtctgccgtgccgccgccgagacgctcgacttccacaccgtcaacggctttttaaacggctttatcgatatggtctgccaagaccccgacggcaatatctgcatcatcgactacaaatccaaccacctatccgcctacacgcggcaggcgatggacgaagccgtcgcgcaccagcactattaccttcaggcactgatttacgccgttgccgccgcgcgctacttcaaactgcgcggacaaccgcccgccgccgtttccgtccgctacctgtttttgcgcggattggatggcaaaggcggcggcgtttggcgttgggacatagatgccgccgctttggaacagataaaa

SEQ ID NO: 3112 - protein, 1158 aa, Neisseria gonorrhoeae
LEQKSVERVLVVTFTKAATAELKTRLRARLDDVLQVLESKEIAELGDDTLSDGIAAYCAEHHEGDTFLPALLEQALQKESRTRLIVRLKAAIGQFDNAAIYTIHGFCQRILRDYAFLCQAPFDVELTEEDGDRLLVPAQDFWRERVSGDPVLAALAFKRKAVPQTVLAQIRAYLSRPYLNFRRPQADLKQAQRDAETSWQTVCRLLPELEAGFWRIHPDLNGNSYRKNSFGNLFKELAQKSAAGQLPCLDKDTHERLLKLSSDKLEAGLKKGKTPDAAVFAELQKLADFGRDLNALEEAEETTMIRLQLDLIEYLNSSLAEMKKSRRERGFDDLLLDVHTALTDNPHAETPARAVAENWEIALIDEFQDTDPLQYEIFQKIFIARNRPLFLVGDPKQAIYSFRGADIYAYLQAAEDARHRYTLATNYRSHAALIGSIGALFRLKERPFVLENIGYSEVGAARAESRLSPKRPAVQLRWLHENDNEKANKDVLRRRAADYCADEIARALNEASGGRLNFKDRPLQSGDIAVLVRTHNEAVMISAALKKRQVQSVLLSRESVFASPEAAALSALIGFWLEPRRAGTLRFVLTSGIFGYDAQQLHDFNQNESEILHWAESARTALDIWQKYGIFAAMQQFSQTHGIETRLLSRNNGRSLTNYFQLLELLAAEDAQNRNPAALHKWLRDQISLAGNNGGDNRAIRLESDEDLVKIVTMHASKGLQYPLVYCPFAWDAQDTGPSDWQILHQGANRAELLAKAQLSESEQKQYADEEMAERLRLLYVALTRAEEQLNIYAAYSSDTADNPLAYLIEGLPQDSRETVRRTYACEKDGITMLKRNWRRVADNAPAGTDFTFTEDAPPPAAYRGNADQAAEFAANSIPERGFRFVRHTSFTALSRHTQTPDGGEEDACPSLDAAETSVPAMPSETPTASDGISIHDFPKGTQAGLCLHEILEDFKFGQAAAEQETLIADKLKKYGFEEIWLPAVAEMAEACRKTPLTGAYGLSDIPPGCRRPEMGFTLHTEDFGLKRLRDWLARDDIRLPEVCRAAAETLDFHTVNGFLNGFIDMVCQDPDGNICIIDYKSNHLSAYTRQAMDEAVAHQHYYLQALIYAVAAARYFKLRGQPPAAVSVRYLFLRGLDGKGGGVWRWDIDAAALEQIK

SEQ ID NO: 3113 - DNA, 99 bp, Neisseria gonorrhoeae
atgccgtctgaaaccctttttcagacggcattttcccgttttaccgtccaaccgttttcatacacgctatgtccgcacccatccgagcattcgacccgc

SEQ ID NO: 3114 - protein, 33 aa, Neisseria gonorrhoeae
MPSETLFQTAFSRFTVQPFSYTLCPHPSEHSTR

SEQ ID NO: 3115 - DNA, 906 bp, Neisseria gonorrhoeae
atgaacacgccccaatccgccatcattcccgaccacgcccaagccggcatctttatcgaagccgacttcgccgccaaccgcctcaacgatattaaagccgcctgccgcgcttcgctcgacgcgttatccgccttgaaagcccgctttccggacgatattttgggtctgaccatcgccttcggcagcaaagcctgggcaacattcggacacacggacgaaggcagtgaaatcaaacccttccccgaaatgggcaacgggcttgcgccgtccacgcagcacgatatgtccatccacatccaatccttccgccaaaacgccgcctacgcgcttgcccaatccgttttgggcgcgttcggcgacagcatatgcgtcgcgtccgaagaacacggtttgcgcctgtatcaggatcgcgggctggacggtttcgtcgacggcacggaaaacccgcaaggcgatgaaacaatccgcgaagtcgccatcatccccgaagggctgcccgatgcaggcggcagctatgtcctgctgcaaaaatacctgcacgatttgaaaaaatgggatgccgtccccgtcgccgaacaggaggcctcggtcggacgcagcaaggaaaccgacgacgaattcagccgcgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcataatatcgaagcgcaattattgagtatgttcggcgacacggacggcaaaaccgacctgctgctccgacacctctccgccgccgtttcgggcggatactactacgcgccgtccgtcgaacgcctgcaaaacctc

SEQ ID NO: 3116 - protein, 302 aa, Neisseria gonorrhoeae
MNTPQSAIIPDHAQAGIFIEADFAANRLNDIKAACRASLDALSALKARFPDDILGLTIAFGSKAWATFGHTDEGSEIKPFPEMGNGLAPSTQHDMSIHIQSFRQNAAYALAQSVLGAFGDSICVASEEHGLRLYQDRGLDGFVDGTENPQGDETIREVAIIPEGLPDAGGSYVLLQKYLHDLKKWDAVPVAEQEASVGRSKETDDEFSRDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 3117 - DNA, 207 bp, Neisseria gonorrhoeae
gtgaaattgcggcaaacacaaagaatactttttttatatggttattccaaatcggaatgggaaagatatgccgaagccgccggaagcggaaataaagggggcgggaaaggcggcgggcggcacgaaaccgaaaagcggcatcaggtatgcaaacggcggattcacgcacgccgttccggcaaaaatccgcctgccgattcggtgcta

SEQ ID NO: 3118 - protein, 69 aa, Neisseria gonorrhoeae
VKLRQTQRILFLYGYSKSEWERYAEAAGSGNKGGGKGGGRHETEKRHQVCKRRIHARRSGKNPPADSVL

SEQ ID NO: 3119 - DNA, 105 bp, Neisseria gonorrhoeae; identical to SEQ ID NO: 1035

SEQ ID NO: 3120 - protein, 35 aa, Neisseria gonorrhoeae; identical to SEQ ID NO: 1036

SEQ ID NO: 3121 - DNA, 303 bp, Neisseria gonorrhoeae
ccctttcaactcgtccaaatcggcaacattaatcgtttgtcggttgcggtacaccagcaccataatcgccaaaccgatggcagattcggcagcggcaacggtcaatacgaagaatacgaaaatttgtccggcagtatcgcccaaatgttgcgagaaggcgataaagttgaagttcaccgccaaaagcatcagctcgatggacatcagcaataccagcacgtttttgcggttcataaagatgcccatcgcgctgataccgaacaggagagcgcccaataccagataatgcgtcaaagtaatcat

SEQ ID NO: 3122 - protein, 101 aa, Neisseria gonorrhoeae
PFQLVQIGNINRLSVAVHQHHNRQTDGRFGSGNGQYEEYENLSGSIAQMLREGDKVEVHRQKHQLDGHQQYQHVFAVHKDAHRADTEQESAQYQIMRQSNH

SEQ ID NO: 3123 - DNA, 1443 bp, Neisseria gonorrhoeae
atggagactctcatggacacacaaacttacaactacaaagtggtgcgccagttcgccatcatgactgtagtttgggggattgtgggcatgttggtcggcgttatcgtcgccgcccagctttttgctcctgccctcgacttgtctaatatcggaccttggttccacttcggccgcctgcgtccgctgcacaccaatgcggttattttcgcatttggcggttgcggtctgatcggcacatcatactacgttgtccaacgtacttgtaatacccgtcttttcggcggttggctgccggcatttaccttttggggttggcaggcggtaatcgttgccgccgtcgtcagcttccctatgggttggacccaaggtaaggaatatgccgaactggaatggccgattgacattctgattactttggtttgggtggcttacgccatcgtattcttcggtacgattgccaaacgcaaggtaaaacacatttacgttgccaactggttctacggcggctttattttggcggtcgcacttttgcacatcgtcaacaatatcagcatcccggccggtttgatgaagtcataccccgtctattccggtgcgattgatgctatggttcaatggtggtacgggcataacgccgtgggcttcttcctgactgccggctttttgggtatgatgtactatttcgtacccaaacaagcagcccgccccgtttactcctaccgcctgtccgtcgttcacttctgggcgttgattttcacctatatgtgggcgggtccgcaccatcttcactacactgcgctgcctgactggacgcaatctttgggtatggttctgtccttgattttgttcgcaccctcttggggcggtatgattaacggcattatgaccttgtccggcgcgtgggacaaactgcgtacagacccgattcttaaattcctgattgtatccttgtccttctacggtatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattccccgtctgttcggcaaagagcagatgcacagcaccaagctggtagaggcgcatttctggattgcgactatcggtgtggttctgtatatcgccgcgatgtggattgcaggtgtgatgcagggtttgatgtggagttctctgaacgatgacggtacgctgacctactcgtttgtcgaatccgtaaaacgcaccatgccttactacatgatccgttttgcaggtggtttattgtatctgagtggcatgtgcattatggcgtacaacgtgtaccgcacagccatcggtggtaaagcagtcgatgccgaaatccctgcggtttcccaaacacagcaccac

SEQ ID NO: 3124 - protein, 481 aa, Neisseria gonorrhoeae
METLMDTQTYNYKVVRQFAIMTVVWGIVGMLVGVIVAAQLFAPALDLSNIGPWFHFGRLRPLHTNAVIFAFGGCGLIGTSYYVVQRTCNTRLFGGWLPAFTFWGWQAVIVAAVVSFPMGWTQGKEYAELEWPIDILITLVWVAYAIVFFGTIAKRKVKHIYVANWFYGGFILAVALLHIVNNISIPAGLMKSYPVYSGAIDAMVQWWYGHNAVGFFLTAGFLGMMYYFVPKQAARPVYSYRLSVVHFWALIFTYMWAGPHHLHYTALPDWTQSLGMVLSLILFAPSWGGMINGIMTLSGAWDKLRTDPILKFLIVSLSFYGMSTFEGPMMSIKTVNALSHYTDWTVAHVHAGALGWVGFVTIGSVYYMIPRLFGKEQMHSTKLVEAHFWIATIGVVLYIAAMWIAGVMQGLMWSSLNDDGTLTYSFVESVKRTMPYYMIRFAGGLLYLSGMCIMAYNVYRTAIGGKAVDAEIPAVSQTQHH

SEQ ID NO: 3125 - DNA, 822 bp, Neisseria gonorrhoeae
atgttgaaaaaattcgtactcggcggcattgccgcattggttttggcggcctgcggcggttcggaaggcggcagcggagcatcttccgcgcctgcacaatcggcaatttccggttctttaatcgagcgcatcaacaataaaggcacggttaccgtcggcacggaaggcacttacgcaccgtttacctaccacgacaaagacggcaaactgaccggttacgacgtggaagtaacccgcgccgtggcggaaaaactgggcgtaaaagtcgagtttaaagaaacgcaatgggattcgatgatggcgggtttgaaagccggacgtttcgacgtggtggcaaaccaagtcggcctgaccagccccgaacgccaggcgacatttgacaaatccgaaccttacagctggagcggtgcggttttggttgcgcataacgacagcaacattaaatccatagccgacatcaaaggcgtgaaaaccgcgcaatccctgaccagcaactacggcgaaaaagccaaagccgcaggtgcgcaactcgtgccggtggacggtttggcgcaatcgctgaccctgattgaacaaaaacgcgccgatgcgacgttgaacgatgaattggcggttttggactatctgaagaaaaacccgaatgcgggggtgaaaatcgtgtggtccgcgcctgccgatgaaaaagtcggttccggtctgattgtcaacaagggcaatgacgaggccgtggcgaaattcagcacggcaatcaacgagctgaaagccgacggcacgttgaaaaaactgggcgaacaattcttcggaaaagacatcagtgttcaa

SEQ ID NO: 3126 - protein, 274 aa, Neisseria gonorrhoeae
MLKKFVLGGIAALVLAACGGSEGGSGASSAPAQSAISGSLIERINNKGTVTVGTEGTYAPFTYHDKDGKLTGYDVEVTRAVAEKLGVKVEFKETQWDSMMAGLKAGRFDVVANQVGLTSPERQATFDKSEPYSWSGAVLVAHNDSNIKSIADIKGVKTAQSLTSNYGEKAKAAGAQLVPVDGLAQSLTLIEQKRADATLNDELAVLDYLKKNPNAGVKIVWSAPADEKVGSGLIVNKGNDEAVAKFSTAINELKADGTLKKLGEQFFGKDISVQ

SEQ ID NO: 3127 - DNA, 756 bp, Neisseria gonorrhoeae
atgagcatatcagcgcgtgtttccgtcataaacggcagagaggcaaggaaattattgaacactgatgtcttttccgaagaattgttcgcccagttttttcaacgtgccgtcggctttcagctcgttgattgccgtgctgaatttcgccacggcctcgtcattgcccttgttgacaatcagaccggaaccgactttttcatcggcaggcgcggaccacacgattttcacccccgcattcgggtttttcttcagatagtccaaaaccgccaattcatcgttcaacgtcgcatcggcgcgtttttgttcaatcagggtcagcgattgcgccaaaccgtccaccggcacgagttgcgcacctgcggctttggctttttcgccgtagttgctggtcagggattgcgcggttttcacgcctttgatgtcggctatggatttaatgttgctgtcgttatgcgcaaccaaaaccgcaccgctccagctgtaaggttcggatttgtcaaatgtcgcctggcgttcggggctggtcaggccgacttggtttgccaccacgtcgaaacgtccggctttcaaacccgccatcatcgaatcccattgcgtttctttaaactcgacttttacgcccagtttttccgccacggcgcgggttacttccacgtcgtaaccggtcagtttgccgtctttgtcgtggtaggtaaacggtgcgtaagtgccttccgtgccgacggtaaccgtgcctttattgttgatgcgctcgat

SEQ ID NO: 3128 - protein, 252 aa, Neisseria gonorrhoeae
MSISARVSVINGREARKLLNTDVFSEELFAQFFQRAVGFQLVDCRAEFRHGLVIALVDNQTGTDFFIGRRGPHDFHPRIRVFLQIVQNRQFIVQRRIGAFLFNQGQRLRQTVHRHELRTCGFGFFAVVAGQGLRGFHAFDVGYGFNVAVVMRNQNRTAPAVRFGFVKCRLAFGAGQADLVCHHVETSGFQTRHHRIPLRFFKLDFYAQFFRHGAGYFHVVTGQFAVFVVVGKRCVSAFRADGNRAFIVDALD

SEQ ID NO: 3129 - DNA, 681 bp, Neisseria gonorrhoeae
atgacggaaacacgcgctgatatgctcatcagcgcgttttggcccatggttaaagccggctttacagtgtctttgcctttggcgatcgcttctttcgttatcggcatgattattgccgtagccgttgctttggtaagaatcatgccttccggcggtattttccaaaaatgcttgttgaagctggtggaattttatatttccgtcgttcgcggtacgccgctgttggttcagcttgtgattgtgttttacgggctgccgtccgtcggcatctatatcaatccgattcccgccgccatcatcggcttttcgctcaatgtcggcgcatacgcttccgaaaccatacgcgcggcgattttgtccgtgccgaaagggcagtgggaagcaggtttctccatcggtatgacctatatgcagacgttccgccgcatcgtcgcaccgcaggcattccgcgtcgccgttccgccgttgagcaacgagtttatcggcttgttcaaaaacacctcgcttgccgccgtggtaacggtaacggagcttttccgtgtcgcacaggaaacggcaaaccgcacttatgactttttgcctgtctatatcgaagctgcattggtttattggtgtttctgtaaagtgctgtttttgattcaggcgcgtttggaaaaacgtttcgaccgttatgtcgccaaa

SEQ ID NO: 3130 - protein, 227 aa, Neisseria gonorrhoeae
MTETRADMLISAFWPMVKAGFTVSLPLAIASFVIGMIIAVAVALVRIMPSGGIFQKCLLKLVEFYISVVRGTPLLVQLVIVFYGLPSVGIYINPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 3131 - DNA, 750 bp, Neisseria gonorrhoeae
atggatattgcggattttaatcatgacaactccttatttggcgacataacggtcgaaacgtttttccaaacgcgcctgaatcaaaaacagcactttacagaaacaccaataaaccaatgcagcttcgatatagacaggcaaaaagtcataagtgcggtttgccgtttcctgtgcgacacggaaaagctccgttaccgttaccacggcggcaagcgaggtgtttttgaacaagccgataaactcgttgctcaacggcggaacggcgacgcggaatgcctgcggtgcgacgatgcggcggaacgtctgcatataggtcataccgatggagaaacctgcttcccactgccctttcggcacggacaaaatcgccgcgcgtatggtttcggaagcgtatgcgccgacattgagcgaaaagccgatgatggcggcgggaatcggattgatatagatgccgacggacggcagcccgtaaaacacaatcacaagctgaaccaacagcggcgtaccgcgaacgacggaaatataaaattccaccagcttcaacaagcatttttggaaaataccgccggaaggcatgattcttaccaaagcaacggctacggcaataatcatgccgataacgaaagaagcgatcgccaaaggcaaagacactgtaaagccggctttaaccatgggccaaaacgcgctgatgagcatatcagcgcgtgtttccgtcataaacggcagagaggcaaggaaattattgaacac

SEQ ID NO: 3132 - protein, 250 aa, Neisseria gonorrhoeae
MDIADFNHDNSLFGDITVETFFQTRLNQKQHFTETPINQCSFDIDRQKVISAVCRFLCDTEKLRYRYHGGKRGVFEQADKLVAQRRNGDAECLRCDDAAERLHIGHTDGETCFPLPFRHGQNRRAYGFGSVCADIERKADDGGGNRIDIDADGRQPVKHNHKLNQQRRTANDGNIKFHQLQQAFLENTAGRHDSYQSNGYGNNHADNERSDRQRQRHCKAGFNHGPKRADEHISACFRHKRQRGKEIIEH

SEQ ID NO: 3133 - DNA, 753 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatt

SEQ ID NO: 3134 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 3135 - DNA, 1380 bp, Neisseria gonorrhoeae
atggcaagcatcacccgcgacatcttcaaagcctacgacatccgtggcatcgtcggcaaaaccctgaccgacgatgccgcttatttcatcggcagggccatcgccgccaaagccgccgaaaaaggtatcgcccgcatcgcgatcggacgcgacggacgcttgagcggccccgaactgatggagcacatccaacgcggcctgaccgacagcggtatcggcgtactcaatgtcggcatggttaccactcctatgctctacttcgcagccgtcaacgaatgcggcggcagcggagtgatgattaccggcagccacaatccgcccgattacaacggtttcaaaatgatgctcggcggcgacacgctcgcaggcgaagccattcaagaacttttagctattgttgagaaagacggttttgttgccgccgacaaacaaggcagcgtaaccgaaaaagacatctccggcgcataccacgaccacatcgtcggacacgtcaaactcaaacgcccgataaacatcgccatcgacgcgggcaacggcgtgggcggcgcgtttgccggcaaactctacaaaggtttgggcaacgaagtgaccgaacttttctgcgaagtggacggcaatttccctaatcaccaccctgatccttccaaaccggaaaacctgcaagatttgattgccgcgctgaaaaacggcgatgccgaaatcggcttggcgtttgacggcgatgccgaccgcttgggcgtggttaccaaagacggcaacattatttatcccgaccgccaactgatgctgttcgcccaagacgttttgaaccgcaatcccggcgcgaaagtcattttcgatgtcaaatccacacgcctgcttgccccgtggattaaagaacacggcggagaagccataatggaaaaaaccggccacagcttcatcaaatccgctatgaaaaaaaccggtgcactggttgccggcgaaatgagcggacacgttttctttaaagaacgctggttcggcttcgacgacggcctgtatgccggcgcacgcctcttggaaatcctgtccgcctccgacaatccgtccgaagtgttggacaacctgccgcaaagcatttccacgcccgaactcaacatctccctgcccgaaggcagcaacgggcatcaagttatcgaagaactcgccgccaaagccgaatttgaaggcgcaaccgaaatcatcaccatcgacggcctgcgcgttgaatttcccgacggcttcggtctgatgcgtgcttccaataccacgccgattttggtgttgcgttttgaagcggatacgcaagcagccatcgagcgcattcaaaaccgattcaaagccgtcatcgaaagcaatccgcatttaatctggcctctg

SEQ ID NO: 3136 - protein, 460 aa, Neisseria gonorrhoeae
MASITRDIFKAYDIRGIVGKTLTDDAAYFIGRAIAAKAAEKGIARIAIGRDGRLSGPELMEHIQRGLTDSGIGVLNVGMVTTPMLYFAAVNECGGSGVMITGSHNPPDYNGFKMMLGGDTLAGEAIQELLAIVEKDGFVAADKQGSVTEKDISGAYHDHIVGHVKLKRPINIAIDAGNGVGGAFAGKLYKGLGNEVTELFCEVDGNFPNHHPDPSKPENLQDLIAALKNGDAEIGLAFDGDADRLGVVTKDGNIIYPDRQLMLFAQDVLNRNPGAKVIFDVKSTRLLAPWIKEHGGEAIMEKTGHSFIKSAMKKTGALVAGEMSGHVFFKERWFGFDDGLYAGARLLEILSASDNPSEVLDNLPQSISTPELNISLPEGSNGHQVIEELAAKAEFEGATEIITIDGLRVEFPDGFGLMRASNTTPILVLRFEADTQAAIERIQNRFKAVIESNPHLIWPL

SEQ ID NO: 3137 - DNA, 537 bp, Neisseria gonorrhoeae; identical to SEQ ID NO: 121

SEQ ID NO: 3138 - protein, 179 aa, Neisseria gonorrhoeae; identical to SEQ ID NO: 122

SEQ ID NO: 3139 - DNA, 669 bp, Neisseria gonorrhoeae
tgctttgccctccccttccgtcttgaggccgtctgaaacttcgctttcttcggcagattcgacttgcggtttgaccgcttccattttcaccagacgcatacggccttgatcggcgcgtactttaacttggtcggctggatccatacgtttcggattggtggttttgcggtgaaccaatgcaatcgcggccaccatgcccaacagcagcaataccgccgccaattcaaacggcaacaggtagtcggtataaatacggctgcccaaatcgcggatattgttgtaatcggccggaatgtctttcatcagaccaaatgcggccaggtcggttttcgggttgaccagaatcaggatcagggcaaccgccaacaacgtaccgaccacaccggcaacaggcgcgtgccgccagaaaccggcgcgcatttcctcgatgtcgatattcagcatcatcacgacgaacaggaacaacaccattacggcgccgacgtaaaccaccaccagcgtcacgcccaaaaactccgcctgcatcagcatccaaatcatcgcgctcacgcagaaggtcagcaccagatgcaaagcggcatggacagggtttttggcggtaacggtacgaaccgcaccgtacaaaacgatggcggcaaggatatagaacagaatcacggaaaaagtcat

SEQ ID NO: 3140 - protein, 11 aa, Neisseria gonorrhoeae
CFALPFRLEAV

SEQ ID NO: 3141 - DNA, 114 bp, Neisseria gonorrhoeae
atgcctttaaaatgcagcttaacctacatcaataaagtgccacaaaaagggaaaattggaaacaaaagcaatggcggccgggttgtaatttattataacaatatgatttatatg

SEQ ID NO: 3142 - protein, 38 aa, Neisseria gonorrhoeae
MPLKCSLTYINKVPQKGKIGNKSNGGRVVIYYNNMIYM

SEQ ID NO: 3143 - DNA, 672 bp, Neisseria gonorrhoeae
atgcgtagtattggttgctctgtgggcttatgctgtactgatgtaaaccatcgacctaaacaacaagaccgtctgaaagaatatttttcagacgaccttgaagtttgtcgttcagacacaatttgtcgaataattcaaaaccggattctaacgaaaggaaaacccatgattatcctgcacaccaacaaaggcgacatcaaaatcgaactcgatttcgacaaagcccctgttaccgccaaaaacttcgagcaatacgtcaaagacggcttctacgacggcgtaatcttccaccgcgtcatcaaaggcttcatgattcaaggcggcggcatggatgaaaacatgaacgaaaaagaaacccgcgatccgattcaaaacgaagcgtccaacggcctgcccaacgataaatacaccatcgccatggcgcgcacttccgacccccattccgccggcgcgcaattcttcatcaacactgccgacaacgctttcctaaacttccgttctaaagagctgtacggcaaaaccgtcgtccaagactggggctatgccgtattcggtaaagtcgttgacggttttgacgttgtcgatgccatcgaaagcgtatccaccaaacgccacggctaccacgacgatgtgccgaccgaacctgtcatcatcattaaagccgaagcagta

SEQ ID NO: 3144 - protein, 224 aa, Neisseria gonorrhoeae
MRSIGCSVGLCCTDVNHRPKQQDRLKEYFSDDLEVCRSDTICRIIQNRILTKGKPMIILHTNKGDIKIELDFDKAPVTAKNFEQYVKDGFYDGVIFHRVIKGFMIQGGGMDENMNEKETRDPIQNEASNGLPNDKYTIAMARTSDPHSAGAQFFINTADNAFLNFRSKELYGKTVVQDWGYAVFGKVVDGFDVVDAIESVSTKRHGYHDDVPTEPVIIIKAEAV

SEQ ID NO: 3145 - DNA, 1617 bp, Neisseria gonorrhoeae
atgaatccccctgatgcatcctgtttttccccttacatatcaatcccatctcataaacaaaaccgacaaatcgtttacaatatatttacactacaccgaattacaaatatactcgaagcggttgcagaaccgacggtttcgcaaaccgtttcggattgcacgatacaaaagaaaaaccgattttgttgccttaaaggagcattcatgaacctgcatgcaaaggacaaaacccagcatcccgaaaacgtcgagctgctcagtgcgcagaagccgattaccgactttaagggtttgctgaccaccattatttccgccgtcgtctgtttcggcatttaccacatcctgccttacagccccgatgccaataaaggtatcgcgctgctgattttcgttgccgcactttggttcaccgaggccgtccacatcacggtaaccgcattaatggtgccgattctcgccgtcgtactcggtttccccgacatggacatcaaaaaggcgatggctgatttttccaacccgattatctacatttttttcggcggcttcgcgcttgccaccgccctgcatatgcagcggctggaccgtaaaatcgccgtcagcctgttgcgcctgtcgcgcggcaatatgaaagtggcggttttgatgttgttcctcgttactgcctttctgtccatgtggatcagcaacaccgccaccgccgcgatgatgctgcctctagcaatgggtatgctgagccacctcgaccgggaaaaagaacacaaaacctacgtcttcctcctgctcggcatcgcctattgcgccagcatcggcggcttgggcacgctcgtcggctcgccgcccaacctgattgccgccaaagccctaaatctggacttcgtcggctggatgaagctcggcctgccgatgatgctgttgattctgcccttgatgctgctctccctgtacgtcatcctcaaacctaatttgaacgaacgcgtggaaatcaaagccgaatccatcccttggacgctgcaccgcgtcatcgcgctgttgattttccttgccacagccgccgcgtggatattcggctccaaaatcaaaaccgccttcggcatttccaatcccgacaccgttatcgccctgagtgccgccgtcgccgtcgtcgtcttcggcgtggcgcaatggaaggaagtcgcccgcaataccgactggggcgtgttgatgctcttcggcggcggcatcagcctgagcacgctgttgaaaacatccggcgcgtccgaagccttgggacagcaggttgccgccaccttttccggcgcgcccgcatttttagtgatactcatcgtcgccgccttcattatttttctgaccgagttcaccagcaacaccgcctccgccgccctgcttgtaccgattttctccggcatcgctatgcagatggggctgcccgaacaagtcttggtattcgtcatcggcatcgccgcatcttgcgccttcatgctgccggttgccacgccgcctaacgcgattgtgttcggcacgggcttaatcaaacaacgagaaatgatgaatgtcggcatactgctgaacatcctatgcgtagtattggttgctctgtgggcttatgctgtactgatg

SEQ ID NO: 3146 - protein, 539 aa, Neisseria gonorrhoeae
MNPPDASCFSPYISIPSHKQNRQIVYNIFTLHRITNILEAVAEPTVSQTVSDCTIQKKNRFCCLKGAFMNLHAKDKTQHPENVELLSAQKPITDFKGLLTTIISAVVCFGIYHILPYSPDANKGIALLIFVAALWFTEAVHITVTALMVPILAVVLGFPDMDIKKAMADFSNPIIYIFFGGFALATALHMQRLDRKIAVSLLRLSRGNMKVAVLMLFLVTAFLSMWISNTATAAMMLPLAMGMLSHLDREKEHKTYVFLLLGIAYCASIGGLGTLVGSPPNLIAAKALNLDFVGWMKLGLPMMLLILPLMLLSLYVILKPNLNERVEIKAESIPWTLHRVIALLIFLATAAAWIFGSKIKTAFGISNPDTVIALSAAVAVVVFGVAQWKEVARNTDWGVLMLFGGGISLSTLLKTSGASEALGQQVAATFSGAPAFLVILIVAAFIIFLTEFTSNTASAALLVPIFSGIAMQMGLPEQVLVFVIGIAASCAFMLPVATPPNAIVFGTGLIKQREMMNVGILLNILCVVLVALWAYAVLM

SEQ ID NO: 3147 - DNA, 468 bp, Neisseria gonorrhoeae
ttgccgcacgcggcggcaaattcctgcgcctgtccaaaatctgccaaacgtggctggacgaggaggcggcatgaagctgccgcgcaaccgcttcagcctgctttccgcattgtggtttgccggcggcatctattcgctgctcttcaaagctgccgacaccgcgccgccgccgtttccacatttcgacaaagcagcacaccttgccctgtttttcgcacaaatcttgcttctggccaaagcattcaaaaccggaaaacttcccatcccctaccgcagcctgattgcgttcgccttctgttttgccgtcggcagcgaatgcgcgcaggcatggtttaccgcaacgcgaaccggcagtttgggcgatgtccttgccgacctgacgggcgcagcccttgccctctttgccgcgcgttctgcctgccgcccggactaaatcggtttatttctcccaaacaggatgaatccccc

SEQ ID NO: 3148 - protein, 156 aa, Neisseria gonorrhoeae
LPHAAANSCACPKSAKRGWTRRRHEAAAQPLQPAFRIVVCRRHLFAALQSCRHRAAAVSTFRQSSTPCPVFRTNLASGQSIQNRKTSHPLPQPDCVRLLFCRRQRMRAGMVYRNANRQFGRCPCRPDGRSPCPLCRAFCLPPGLNRFISPKQDESP

SEQ ID NO: 3149 - DNA, 204 bp, Neisseria gonorrhoeae
atgaccgaactcaagcagcttatccaaaccgaatccatccccgtcatcgaagaaaccctcgatttcctgctgtacgaatgcagcatcgacgacgcaccgtccgccgaagaagtggcacaatggcgcgacatacttgccgcacgcggcggcaaattcctgcgcctgtccaaaatctgccaaacgtggctggacgaggaggcggca

SEQ ID NO: 3150 - protein, 68 aa, Neisseria gonorrhoeae
MTELKQLIQTESIPVIEETLDFLLYECSIDDAPSAEEVAQWRDILAARGGKFLRLSKICQTWLDEEAA

SEQ ID NO: 3151 - DNA, 381 bp, Neisseria gonorrhoeae
gtggctggacgaggaggcggcatgaagctgccgcgcaaccgcttcagcctgctttccgcattgtggtttgccggcggcatctattcgctgctcttcaaagctgccgacaccgcgccgccgccgtttccacatttcgacaaagcagcacaccttgccctgtttttcgcacaaatcttgcttctggccaaagcattcaaaaccggaaaacttcccatcccctaccgcagcctgattgcgttcgccttctgttttgccgtcggcagcgaatgcgcgcaggcatggtttaccgcaacgcgaaccggcagtttgggcgatgtccttgccgacctgacgggcgcagcccttgccctctttgccgcgcgttctgcctgccgcccggac

SEQ ID NO: 3152 - protein, 127 aa, Neisseria gonorrhoeae
VAGRGGGMKLPRNRFSLLSALWFAGGIYSLLFKAADTAPPPFPHFDKAAHLALFFAQILLLAKAFKTGKLPIPYRSLIAFAFCFAVGSECAQAWFTATRTGSLGDVLADLTGAALALFAARSACRPD

SEQ ID NO: 3153 - DNA, 660 bp, Neisseria gonorrhoeae
ttggataagctgcttgagttcggtcatgactgttcggatacggaaatcgggaaaatgccgtctgaaagggcttcagacggcattggattatttgctgtgcaggaagcgcgttgcctcttcccatttgccggaaatgatgtcgggtacggcctgcagggatttggcgacggcatcgtcgatttgccggcggtgttccgcgctcggtttgttcaagacgtagccgacgacgaggttgcggtcgccggggtggccgatgccgaggcgcaggcggtaatagtctgccgtgccgagttttgcctgaatgtctttcaagccgttgtgtccgccgttgccgccgccgagtttgaatttgatccgtccgcaagggatgtcgagttcgtcgtggacgacgaggatttcttcgggtttgattttgtagaactgtgcaagcgcggcaaccgcctgtccggaacggttcatgaacgtggccggtttgagcagccaaacatcgccgtcgggcagggcggcgcgggcaacttcgccgaagaattttttttcttctttaaacgaagccttccatttccacgccagttcgtcgaggaaccaaaagcccgcattgtggcgggtctgttcgtattctttgcccgggttgcccaagccgacaaccattttgattgtgtt

SEQ ID NO: 3154 - protein, 220 aa, Neisseria gonorrhoeae
LDKLLEFGHDCSDTEIGKMPSERASDGIGLFAVQEARCLFPFAGNDVGYGLQGFGDGIVDLPAVFRARFVQDVADDEVAVAGVADAEAQAVIVCRAEFCLNVFQAVVSAVAAAEFEFDPSARDVEFVVDDEDFFGFDFVELCKRGNRLSGTVHERGRFEQPNIAVGQGGAGNFAEEFFFFFKRSLPFPRQFVEEPKARIVAGLFVFFARVAQADNHFDCV

SEQ ID NO: 3155 - DNA, 576 bp, Neisseria gonorrhoeae
atgtcaaacacaatcaaaatggttgtcggcttgggcaacccgggcaaagaatacgaacagacccgccacaatgcgggcttttggttcctcgacgaactggcgtggaaatggaaggcttcgtttaaagaagaaaaaaaattcttcggcgaagttgcccgcgccgccctgcccgacggcgatgtttggctgctcaaaccggccacgttcatgaaccgttccggacaggcggttgccgcgcttgcacagttctacaaaatcaaacccgaagaaatcctcgtcgtccacgacgaactcgacatcccttgcggacggatcaaattcaaactcggcggcggcaacggcggacacaacggcttgaaagacattcaggcaaaactcggcacggcagactattaccgcctgcgcctcggcatcggccaccccggcgaccgcaacctcgtcgtcggctacgtcttgaacaaaccgagcgcggaacaccgccggcaaatcgacgatgccgtcgccaaatccctgcaggccgtacccgacatcatttccggcaaatgggaagaggcaacgcgcttcctgcacagcaaa

SEQ ID NO: 3156 - protein, 192 aa, Neisseria gonorrhoeae
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSAEHRRQIDDAVAKSLQAVPDIISGKWEEATRFLHSK

SEQ ID NO: 3157 - DNA, 276 bp, Neisseria gonorrhoeae
atgcttgaaattgagattgtgtacggtctgcccgaccgacaggttttgaaaaccatgcagcttgccgagggaacaaccgtccgcaccgccgcactgcaaagcggtttggacggcatatttgaaaatttaaacctgcattccgcgcctttgggcattttcggcaaagccgtcaaagacgacacgccgctgcgcgacggcgaccgcatcgaagtgtaccgcccgctgttgatcgaccccaaagaagcgcgccgcaaacgcgttcaaaatcaagaagaa

SEQ ID NO: 3158 - protein, 92 aa, Neisseria gonorrhoeae
MLEIEIVYGLPDRQVLKTMQLAEGTTVRTAALQSGLDGIFENLNLHSAPLGIFGKAVKDDTPLRDGDRIEVYRPLLIDPKEARRKRVQNQEE

SEQ ID NO: 3159 - DNA, 1755 bp, Neisseria gonorrhoeae
ttgatagttatgattcattataaaatagccccgtcccctctagaccatgaatggcacatcctgctgaaattcacacaagataatgattttcctatagaaataagccttccgaattgggtgccgggcagctatctgattcgggatttttcccgccacatcacttctatccatgcatcctgcaacggcacgtccatgccgctcgaacaaattgcaaaaaaccgctggcacactgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacaggcattccacccgaatggcgtattgccacaacgctgccggaaacagggaggcttgtctttcagacggcatcttatgacgaattgattgaccgacctgtcgagatgggcttgattgaatttttagattttgaggcggcaggcattccgcacacgattgccttaaacggcatatatcccgatttcgaccgcgacaggctggtttcggacatcaaaaaaatctgcgaaacagaactggcgatgttctcctcccctgccccatttgagaaatatttgttcctgctccacgtcggcgaccatatttacggcggtttggaacacaccgacagcaccgcactgctcgccgatcgccacagccttccgccgtacggtatgaccgatgccgacgatgcctacaccacattgctcggacttttctcccacgaatattttcacgcgtggaacgtcaaatccatcaaacctgccgcattcgccccttatgacctcgacaaagaaaactataccgaacaactatgggcattcgaaggcattacatcctattacgacgatttgtttttggcacgcagccgcaccatctcgcccgaattttatttaaacctgctagcacaaggcattacgcgcgtacaacaaacccgcggccgtttgaggcagaccttggcggaatcgagttttaccgcgtggaacaaattttacaaaccggatgaaaacagccccaacgccatcgtcagctactaccaaaaaggcgcacttgccgcattgtgccttgatctgataatacgcaaccgaagcaacggcagacattcccttgatacggtaatggacaaactctatcgggagtggagggacacacactcgggtattccggaaaaacactggcaaatccgttgtcaggaaattaccggcttggatttgacagatttttttcagacggcattgtacagcaccgaagatttgccgcttgccgaatgcctggcaaccacaggcgtgaaactgaccttcctgccgcttccccgacaacacggcggcggatatgcggaacacattttccccatcccgccgacgggcgatttcggcgcacgcttcaaacaaaacgccgaccatatcgtcctgacccatgtcttcaacggcggaagtgcggaatctgcggcactgtgcccgcaagacaaaatcattgctttagacggttatgcctgcaccgactttgccgcacaatgggcccgataccacgtcagggcaaaaatcaatatccacttcttccgtgcaggcatattgcgtcaaaccgtcttgacggttcaggcaacggcggcggatactgccatcctacacatcacagatcgcaacctgttggaaaactggttgttcggt

SEQ ID NO: 3160 - protein, 585 aa, Neisseria gonorrhoeae
LIVMIHYKIAPSPLDHEWHILLKFTQDNDFPIEISLPNWVPGSYLIRDFSRHITSIHASCNGTSMPLEQIAKNRWHTAAVRGEWQIRYTVYAFDLSVRGSFLTTERGFFDGSCLFLKVEGTETLPHRLELTGIPPEWRIATTLPETGRLVFQTASYDELIDRPVEMGLIEFLDFEAAGIPHTIALNGIYPDFDRDRLVSDIKKICETELAMFSSPAPFEKYLFLLHVGDHIYGGLEHTDSTALLADRHSLPPYGMTDADDAYTTLLGLFSHEYFHAWNVKSIKPAAFAPYDLDKENYTEQLWAFEGITSYYDDLFLARSRTISPEFYLNLLAQGITRVQQTRGRLRQTLAESSFTAWNKFYKPDENSPNAIVSYYQKGALAALCLDLIIRNRSNGRHSLDTVMDKLYREWRDTHSGIPEKHWQIRCQEITGLDLTDFFQTALYSTEDLPLAECLATTGVKLTFLPLPRQHGGGYAEHIFPIPPTGDFGARFKQNADHIVLTHVFNGGSAESAALCPQDKIIALDGYACTDFAAQWARYHVRAKINIHFFRAGILRQTVLTVQATAADTAILHITDRNLLENWLFG

SEQ ID NO: 3161 - DNA, 342 bp, Neisseria gonorrhoeae; identical to SEQ ID NO: 123

SEQ ID NO: 3162 - protein, 114 aa, Neisseria gonorrhoeae; identical to SEQ ID NO: 124

SEQ ID NO: 3163 - DNA, 492 bp, Neisseria gonorrhoeae
gcggtacggcgcgtcagcggctttgcgtttggcgatttcggcttcgtatttgtcgccgattgccaagaggatgggcttggtcatatgcaagtcgccttttttctcgccgtggtattcaaaaatatgggtttccacaatcgcatcggtcgggcaggcctcttcgcagaaaccgcagaagatgcacttggtcaggtcgatgtcgtaacgcttggtgcggcgggtgccgtcttcgcgttcttccgattcgatgttgatcgccattgccggacacaccgcctcgcacaatttacacgcgatgcagcgttcctctccgttcggataacggcgttgcgcgtgcagaccgcggaaacgcacggattgcggcgttttctcttcgggaaaataaattgtgtctttgcgggcaaaaaagtttttgagcgttacgcccatgcctttgaccagttcgccaagcagaaaggtttttactaagttagccatattatgttccctcaa

SEQ ID NO: 3164 - protein, 155 aa, Neisseria gonorrhoeae
AVRRVSGFAFGDFGFVFVADCQEDGLGHMQVAFFLAVVFKNMGFHNRIGRAGLFAETAEDALGQVDVVTLGAAGAVFAFFRFDVDRHCRTHRLAQFTRDAAFLSVRITALRVQTAETHGLRRFLFGKINCVFAGKKVFERYAHAFDQFAKQKGFY

SEQ ID NO: 3165 - DNA, 438 bp, Neisseria gonorrhoeae
gtgatgcccgtgaaaaaagttgaaaaaaacatcttggtgctgcacggcgcggacaaaatgttcgagctggtcgacaaggttgaggattacccgcactttctgccgtggtacagcaagaccgaggtcatcgggcgtagcggcaacgaactgaaggcgcggctgtttatggattatatgcgcgttcgccaatcgtttgccacgcacaaccgcaacatccccggcagggaaatccgtatggaactgctcgaaggcccgttcaaaaccttacgtggaacgtggaaatttatcgatttgggcgacgatatgtgcaaaatcgaattcaatttggaatacgatttttccaatgccgttttgtccgccttaatttcccccgtcttcaaccacctttccgccacgctggtcgaagcgttcgtcaaagaggcagaccgccgttatgct

SEQ ID NO: 3166 - protein, 146 aa, Neisseria gonorrhoeae
VMPVKKVEKNILVLHGADKMFELVDKVEDYPHFLPWYSKTEVIGRSGNELKARLFMDYMRVRQSFATHNRNIPGREIRMELLEGPFKTLRGTWKFIDLGDDMCKIEFNLEYDFSNAVLSALISPVFNHLSATLVEAFVKEADRRYA

SEQ ID NO: 3167 - DNA, 1965 bp, Neisseria gonorrhoeae
gtggggaacacctttaaatcaatccttgtctgggtcgccttgggtatcggcctgatggctgcgttcaacgctttggacggcaaaaaagaagacaacgggcaaatcgaatattctcagttcatccgacaggtcaacaacggcgaagtatccggcgtcaacatcgaaggatccgtcgtcagcggttacctgattaaaggcgagcgcaccgacaaaagcaccttcttcaccaacgcgcccttggatgacaacctgattcaaacccttttgaacaaaaacgtccgcgtaaaagtaacgccggaagaaaaaccgagcgcgctgactgccctgttttacagcctgctgcccgtcctgctgctgattggcgcatggttctactttatgcgtatgcaggcgggcggcggcggaaaaggcggcgcattctccttcggcaaaagccgcgcccgcctgctggacaaagatgccaacaaagttacctttgccgatgtcgccggctgcgacgaagccaaagaagaagtgcaggaaatcgtcgattacctcaaagcaccgaaccgctatcaaagcctcggcggccgtgttccgcgcggcatcctgctggcgggcagcccgggaaccggtaaaacactcttggcgaaagccattgcaggcgaggccggcgtgccgttcttcagcatttccggttccgattttgtcgaaatgttcgtcggtgtcggtgcaagccgcgtccgcgatatgttcgagcaggcaaagaaaaacgccccatgcattatctttatcgacgagattgacgcggtaggccgccaacgcggcgcaggtttgggcggcggcaatgatgagcgcgagcaaacattaaaccaattattggttgaaatggacggttttgagagcaatcagactgtaattgtgattgcggcaaccaaccgccccgacgtactcgatcctgcgctgcaacgccccggccgcttcgaccgccaagtcgtcgtccccctgccggacatccgggggcgcgaacagattttgaacgtccattctaaaaaagtgcctttggacgaatctgtggatttattgtccctcgcgcgcggcacgcccggtttttccggcgcggatttggcgaacctggtcaacgaagccgccctgtttgccggccgccgcaacaaagtcaaagtcgatcaaagcgattttgaagacgccaaagacaaaatctatatgggtccggaacgccgcagtatggtgatgcacgaagacgaaaaacgtgcgacggcgtatcatgagtccggacacgcgattgttgccgaaagcctgccctttaccgaccccgtccacaaagtaaccattatgccgcgcggacgtgcgctgggtctgacttggcagcttccggagcgcgaccgcatcagtatgtataaagatcagatgttgagccagctctccatcctgttcggcggacggattgccgaagacatcttcgtcggacgcatctccaccggtgcatcaaacgactttgaacgcgcaacccaaatggcacgcgaaatggtaacgcgctacggcatgagcgacaaaatgggcgtgatggtttatgcggaaaacgaaggcgaagtcttcttggggcgcagcgtaacccgttcgcaaaacatttccgagaaaacccagcaggacatcgacgcggaaatccgccggattttggacgagcagtatcaggttgcctacaaaatcctcgatgaaaaccgcgacaagatggaaacgatgtgcaaagccctgatggaatgggaaaccatagaccgcgatcaggtactggaaattatggcgggcaaacaacccagcccgcccaaggattacagccacaacctgcgcgagaatgcggacgcggcggaagataacgcgccgcacgctccgactcgggaaaaaaccgaagcacctgccccggcagacaccgcctcgacagagtccgggcagcagcctgaaaacaaggct

SEQ ID NO: 3168 - protein, 655 aa, Neisseria gonorrhoeae
VGNTFKSILVWVALGIGLMAAFNALDGKKEDNGQIEYSQFIRQVNNGEVSGVNIEGSVVSGYLIKGERTDKSTFFTNAPLDDNLIQTLLNKNVRVKVTPEEKPSALTALFYSLLPVLLLIGAWFYFMRMQAGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDFEDAKDKIYMGPERRSMVMHEDEKRATAYHESGHAIVAESLPFTDPVHKVTIMPRGRALGLTWQLPERDRISMYKDQMLSQLSILFGGRIAEDIFVGRISTGASNDFERATQMAREMVTRYGMSDKMGVMVYAENEGEVFLGRSVTRSQNISEKTQQDIDAEIRRILDEQYQVAYKILDENRDKMETMCKALMEWETIDRDQVLEIMAGKQPSPPKDYSHNLRENADAAEDNAPHAPTREKTEAPAPADTASTESGQQPENKA

SEQ ID NO: 3169 - DNA, 618 bp, Neisseria gonorrhoeae
atggctgtacgttccaaatcctcaaaagcgtggctgcacgaacacatcaacgaccagtacgtccatatggcgcaaaaagacggctaccgcgcccgtgccgcatacaaacttttggaaatcaacgaaaaagacaagataatcaaacccggcacggtacttgccgacttgggcagcgcgccgggaagctggtcgcaggttgccgccaagctgacgggtacttccggagcggttttcgccttggacatcctgcctatggaagccatagggggcgtgtccttcattcagggcgacttccgcgagaacgacgttttggcgcaattcgaaaccttgttggacaaccgcccgctcgaccttgtaatctgcgatatggcgcccaatatgtcgggaaacgccgtaagcgatcaggcacgcagcttttatctgtgcgaactggctttggacttcgcctcgcaacacctgaaaaccggcggcagctttttggtcaaagtctttcagggtgcaggctatcaggaatacatggcagccatgcgcgaaattttcggcactgtgcagacgcgcaaacccgaagcctcgcgcaatcgctccagtgagatttatttattgggcaaaaataaacgc

SEQ ID NO: 3170 - protein, 206 aa, Neisseria gonorrhoeae
MAVRSKSSKAWLHEHINDQYVHMAQKDGYRARAAYKLLEINEKDKIIKPGTVLADLGSAPGSWSQVAAKLTGTSGAVFALDILPMEAIGGVSFIQGDFRENDVLAQFETLLDNRPLDLVICDMAPNMSGNAVSDQARSFYLCELALDFASQHLKTGGSFLVKVFQGAGYQEYMAAMREIFGTVQTRKPEASRNRSSEIYLLGKNKR

SEQ ID NO: 3171 - DNA, 318 bp, Neisseria gonorrhoeae
atgctgcattatcctttttattcaaacagtaggaaaatggcggataccaaattgaacaccaaagaaattttggaattgaaagcgcgcgcgcaccatctccatcctgttgtgatggtcggtcagcagggtctgacggacgcagtcatcaaggaaaccgatgcggcactgacggcgcatgagctgattaaagtgcgcgtattcggcgacgaccgtgccgagcgtatcgaaatctgcaataccttgtgtgaggcggttgacgcgcaacctgttcggcatatcgggaaacttttggtattgtggcgtaagaatatcgaggcc

SEQ ID NO: 3172 - protein, 106 aa, Neisseria gonorrhoeae
MLHYPFYSNSRKMADTKLNTKEILELKARAHHLHPVVMVGQQGLTDAVIKETDAALTAHELIKVRVFGDDRAERIEICNTLCEAVDAQPVRHIGKLLVLWRKNIEA

SEQ ID NO: 3173 - DNA, 144 bp, Neisseria gonorrhoeae
gtggttgttttgctattgttctttcaatgggcggcacgctgtccttcggcgcggcatttcggcgtgccgaaaccctttccggtgaaaacggattttgattaccgctcgatgccgtctgcaagttgcggcggcttccgtatgatt

SEQ ID NO: 3174 - protein, 48 aa, Neisseria gonorrhoeae
VVVLLLFFQWAARCPSARHFGVPKPFPVKTDFDYRSMPSASCGGFRMI

SEQ ID NO: 3175 - DNA, 165 bp, Neisseria gonorrhoeae
ttgcataagccctccaatcatcctgtcaacaattcaaatcatacggaagccgccgcaacttgcagacggcatcgagcggtaatcaaaatccgttttcaccggaaagggtttcggcacgccgaaatgccgcgccgaaggacagcgtgccgcccattgaaagaacaa

SEQ ID NO: 3176 - protein, 55 aa, Neisseria gonorrhoeae
LHKPSNHPVNNSNHTEAAATCRRHRAVIKIRFHRKGFRHAEMPRRRTACRPLKEQ

SEQ ID NO: 3177 - DNA, 1014 bp, Neisseria gonorrhoeae
atgattggagggcttatgcaatttccttaccgcaatgttccggcttcgcgtatgcgccgtatgcgcagggatgatttttcacgccgcctgatgcgcgagcatatgctgaccgccgatgatttgatttatccggtgttcgtattggagggggcggcgcgcgaggaggatgtgccttctatgccgggcgtgaagcgtcagagtttggacaggctgctgtttacggcggaagaggcggtgaagctcggtattccgatgttggcactctttcccgtggttacggcaaacaaaaccgggcgtgcgcaggaggcgtacaatcccgaaggactcgtgccgtcaactgtccgagccttgcgcgagaggttttccgaactgggcattatgacggatgtcgcgctcgatccttatacggtgcacggtcaggacggactgacggacgaaaacggttacgtgatgaatgatgaaaccgtagaagtcttggtgaaacaggctttatgtcatgcagaggcgggcacgcaggtcgttgctccttccgatatgatggacgggcgtatcggcgccatccgcgaggctttggaggatgccggacatatccatacgcggattatggcatattccgccaaatatgcttctgcattctacggccctttccgtgatgcggtaggcagttcgggcaatttgggaaaggcagataaaaagacctatcagatggatcctgcaaataccgatgaggcgctgcatgaagtggcgctcgatattcaggaaggtgcggatatggtgatggtgaagcccggtttgccgtatttggacgttgtccgccgcgtgaaggacgagttcggcgtaccgacttatgcctatcaggtttcgggcgaatatgcgatgttgcaggcggcggttgccaacggctggctggacggcggcaaagtggttttggaaagcctgctggcattcaaacgtgcgggtgcggacgggattttgacctattacgccattgaggcggcaaagatgctgaagcgt

SEQ ID NO: 3178 - protein, 338 aa, Neisseria gonorrhoeae
MIGGLMQFPYRNVPASRMRRMRRDDFSRRLMREHMLTADDLIYPVFVLEGAAREEDVPSMPGVKRQSLDRLLFTAEEAVKLGIPMLALFPVVTANKTGRAQEAYNPEGLVPSTVRALRERFSELGIMTDVALDPYTVHGQDGLTDENGYVMNDETVEVLVKQALCHAEAGTQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 3179 - DNA, 126 bp, Neisseria gonorrhoeae
ttggcggccgcatcgggggaagtgtcggcattccccccgattttttacatatcgggcggacgcggcaaatttttgccgttttgtttgcgcgaagggggcgttatacaaaattatcaggcgcaccaa

SEQ ID NO: 3180 - protein, 42 aa, Neisseria gonorrhoeae
LAAASGEVSAFPPIFYISGGRGKFLPFCLREGGVIQNYQAHQ

SEQ ID NO: 3181 - DNA, 90 bp, Neisseria gonorrhoeae
atgtttaacatacacccttcagggaactcttatcaaaacaaaagccgcaagcgcggcaataaccacgaaagaaacaggcgaccaaacctg

SEQ ID NO: 3182 - protein, 30 aa, Neisseria gonorrhoeae
MFNIHPSGNSYQNKSRKRGNNHERNRRPNL

SEQ ID NO: 3183 - DNA, 567 bp, Neisseria gonorrhoeae
gtgtcggtcggctacgacttcggcggctggaggatagcggcagattatgcccgttacagaaagtggaacgacaataaatattccgtgaacataaaagagttgggaagaaaggatggtacctcttctagcggccgctatcttaacatacaaacccgaaagacggaaaatcaggaaaacggtacgttccacgccgtttcttctctcggcttgtcaaccgtttacgatttcagagccaacgataaattcaaaccctatatcggcgtgcgcgtcgcctacggacacgtcagacatcaggttcattcaatggaaaaagaaaccacgactgttaccacttacccaagcgacggtagtgcgaaaacttctgttccatcagaaatgccccccaaacctgcctatcacgaaaaccgcagcagccgccgcttgggcttcggcgcgatggcgggcgtgggcatagacgtcgcgcccggtctgaccttggacgccggctaccgctaccactattggggacgcctggaaaacacccgcttcaaaacccacgaagcctcattgggcatgcgctaccgcttc

SEQ ID NO: 3184 - protein, 189 aa, Neisseria gonorrhoeae
VSVGYDFGGWRIAADYARYRKWNDNKYSVNIKELGRKDGTSSSGRYLNIQTRKTENQENGTFHAVSSLGLSTVYDFRANDKFKPYIGVRVAYGHVRHQVHSMEKETTTVTTYPSDGSAKTSVPSEMPPKPAYHENRSSRRLGFGAMAGVGIDVAPGLTLDAGYRYHYWGRLENTRFKTHEASLGMRYRF

SEQ ID NO: 3185 - DNA, 417 bp, Neisseria gonorrhoeae
ttgggcgtagaaaaggtatggttgctgcacaggttggacaagcaggccggaggcatattgctgtttgcccttaattcccaaagtgccgctgttcttgccgcacagtttgccgaaaggaaaatgaagaaaagctatttggctttgtccgaccgcaaaccgtccaaaaaacaaggatggataaaaggcggcatggaaaaatccaggcgcgggatgtggaagctgacgcgcaatatggaaaatattgccgttacccggtttttcagtatccgcatcagtgaaaaaatgcggctgttcatccttgagccacatacgggtaagacacatcagttgagggtggtaatgaagagtctgggcagctctatatttggggacagcctgtatagaggaacagaatccgaaactatgttcctgtatgcg

SEQ ID NO: 3186 - protein, 139 aa, Neisseria gonorrhoeae
LGVEKVWLLHRLDKQAGGILLFALNSQSAAVLAAQFAERKMKKSYLALSDRKPSKKQGWIKGGMEKSRRGMWKLTRNMENIAVTRFFSIRISEKMRLFILEPHTGKTHQLRVVMKSLGSSIFGDSLYRGTESETMFLYA

SEQ ID NO: 3187 - DNA, 1317 bp, Neisseria gonorrhoeae
gtgtattgtatggcaggcagatgccgtctgaaaaaacgctgtcggccgcctgcctgcaaatgcgagattatatcacttgcttttggcggctgcattgattgtttctattttcgggatagtgataaaatcccgacttatccatatcttacaaggcagaaacagatgaaattcccgacccgtaccatccattccggctacgattgcgacgaacacaaccgcgcgctgatgccgccgatttatcaaaacagtatgtttgcgctgcacgaaatcggcgaaaatgtgccttaccgttattcgcgcctgagcaacccgacccgtcagattttggaagacaccgttgccgatttggaacacggtgcggcaggttttgcgttttccagcggtatggcggggattgatgccgtgtggcgtaccttcctgcgcccgggcgataccatcgtcgcggtcgccgatatttacggcggcgcatatgacttattggtcgatgtttatcaaaaatggggggtgaacgttgtttttgccgatttgggcaatcccgataatttggacgaattgctcaaagcgcacaatgtcaaactggtttggctggaaatgccgtccaatccgcttttacgcttggtagacatcaaagcccttgcagcgaaagccaaagcagccgacgcgctggtcggcatcgacaacacctttgccacgccgtatctgcaacagcccttggatatgggttgcgattttgcattccattccgctaccaaatatttgtgcggccattccgacgtattgatgggcatcgtcgttgccaaaaccaaagagctggctcagcctttgcacgatatgatggtgcataccggcgcgattgcaggtccgacggactgctggctggtgttgcgcggcatcaaaacgcttgccctgcgtatggaggcacactgcaaaaacgcactcgaaattgcgcgccgtttggaagcccatcctgccattgaaaaagtgttccatcccggcctgccgtctcacgaacattacgcactcgcccaagcgcaaatgcccaaaggcatcggcggcgtggttacggtttatctcaaaaacgacacgcgcgaagcggcaaacagcgtgattaaaaacatgaaactggtcaaaatgacctccagcctcggcggcgtggaaagtctggtcaaccattgctattcccaatctcacagcggcgtgccgcataatgtgaaaatggaaatgggcatcagggtcggactcctgcgcttctccatcggtattgaagacgtagatgatatttggaacgatatttccgccgcactcgatacaactttg

SEQ ID NO: 3188 - protein, 439 aa, Neisseria gonorrhoeae
VYCMAGRCRLKKRCRPPACKCEIISLAFGGCIDCFYFRDSDKIPTYPYLTRQKQMKFPTRTIHSGYDCDEHNRALMPPIYQNSMFALHEIGENVPYRYSRLSNPTRQILEDTVADLEHGAAGFAFSSGMAGIDAVWRTFLRPGDTIVAVADIYGGAYDLLVDVYQKWGVNVVFADLGNPDNLDELLKAHNVKLVWLEMPSNPLLRLVDIKALAAKAKAADALVGIDNTFATPYLQQPLDMGCDFAFHSATKYLCGHSDVLMGIVVAKTKELAQPLHDMMVHTGAIAGPTDCWLVLRGIKTLALRMEAHCKNALEIARRLEAHPAIEKVFHPGLPSHEHYALAQAQMPKGIGGVVTVYLKNDTREAANSVIKNMKLVKMTSSLGGVESLVNHCYSQSHSGVPHNVKMEMGIRVGLLRFSIGIEDVDDIWNDISAALDTTL

SEQ ID NO: 3189 - DNA, 870 bp, Neisseria gonorrhoeae
ttgcaggcaggcggccgacagcgttttttcagacggcatctgcctgccatacaatacacacatctcaataattatctgaatattaaggacaaacaacgcatgaacgccattgcagacgtgcaatccagcagagatttgcgcaacctgccgatcaatcaggtcggcattaaagacctgcgcttcccgattaccctgaaaaccgccgaaggaacacaatccacggttgctcgcctgacgatgacggtttatctgcccgccgagcagaaagggacgcatatgtcgcgctttgtcgcattgatggagcaacataccgaagtcttggatttcgcacaattgcataggctgactgccgaaatggtcgcgcttttggattcccgcgccggcaaaatcagcgtttcttttccgtttttccgcaagaaaaccgcgccggtatccggtatccggtccttactggattatgatgtcagcctcacgggtgaaatgaaagacggggcatacggccacagtatgaaggtcatgattcccgtaacctcgctttgcccgtgttccaaagaaatttcccaatatggcgcgcataatcagcgttcgcacgttaccgtcagcctgacttccgatgccgaagtcggtatcgaggaagttatcgattatgtggaaacgcaggcgagctgccaactctacggcctgctcaaacgccccgatgaaaaatacgttaccgaaaaggcctacgaaaacccgaaattcgtggaagatatggtgcgcgatgtcgctacttcgctgattgccgacaaacgcatcaagagtttcgtcgtcgagagcgagaatttcgagtctatccacaaccattcggcttatgcctatatcgcctacccg

SEQ ID NO: 3190 - protein, 290 aa, Neisseria gonorrhoeae
LQAGGRQRFFRRHLPAIQYTHLNNYLNIKDKQRMNAIADVQSSRDLRNLPINQVGIKDLRFPITLKTAEGTQSTVARLTMTVYLPAEQKGTHMSRFVALMEQHTEVLDFAQLHRLTAEMVALLDSRAGKISVSFPFFRKKTAPVSGIRSLLDYDVSLTGEMKDGAYGHSMKVMIPVTSLCPCSKEISQYGAHNQRSHVTVSLTSDAEVGIEEVIDYVETQASCQLYGLLKRPDEKYVTEKAYENPKFVEDMVRDVATSLIADKRIKSFVVESENFESIHNHSAYAYIAYP

SEQ ID NO: 3191 - DNA, 393 bp, Neisseria gonorrhoeae
atggttgtggatagactcgaaattctcgctctcgacgacgaaactcttgatgcgtttgtcggcaatcagcgaagtagcgacatcgcgcaccatatcttccacgaatttcgggttttcgtaggccttttcggtaacgtatttttcatcggggcgtttgagcaggccgtagagttggcagctcgcctgcgtttccacataatcgataacttcctcgataccgacttcggcatcggaagtcaggctgacggtaacgtgcgaacgctgattatgcgcgccatattgggaaatttctttggaacacgggcaaagcgaggttacgggaatcatgaccttcatactgtggccgtatgccccgtctttcatttcacccgtgaggctgacatcataatccag

SEQ ID NO: 3192 - protein, 131 aa, Neisseria gonorrhoeae
MVVDRLEILALDDETLDAFVGNQRSSDIAHHIFHEFRVFVGLFGNVFFIGAFEQAVELAARLRFHIIDNFLDTDFGIGSQADGNVRTLIMRAILGNFFGTRAKRGYGNHDLHTVAVCPVFHFTREADIIIQ

SEQ ID NO: 3193 - DNA, 663 bp, Neisseria gonorrhoeae
atgacagtattaagcaaagagcaggttctatccgcatttaaaaaccgcaaatcgtgccggcattacgatgcggcacgtaaaatcagtgccgaggattttcagtttattttagaactcgggcgtttgtcgcccagttcggtcggttcggagccttggcagtttgttgtggttcaaaaccccgaaatccgacaggcaatcaagctgttttcttggggtatggcggatgctttggataccgccagtcatttggtggtgtttttggcgaagaaaaatgcccgcttcgacagcccgtttatgttggaaagtctcaaacggcgcggcgttaccgaaccggatgccgtagaaaaatctttggcgaggtatcaggcgtttcaagctgacgacatcaagattttggacgattcgcgcgccttgtttgactggtgctgccgccagacctatatcgcgttagccaacatgatgacgggtgcggcgatggcgggtatcgattcctgcccggtggaaggtttcaactatgccgatatggaacgcgtattgtccgggcagttcggtttgttcgatgcggcagaatggggcgtgtccgttgccgcgacattcggctaccgggttcaggaaatcgtcacgaaagcgcgcaggcccttggaagaaaccgttatttgggca

SEQ ID NO: 3194 - protein, 221 aa, Neisseria gonorrhoeae
MTVLSKEQVLSAFKNRKSCRHYDAARKISAEDFQFILELGRLSPSSVGSEPWQFVVVQNPEIRQAIKLFSWGMADALDTASHLVVFLAKKNARFDSPFMLESLKRRGVTEPDAVEKSLARYQAFQADDIKILDDSRALFDWCCRQTYIALANMMTGAAMAGIDSCPVEGFNYADMERVLSGQFGLFDAAEWGVSVAATFGYRVQEIVTKARRPLEETVIWA

SEQ ID NO: 3195 - DNA, 756 bp, Neisseria gonorrhoeae
atgaattccaaaatttcctccgaccatacagaagataccatacgcctctccaaacgtatggcacaactggggctttgttcgcgccgcgaagccgacggccatatcgaacagggctgggtaacggtcaacggcaaaaccgccgtactcggtcagaaagtttcaccggcagaccgtatcgaactgaacaagaaagcccacgaacagcaggcggcacgcattaccatcctgctgaacaaacccgtcggctatgtcagcgcacaagcggaaaaaggctataaatccgccgccgaactgattacccctgaaaattgctgggaaggcgacaccagccgcatcagtttcgatccgaaacacaaaatcggtcttgcccccgccggcaggctcgatatcgattcagtcggattgctggtgttgacgcaagacggccgtatcgccaagcagcttatcggcgaaaacagcggcagtgaaaaagaatatttggtgcgcgtgcgcggcaaattggacgaaaaaggacttgccttactgaatcacggattgagtttggacggtgataaactgcgtcccgccaaagtagaatggcaaaatgaagaccaactgcgcttcgtgttgaaacagggtaaaaagcggcaaatccgccgtatgtgcgaactggtcggactgcgcgtcgtcgggctgaaacgcatccgcatgggcaaggtcaaactcggcaggctgccgcccggcaaatggcgttatctcgctcccggcgaatcgttt

SEQ ID NO: 3196 - protein, 252 aa, Neisseria gonorrhoeae
MNSKISSDHTEDTIRLSKRMAQLGLCSRREADGHIEQGWVTVNGKTAVLGQKVSPADRIELNKKAHEQQAARITILLNKPVGYVSAQAEKGYKSAAELITPENCWEGDTSRISFDPKHKIGLAPAGRLDIDSVGLLVLTQDGRIAKQLIGENSGSEKEYLVRVRGKLDEKGLALLNHGLSLDGDKLRPAKVEWQNEDQLRFVLKQGKKRQIRRMCELVGLRVVGLKRIRMGKVKLGRLPPGKWRYLAPGESF

SEQ ID NO: 3197 - DNA, 888 bp, Neisseria gonorrhoeae
atgaacagcccttttcacaacatcggtatcgtaacccgccccaacacgcccgacatccaagataccgcacacacgctgattacctttttgaagcagcacggctttaccgtctatctcgacgaagtcggcgtaagggaatgctgcatctatacccaagacaccgacggctgccatatcgtcaacaagaccgaactggggcaatactgcgacctggtcgccgtcttaggcggagacggcacctttctctctgccgcccgcgaaatcaccccccgcgccgttccgattatcggcatcaaccaaggtcatttgggctttcttacccaaattccccgcgaatatatgacggacaagctattgcccgttttagaaggaaaataccttgccgaagagcgcatcctgattgaagccgcactgatccgcgaaggcaaaaccgccgaacgcgccctcgccctcaacgatgccgtcctctcccgcggcggtgccggacagatgattgaatttgaagtcttcgtcaatcaggaattcgtctatacacaacgttcggacgggctgattgtctccacccccaccggatcgaccgcctattcgcttgccgccggcggcccaatcatgcaggcaggattacacgccttcacgctcgtccccatctgcccgcaatctatgactaaccgccccatcgccattccagacacgtccgaaatcgaaatcctcgttacccaaggcggcgacgcgcgcgttcatttcgacggacaatccttcatcgacgtgcaaaacctcgaccgcatcatcatccgccgctaccacaatcccttacgcatcctacacccgaccgactaccaatatttcaaaaccctgcgccaaaaactgcactggggcgagcaattagtc

SEQ ID NO: 3198 - protein, 296 aa, Neisseria gonorrhoeae
MNSPFHNIGIVTRPNTPDIQDTAHTLITFLKQHGFTVYLDEVGVRECCIYTQDTDGCHIVNKTELGQYCDLVAVLGGDGTFLSAAREITPRAVPIIGINQGHLGFLTQIPREYMTDKLLPVLEGKYLAEERILIEAALIREGKTAERALALNDAVLSRGGAGQMIEFEVFVNQEFVYTQRSDGLIVSTPTGSTAYSLAAGGPIMQAGLHAFTLVPICPQSMTNRPIAIPDTSEIEILVTQGGDARVHFDGQSFIDVQNLDRIIIRRYHNPLRILHPTDYQYFKTLRQKLHWGEQLV

SEQ ID NO: 3199 - DNA, 564 bp, Neisseria gonorrhoeae
atgtccgccctcctccccatcatcaaccgcctgattctgcaaagcccggacagccgctcggaacttacctcctttgcaggcaaaacactgaccctgaacattgccgggctgaaactggcgggacgcatcacagaagacggtttgctctcggcgggaaacggctttgcagacaccgaaattaccttccgcaacagcgcgatacggaaaatcctccaaggcggcgaacccggggctggcgacatcaggctcgaaggcgacctcatcctcggcatcgcggtactgtccctgctcggcagcctgcgttcccgcgcatcggacgaattggcacggattttcggcacgcaggcaggcatcggcagccgtgccaccgacatcggacacggcatcaaacaaatcggcaggaacatcgccgaacaaatcggcggattttcccgcgaacccgagtccgcaaacaccggcaacgaagcccttgccgactgcctcgacgaaataagcagactgcgcgacggcgtggaacgcctcaacgaacgcctcgacaggctcgaacgcgacatttggatagac

SEQ ID NO: 3200 - protein, 188 aa, Neisseria gonorrhoeae
MSALLPIINRLILQSPDSRSELTSFAGKTLTLNIAGLKLAGRITEDGLLSAGNGFADTEITFRNSAIRKILQGGEPGAGDIRLEGDLILGIAVLSLLGSLRSRASDELARIFGTQAGIGSRATDIGHGIKQIGRNIAEQIGGFSREPESANTGNEALADCLDEISRLRDGVERLNERLDRLERDIWID

SEQ ID NO: 3201 - DNA, 774 bp, Neisseria gonorrhoeae
atgcgcgcagtccccccgccccatatctccatcacaggcctaggttacctcggcctgccgctggcacaaaagttttaccgacacggcagccgcgtcgccgccataaaacgcagcctgacttcggacgacatcaacctgcccatacacctcgacaccttcgacctcaaccgtaccgatgcctttcagacggcattgtggcggcatcacgccgacaaacccgtctggttcttcctgctgccgccctcctttttggcgcattacgccgacaccgtcaaacaatgggcagagcttgcccgggcgtgcaacgtgcaacacctgattttcacaagcagcacaagcgtttacggcgataaagcgcgagaatgcgacgaaaccgccgcacccgatccgcaaaccgagtccgcccgacaaatccttgccgccgaacaacacctgctcgacaacggcgttccgaacatcgacatcctgcggctgggcgggctttattgcgccgaacgccatcccgtcagccgcctcgtgcaaaagcaaaacatccaaggcggcaaccggcctgtcaatatcgtccaccgcgacatcgccgtcgaaaacctgtttcagacggcatccaaccccggcggcaggcggctgaaaaacattatcgaaccgcgccacccgacacgccgcgaattttatacggaagaagccgccaaactcggcctgcccgcgccggatttctcacccgacgacagcgtgggcaaaatcatccgtaccgtttgcgataacggcttaagcctg

SEQ ID NO: 3202 - protein, 258 aa, Neisseria gonorrhoeae
MRAVPPPHISITGLGYLGLPLAQKFYRHGSRVAAIKRSLTSDDINLPIHLDTFDLNRTDAFQTALWRHHADKPVWFFLLPPSFLAHYADTVKQWAELARACNVQHLIFTSSTSVYGDKARECDETAAPDPQTESARQILAAEQHLLDNGVPNIDILRLGGLYCAERHPVSRLVQKQNIQGGNRPVNIVHRDIAVENLFQTASNPGGRRLKNIIEPRHPTRREFYTEEAAKLGLPAPDFSPDDSVGKIIRTVCDNGLSL

SEQ ID NO: 3203 - DNA, 465 bp, Neisseria gonorrhoeae
atgccgtctgaacaccaaccgcaaagcaaaggaaacaaaatggcgattctcaaacttgacgaacatctctacatctccccgcaactgaccaaagccgatgcggaacaaatcgcgcaacttggcatcaaaaccgtcatctgcaaccgccccgaccgcgaagaagaatcgcaacccgacttcgcccaaatcaaacagtggctggaacaagcaggcgttaccggattccatcaccaacccgttaccgcacgcgacatccaaaaacacgatgtcgaaaccttccgccaactcatcggacaagccgaatatcccatccttgcctattgccggaccggtacgcgctgctccctcctgtggggcttccgccgggcggcagaaggtatgccggttgacgaaatcatccgccgcgcccaagcggcaggtgtaaatctggaaaacttcagagagcggctggacaacgcccgcgtc

SEQ ID NO: 3204 - protein, 155 aa, Neisseria gonorrhoeae
MPSEHQPQSKGNKMAILKLDEHLYISPQLTKADAEQIAQLGIKTVICNRPDREEESQPDFAQIKQWLEQAGVTGFHHQPVTARDIQKHDVETFRQLIGQAEYPILAYCRTGTRCSLLWGFRRAAEGMPVDEIIRRAQAAGVNLENFRERLDNARV

SEQ ID NO: 3205 - DNA, 1080 bp, Neisseria gonorrhoeae
tttccacaaattcagcggtgaaatcatccacacgcccaaaaccacgatgtaggcgaagccgatcggaatcagcactttccagcccaaacgcatgatttggtcgtagcggtagcgtgggaaggttgcacgaatccacagataccagtacagcaccgccgccattttcacgaacatccagaatgcggaaggcgtaccgacaatgccccagctttgcgggaacggagacaaccagccgccgaggaacatcagcgatgtcagcgcggcaatcagaatcatgaaaatgtattcggcaaggaagaacagcgcgaatgcaaagccggagtattcgacgtggtgtccggcaacgatttcagactcgccctctgccacgtcaaacggtgcgcggttggtttcggcaacggcggaaatcagatagacgatgaagattgggaacagcggcagccagttccacgagaacacagaaccgcccgcgatgccttttgcctgcgcggcaacgatgtcggagaagttcatgctgcccgataccatcacaacgcacaccagcgcggcactcatggcaatctcgtaggaaatgctttgcgcggaagcacgcattgcacccaagaacgaatatttggagttggaagcccagcccgcgataatcacgccgtaaaccgacagcgaggtaatcatcaggatgtacaaaaggccgatattgatattggtcagcacccattcttcgttaaacggaatcaccgcccacgccgcgaaagacggggcgagcgacataatcgggccgatgtagaataaggctttgtttgacagcttcggacgggttacctctttaaacaagagtttgaacacgtcggcaaacggctgaatcagaccccgcgggccggttacgttcgggccgacgcgaagctgcataaagccgatgactttacgttcgaaatacgtcaggtaggcaacggtcagaatcagcggaatcaggataatcacgattttgacgatgacggataccaccaagcctacggtgatgcccaaatcgcccagaccgagcgttgcggcaaagaggttttggaaccattcctgcataatcaa

SEQ ID NO: 3206 - protein, 6 aa, Neisseria gonorrhoeae
FPQIQR

SEQ ID NO: 3207 - DNA, 1023 bp, Neisseria gonorrhoeae; identical to SEQ ID NO: 125

SEQ ID NO: 3208 - protein, 341 aa, Neisseria gonorrhoeae; identical to SEQ ID NO: 126

SEQ ID NO: 3209 - DNA, 687 bp, Neisseria gonorrhoeae
ttggctgcccacttcgttcagcctgtaaatccaaggagtatgcccgtgacccgcattgcaaaaaccaatacttacacccgcatcatcgacgccagccttgcgcttttcaacgaggaaggcgagcgcaacatcagcaccaaccatatcgcggcgcatttgggcatcagtccgggcaatctttattaccacttccgcaacaaagacgaaatcatcgtccaactcttcaaacgttacagcgaagccctgttggcatacctgaatgaagccgtgttgccctctgatgtggaagactctatcaactatatggcaggcatttacgatgtcatgtgggaataccgcttcctctttagcgacgtaaacaccctacttgcgcgcagtgccgaattgttgggcgaacacaatacctttacccaagccaaagtctcgccgcttctagtcaaactgctgacccagctcaacgggctgaacgtcatcaacgccgaccaaaccgctatgaacgacctcgccgtcaatatgtggatggttacgaaatactggttcgacttcgacagctccctgcgcggccgtaccaagctgaccgaagactccaaagcacgcggcgtccgtcgtaccttaagcctccttcgcccctatcttttgcccgaacaccgcgcggaatacgaccgcaaaatcggcaacggcaacccg

SEQ ID NO: 3210 - protein, 229 aa, Neisseria gonorrhoeae
LAAHFVQPVNPRSMPVTRIAKTNTYTRIIDASLALFNEEGERNISTNHIAAHLGISPGNLYYHFRNKDEIIVQLFKRYSEALLAYLNEAVLPSDVEDSINYMAGIYDVMWEYRFLFSDVNTLLARSAELLGEHNTFTQAKVSPLLVKLLTQLNGLNVINADQTAMNDLAVNMWMVTKYWFDFDSSLRGRTKLTEDSKARGVRRTLSLLRPYLLPEHRAEYDRKIGNGNP

SEQ ID NO: 3211 - DNA, 1170 bp, Neisseria gonorrhoeae
ttgcctcgctcaccatcgcagccgtcgccttggtgtggtgcttggaaaaatacagtatggagttggtcaaatcacacaaggccgtctgaaaacgcagcacacttcaattcaaatacagttaaagctcaaaccatgcaacccatccgataccgaaccgacctcaccccctacaacactttcggcctgcacgcccaagcccgggcctttatcgcgcttaaacacgccgacgaattgcgcgacatcgtccgactgcccgagttcgaccgcgatactgttttatggctgggcggcggcagcaacatccttttgatgcaggattacgacggcttggtcgtccatatggaaaacaagggcatacgcgagattgcgcgctcagacggcatggttctgattgaagcgcaggcgggcgaaatttggcacgatttcgtgttgcacaccgtcgcgctgggtttgagcggtttggaaaacctgagcctgattccgggtacggtcggcgcgtcgcccgtgcagaacatcggcgcatacggcgtggaggcgaaagatgtgattcacagcgtgcgctgcttcgatttggatacggaaacctttgtaaccctttccaatgccgactgccgcttcgcctaccgcgaaagcctgttcaagcaggaaggcaaagggcgttatgtgattgtttcggtcgtatttgcattaaaaacgcattttgtgccgaacttgggctacggcgatttggcggcgaaggttgccgaattgagtgcaggtagggaggcaacggcgaaagacgtttccgatgcggtatccgccatccgcaacagcaaattacccgacccgaaagttttgggcaatgtcggcagtttctttaaaaaccccgtcgtcagcgcggaaaaagccgccaccctgttgcagcggcatcccgatatgccgcgctatccgcagcccgacggttcggtcaaactcgccgccggctggctgatcgaccaatgccgtctgaagggcttccaaatcggcggtgcggcggtacacgataaacaggcattggttttggtaaacaaaaacaacgcctcggcaaacgatgtccggcagttggcgcaacacatcaaatttacagtatttgctcggtttcaggtagaattacacgccgaacccaattggctgcccacttcgttcagcctg

SEQ ID NO: 3212 - protein, 390 aa, Neisseria gonorrhoeae
LPRSPSQPSPWCGAWKNTVWSWSNHTRPSENAAHFNSNTVKAQTMQPIRYRTDLTPYNTFGLHAQARAFIALKHADELRDIVRLPEFDRDTVLWLGGGSNILLMQDYDGLVVHMENKGIREIARSDGMVLIEAQAGEIWHDFVLHTVALGLSGLENLSLIPGTVGASPVQNIGAYGVEAKDVIHSVRCFDLDTETFVTLSNADCRFAYRESLFKQEGKGRYVIVSVVFALKTHFVPNLGYGDLAAKVAELSAGREATAKDVSDAVSAIRNSKLPDPKVLGNVGSFFKNPVVSAEKAATLLQRHPDMPRYPQPDGSVKLAAGWLIDQCRLKGFQIGGAAVHDKQALVLVNKNNASANDVRQLAQHIKFTVFARFQVELHAEPNWLPTSFSL

SEQ ID NO: 3213 - DNA, 1299 bp, Neisseria gonorrhoeae
atgctgttggcgcaggtcgcgcaggtgggcatcggtttcgtcgataccgtgatggcgggcggtgcgggcaaggaagatttggcggcggtggctttgggcagcagcgcgtttgccacggtttatattacctttatgggcattatggcggcgctgaacccgatgattgcccagctttacggcgcgggtaaaaccggtgaagcaggcgaaacggggcggcaggggatttggttcgggctgattttggggattttcggcatgattttgatgtgggcggcgattacgccgttccgcaactggctgactttgagcgattatgtggaaggcacaatggcgcagtatatgctgttcaccagcttggcgatgccggcggcaatggtacaccgcgcactgcacgcctacgcttccagcctgaaccgcccgcgcctgattatgttggtcagctttgcggcgtttgtgttgaacgtgccgctgaactatattttcgtttacggcaaattcggtatgcccgctttgggtggcgcaggttgcggcgtggcgacaatggcggtgttttggttcagcgcgctggcattgtggatttatatcgccaaggaaaaattcttccgcccgttcggactgacagcgaaattcggcaaaccggattgggcggtgttcaaacagatttggaaaatcggcgcgcccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcagggacggtgcgcatcggcttttcgcttgggcggcgcgaattttcgcgggcgcgttatatttcaggagtgtcgctggtgtcgggctgggtgctcgccgtgattaccgtgctttccttggtattattccgttcgccgctggcaagcatgtacaacgatgatccggcagttttaagcatcgcctccaccgtcctgctgttcgccggcctgttccaaccggcagacttcacccaatgtatcgcgtcctatgccctgcgcggctacaaagtcaccaaggtgccgatgttcatccacgccgccgccttctggggctgcggcctgctgccgggctatctgctcgcctaccgtttcgatatgggcatttacggcttctggacggcattgattgcctcgctcaccatcgcagccgtcgccttggtgtggtgcttggaaaaatacagtatggagttggtcaaatcacacaaggccgtc

SEQ ID NO: 3214 - protein, 433 aa, Neisseria gonorrhoeae
MLLAQVAQVGIGFVDTVMAGGAGKEDLAAVALGSSAFATVYITFMGIMAALNPMIAQLYGAGKTGEAGETGRQGIWFGLILGIFGMILMWAAITPFRNWLTLSDYVEGTMAQYMLFTSLAMPAAMVHRALHAYASSLNRPRLIMLVSFAAFVLNVPLNYIFVYGKFGMPALGGAGCGVATMAVFWFSALALWIYIAKEKFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWVLAVITVLSLVLFRSPLASMYNDDPAVLSIASTVLLFAGLFQPADFTQCIASYALRGYKVTKVPMFIHAAAFWGCGLLPGYLLAYRFDMGIYGFWTALIASLTIAAVALVWCLEKYSMELVKSHKAV

SEQ ID NO: 3215 - DNA, 117 bp, Neisseria gonorrhoeae
atgtgcaccattatttctcatcacttcccgctgccgttttttttgtttcagacggcatttttattgactgaacacttatgctgctcgacctcgaccgcttttccttttccgtcttcc

SEQ ID NO: 3216 - protein, 39 aa, Neisseria gonorrhoeae
MCTIISHHFPLPFFLFQTAFLLTEHLCCSTSTAFPFPSS

SEQ ID NO: 3217 - DNA, 189 bp, Neisseria gonorrhoeae
gtgatgagaaataatggtgcacattatatagtaaaaaataccgtgccgtcagacggcggatacggggtatataaagtatattcagattgtgtgtattttatggtaaagtttggttttaacgacttgacggcattgagccgtcggacaggggctgttcggattctgaatcggaaggaagcatcgccgttt

SEQ ID NO: 3218 - protein, 63 aa, Neisseria gonorrhoeae
VMRNNGAHYIVKNTVPSDGGYGVYKVYSDCVYFMVKFGFNDLTALSRRTGAVRILNRKEASPF

SEQ ID NO: 3219 - DNA, 96 bp, Neisseria gonorrhoeae
ttgttaatccgctatacccgctgtaaaaacggagaaggacagaggacggcagtaaggtttgccgtcctctttttcaagttgcggtggaatgccgct

SEQ ID NO: 3220 - protein, 32 aa, Neisseria gonorrhoeae
LLIRYTRCKNGEGQRTAVRFAVLFFKLRWNAA

SEQ ID NO: 3221 - DNA, 201 bp, Neisseria gonorrhoeae
atgagaatctgccttctgttttatcctgtaaacacaaaagactgcccgatccgcaatcagacggcatctttgccgcaacgcatcacgccgctgtcaaaacggcgatgcttccttccgattcagaatccgaacagcccctgtccgacggctcaatgccgtcaagtcgttaaaaccaaactttaccataaaatacacacaatc

SEQ ID NO: 3222 - protein, 67 aa, Neisseria gonorrhoeae
MRICLLFYPVNTKDCPIRNQTASLPQRITPLSKRRCFLPIQNPNSPCPTAQCRQVVKTKLYHKIHTI

SEQ ID NO: 3223 - DNA, 192 bp, Neisseria gonorrhoeae
atgttccggaagctgccatgtctgcatgagaatctgccttctgttttatcctgtaaacacaaaagactgcccgatccgcaatcagacggcatctttgccgcaacgcatcacgccgctgtcaaaacggcgatgcttccttccgattcagaatccgaacagcccctgtccgacggctcaatgccgtcaagtcgt

SEQ ID NO: 3224 - protein, 64 aa, Neisseria gonorrhoeae
MFRKLPCLHENLPSVLSCKHKRLPDPQSDGIFAATHHAAVKTAMLPSDSESEQPLSDGSMPSSR

SEQ ID NO: 3225 - DNA, 1149 bp, Neisseria gonorrhoeae
atgcagacatggcagcttccggaacatatcgccgacgtactgcccacgaacgcgcggcagcttgaaagcgcgcgcgagcagttgttggcactgttccgcgtacacggttatgaactggtacagcctccgctgatggagtacgcacattccctgctgacgcatatcgatgcggggctttcactgaaaaccattttggtaacggacaggctcagcggcaggcagttgggcatacgcgccgacatcacgccgcaggtggcgcgtatcgatgcccatcttttgtccgccaaccaagggattaaccggttgtgttatgccggtccggtgttgcacgcgcagcccgacggtctgccgaatatgcgcgaacccttgcaggcaggggcggaaatgtacggttttgccgacatccgtggcgacatcgagctgatagaccttatgctgaaaagcatgaaaattgccgatatgggcaaagtgctgctttcgctggggcatatcggcatattccgcgccttgtccgatgcggcgcatttggatgcggggcagtccgcagcgctgcttgccttgatgcaggataaagataccgggtcggtcgaagcgcaggtcaaggcttggaagctggacggtatgtgggcaaaagcattctcgctgctgccgcgcctgtacggcgggcgtgaagtgttgtccgacgcgcgcggacggttgccggatttgtcggcggtcggcggcgcgttggacgaattgcaggcggtgtgcgacgcattccccgataatgaaatccatatcgacttgtccgagctgcgcgtcgacaattaccacacgggcttgctgtatgccgcctatgccgccgatttccacgacgcggtcgcgcgcggcgggcgttatgacggattgggcggatatttcggcagggcgcgcccggcaacgggattcagtttcgacttacgcagctttatcgggcgtttgcccgccgtcgaacggcagcccgccgtgttggtcgatgcggaagatgcagaagcggcgcgcgaagcggtcgaagccttgcgtgaacaagggcagtgtgtcgtgattgactacggtatcggacacaatgtttcggaagagcttgcaggccgtctgaaaaagacggacggcgtttggcaggtcgtgaaacgc

SEQ ID NO: 3226 - protein, 383 aa, Neisseria gonorrhoeae
MQTWQLPEHIADVLPTNARQLESAREQLLALFRVHGYELVQPPLMEYAHSLLTHIDAGLSLKTILVTDRLSGRQLGIRADITPQVARIDAHLLSANQGINRLCYAGPVLHAQPDGLPNMREPLQAGAEMYGFADIRGDIELIDLMLKSMKIADMGKVLLSLGHIGIFRALSDAAHLDAGQSAALLALMQDKDTGSVEAQVKAWKLDGMWAKAFSLLPRLYGGREVLSDARGRLPDLSAVGGALDELQAVCDAFPDNEIHIDLSELRVDNYHTGLLYAAYAADFHDAVARGGRYDGLGGYFGRARPATGFSFDLRSFIGRLPAVERQPAVLVDAEDAEAAREAVEALREQGQCVVIDYGIGHNVSEELAGRLKKTDGVWQVVKR

SEQ ID NO: 3227 - DNA, 144 bp, Neisseria gonorrhoeae
gtgtccgataccgtagtcaatcacgacacactgcccttgttcacgcaaggcttcgaccgcttcgcgcgccgcttctgcatcttccgcatcgaccaacacggcgggctgccgttcgacggcgggcaaacgcccgataaagctgcg

SEQ ID NO: 3228 - protein, 48 aa, Neisseria gonorrhoeae
VSDTVVNHDTLPLFTQGFDRFARRFCIFRIDQHGGLPFDGGQTPDKAA

SEQ ID NO: 3229 - DNA, 1302 bp, Neisseria gonorrhoeae
atggctatggctaaaaatgttgtagtaatcggcgcacagtggggcgacgagggtaaaggtaaaatcgttgactggctggcggaagaagccggcggcgtcgtgcgcttccaaggcggccacaatgcgggccataccttggtcgtcggcggcaaaaaaaccattttgcgcctgattccgagcggtatcctgcacgaaggattggattgcttcatcggttcgggcgttgtcgtttcccccgaagccctgttgggcgaaatcgacgagttgaacgcggcaggcgtgaaaaacgtcgaaggccgtctgaaaatcgcgccgacctgcccgctgatcctgccttaccacatcgcgctcgaccaagcccgcgaagcatcgcgcggcaaaggcaaaatcggcacgaccggccgcggcatcggccctgcctacgaagacaaagtggcacgccgcgccattcgcgccgccgatttgctgcatcctgaaaaactgcgtgaaaaactggatgccgtccttgcctattacaacgtccaactccaatacctgcataacgccggaccggttaaagcggaagacgtgatggcggttatcgaaaaagtcgcgccgcgcattgcgccgatgattgccgacgtgtcccgcgtgttgaacgaaaaaaacaaaaacggcgaaaaactgctgtttgaaggcgcgcaaggtgcgttgttggacatcgactacggcacttaccccttcgttacctcgtccaactgtctcgccggcgcggcttcggcaggcgcgggcgtaggtcctcaaatgctggattatgttttgggcatcgtcaaagcctataccacgcgcgtcggttcgggcccgttcccgaccgaattgttcgacgaagtaggcgcaggtttggcggagcgcggacacgaattcggttcggtaaccggccgcgcgcgccgctgcggctggtttgatgccgccgccctgaaacgctccatccaaatcaacggcatttccggtatgtgcattaccaaactcgatgtaatggacggcgttgaaaccatcaatatctgcgtcggctacgaattgccaggcggcggcaaaaccgacatcctgccttgcggttcggatgcggtggaaacctgcaaaccgatttacgaaaccatgcccggctggcgcgaatcgactgtcggcgtgaaaagctacgacgcattgcctgccaatgccaaagcatatttgaaacggattgaagaagtctgcggcgcgccggtcgccatcgtctccaccggccccgaccgcgaagaaacgattgtgctgcatcatccgttcgca

SEQ ID NO: 3230 - protein, 434 aa, Neisseria gonorrhoeae
MAMAKNVVVIGAQWGDEGKGKIVDWLAEEAGGVVRFQGGHNAGHTLVVGGKKTILRLIPSGILHEGLDCFIGSGVVVSPEALLGEIDELNAAGVKNVEGRLKIAPTCPLILPYHIALDQAREASRGKGKIGTTGRGIGPAYEDKVARRAIRAADLLHPEKLREKLDAVLAYYNVQLQYLHNAGPVKAEDVMAVIEKVAPRIAPMIADVSRVLNEKNKNGEKLLFEGAQGALLDIDYGTYPFVTSSNCLAGAASAGAGVGPQMLDYVLGIVKAYTTRVGSGPFPTELFDEVGAGLAERGHEFGSVTGRARRCGWFDAAALKRSIQINGISGMCITKLDVMDGVETINICVGYELPGGGKTDILPCGSDAVETCKPIYETMPGWRESTVGVKSYDALPANAKAYLKRIEEVCGAPVAIVSTGPDREETIVLHHPFA

SEQ ID NO: 3231 - DNA, 837 bp, Neisseria gonorrhoeae
gtgaaacgcatttttctgtttttggctaccaatatcgctgttttggtcgtaatcaacattgttttggcggttctgggcatcaacagccggggcggcgcgggcagcctgttggcgtattccgccgtcgtcggcttcactggttcgattatttcgctgctgatgtccaaatttatcgccaaacaatcggtcggtgcggaagtcatcgacacgccgcgcaccgaagaagaagcctggcttctgaacactgtcgaagcccaagcgcggcaatggaatctgaaaacgccagaagtcgccatctaccactcccccgaacccaatgcctttgccacgggcgcatcgagaaacagctccctgatcgccgtcagcaccggtttgctcgaccatatgacgcgcgacgaagtggaagccgtgttggcgcacgaaatggcgcacgtcggcaacggcgacatggttacgctgacgctgattcaaggcgtggtcaatacctttgtcgtgttcctgtcgcgcattattgccaacctgattgcccgaaacaacgacggcagccagtcccagggaacttatttcctagtcagcatggtattccaaatcctgttcggcttccttgccagcctgattgtcatgtggttcagccgccaacgcgaataccgcgccgacgcgggcgcggcaaaactggtcggcgcaccgaaaatgatttccgccctgcaaaggcttaaaggcaacccggtcgatttgcccgaagaaatgaacgcaatgggcatcgccggagatacgcgcgactccctgctcagcacccacccttcgctggacaaccgaatcgcccgcctcaaatcgctt

SEQ ID NO: 3232 - protein, 279 aa, Neisseria gonorrhoeae
VKRIFLFLATNIAVLVVINIVLAVLGINSRGGAGSLLAYSAVVGFTGSIISLLMSKFIAKQSVGAEVIDTPRTEEEAWLLNTVEAQARQWNLKTPEVAIYHSPEPNAFATGASRNSSLIAVSTGLLDHMTRDEVEAVLAHEMAHVGNGDMVTLTLIQGVVNTFVVFLSRIIANLIARNNDGSQSQGTYFLVSMVFQILFGFLASLIVMWFSRQREYRADAGAAKLVGAPKMISALQRLKGNPVDLPEEMNAMGIAGDTRDSLLSTHPSLDNRIARLKSL

SEQ ID NO: 3233 - DNA, 114 bp, Neisseria gonorrhoeae
ttgcaagcaaatgttttgcatacctttgccgagcctgatattcacaaggcggcaactttttgggacaatccccaaaatttcaaaacatcacaccctaccaaaaaggaacatccg

SEQ ID NO: 3234 - protein, 38 aa, Neisseria gonorrhoeae
LQANVLHTFAEPDIHKAATFWDNPQNFKTSHPTKKEHP

SEQ ID NO: 3235 - DNA, 924 bp, Neisseria gonorrhoeae
gtgatccttttaaatgtgtttattggaatcaaacagatggtttacgattctacacggcttggcgcaatagttcaaaaaccaactgcacaaactgccatttgcaagcaaatgttttgcatacctttgccgagcctgatattcacaaggcggcaactttttgggacaatccccaaaatttcaaaacatcacaccctaccaaaaaggaacatccgtgaaacgcatttttctgtttttggctaccaatatcgctgttttggtcgtaatcaacattgttttggcggttctgggcatcaacagccggggcggcgcgggcagcctgttggcgtattccgccgtcgtcggcttcactggttcgattatttcgctgctgatgtccaaatttatcgccaaacaatcggtcggtgcggaagtcatcgacacgccgcgcaccgaagaagaagcctggcttctgaacactgtcgaagcccaagcgcggcaatggaatctgaaaacgccagaagtcgccatctaccactcccccgaacccaatgcctttgccacgggcgcatcgagaaacagctccctgatcgccgtcagcaccggtttgctcgaccatatgacgcgcgacgaagtggaagccgtgttggcgcacgaaatggcgcacgtcggcaacggcgacatggttacgctgacgctgattcaaggcgtggtcaatacctttgtcgtgttcctgtcgcgcattattgccaacctgattgcccgaaacaacgacggcagccagtcccagggaacttatttcctagtcagcatggtattccaaatcctgttcggcttccttgccagcctgattgtcatgtggttcagccgccaacgcgaataccgcgccgacgcgggcgcggcaaaactggtcggcgcaccgaaaatgatttccgccctgcaaaggct

SEQ ID NO: 3236 - protein, 308 aa, Neisseria gonorrhoeae
VILLNVFIGIKQMVYDSTRLGAIVQKPTAQTAICKQMFCIPLPSLIFTRRQLFGTIPKISKHHTLPKRNIRETHFSVFGYQYRCFGRNQHCFGGSGHQQPGRRGQPVGVFRRRRLHWFDYFAADVQIYRQTIGRCGSHRHAAHRRRSLASEHCRSPSAAMESENARSRHLPLPRTQCLCHGRIEKQLPDRRQHRFARPYDARRSGSRVGARNGARRQRRHGYADADSRRGQYLCRVPVAHYCQPDCPKQRRQPVPGNLFPSQHGIPNPVRLPCQPDCHVVQPPTRIPRRRGRGKTGRRTENDFRPAKA

SEQ ID NO: 3237 - DNA, 645 bp, Neisseria gonorrhoeae
atgaaagcattacttttaggcgcaccgggcgcgggcaaaggcactcaggcgcaattcatcaccgccgcgttcggcattccgcaaatctctaccggcgacatgctccgtgccgcgattaaggcaggcacgcccttgggtttggaagcgaaaaaaatcatcgatgaaggcggtttggtgcgcgacgacatcattatcggcatggtcaaagaacgcatcgcgcaagacgactgcaaaaacggtttcctgttcgacggtttcccgcgtacattggcgcaagccgaagcgatggtggaagcaggcgtgggtttggacgcggtcgttgaaatcgacgtatccgacagcgtgattgtcgaccgcatgagcggccgccgcgtgcatttggcttccggccgtacttaccacgttacctacaatccgcctaaaaccgaaggcaaagacgacgtaaccggcgaagatttgattcagcgcgacgacgacaaagaagaaaccgtgaaaaaacgtcttgccgtttaccacgagcaaaccgaagttttggttgatttttacagcaagctggaaggcgaacacgcgccgaaatacatcaaagtcgacggtacccaagcagtagaagctgtgaaagccgaagtattgggcgcattgggcaaa

SEQ ID NO: 3238 - protein, 215 aa, Neisseria gonorrhoeae
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVGLDAVVEIDVSDSVIVDRMSGRRVHLASGRTYHVTYNPPKTEGKDDVTGEDLIQRDDDKEETVKKRLAVYHEQTEVLVDFYSKLEGEHAPKYIKVDGTQAVEAVKAEVLGALGK

SEQ ID NO: 3239 - DNA, 108 bp, Neisseria gonorrhoeae
atgtttgaaaataaaagaaaaatcagatgcttgtattcccgcctgcgcagaaatggagacggtgctctgtcgtctcatttttgttttaatcaactatatataactgat

SEQ ID NO: 3240 - protein, 36 aa, Neisseria gonorrhoeae
MFENKRKIRCLYSRLRRNGDGALSSHFCFNQLYITD

SEQ ID NO: 3241 - DNA, 558 bp, Neisseria gonorrhoeae; identical to SEQ ID NO: 2303

SEQ ID NO: 3242 - protein, 186 aa, Neisseria gonorrhoeae; identical to SEQ ID NO: 2304

SEQ ID NO: 3243 - DNA, 2259 bp, Neisseria gonorrhoeae
agctcccgccagttcaataatgcccatcaacgcacccagcgcggcattttcggtatgcagcggcagatgcaccacgttttcaggcaaaccggcatcggctttgacggcaaccgatacgcttgcaccgttttgtttggcgacagcggtttgtccgtcttgcaggcccaagcgtgccaatgtgttcggattcacacgcgcggcaggcacggcggcatggctggtttcttgcaacggtgcggaacggcgcacgatagaatcagtatgataaataccgacgccgccgacacggacgaggcggtttgaggccgtctgaacgccctcccctgcccatgtgctgcggttgtccagtttggacggcagactttccgcatccagcgcgtctttcagaatcgcagcggtatcgtggtattcaaaacctttcaggtcaaacaggttgcccaatacgcgcaacactttccacatcggacgtgaatcgccgaagccttgtaccacgccgtggaaagattgcagacggccttccatattgatgaagctgcctgatgtttcggtaaacggcgcaatcggcagcaatacgtcgcacacgtccagcagcgtttcgctgacaaacggcgtaaacgccatcacgcttttcgcctgtttcaacgcggctacggcttttgcaccgtcaaccgtatcgatttcaggctcgacgttgagcagcaagactgcctgtttcggcgtgtttgccatttcggcaacgctctcgcccgagttcacacccaatacgtccgcaccgacgctgttggcggcttgcggcaaaatgcccagcactgcgccggtcgcgtccgccaactcttgcgcggcggcataaatggcggcgtaatcaggatggttttgcacttccgcacccaaaatcaccgctgctttttcagcgtttttcaggctggcggtaacggcatgttccgcatcggcagacaggtttttcagacggcctgcccactcgtcgggatgtgcggcttcttgagacagaagcggcataaacaattcttctttactgccggccaatacgctcaaggccatacggtctttggcggcgcggcgcaggcgggcggtcaggagcggctgttctttgcgcaagttcgcaccgactaccaatacggcatcgttgtcagccaaagattcaatactttgtcccaaccattgcgcacctttaaggccgtctgaaagacgtttgtcttgttggcgcaaacgggttgcaaagtttttaacacccaagccgtcggcaaattttttggccagatacagctcttcaaccgtattcatcggattagcccaaacgccgacttggttttggttgccgtctttggcgatacattcaatcgcgctgcggacatattccaacgcggttttccaatccacgtccatccactcgccaccctgtttgattttcggatttttcagacggctttcgtgatacaggccttcgtaggcaaaacggtcgcggtcggacagccagcattcgttgatggcttcgttttccaacggcaacacgcggcggacggtatggtctttggtttgtacaatcaggttgctgcccaaagcgtcgtgtgcggaaacggatttgcggcggttcaattcccaagtacgcgcgttgaagcggaacggtttgctggtcaatgcgccgacgggacacaaatcgatgacgttgcccgacagctcggtttccaccgctttgccgataaagggcatgatttcggagtgttcaccacgattcaccatcgcaatttcctgcaaaccggcgatttcttcggtgaaacgtacgcagcgggtacagtggatacagcggctcatttcctcggcggaaaccaaaggacccatgtccttgccgacgacggaacgtttttcttcggtataacggctggtggttttgccgtagcccaccgccaaatcctgcaactggcattcgccgccctggtcgcaggtcggacaatcaagcggatggttgatgagcaggaactccatcacgccttcctgcgcctctcgggcttttgccgaatgcgtacgcacaatcatgccgtccgttaccggcgtggcacaggcaggcagcggtttgggggctttttccacatccaccagacacatacggcagttggcggcaatagagagctttttgtggtaacagaaatgcggaatataagtaccgagcttgtgcgcggcttcaattaccgtcgcgccctgctccacagatacctgtttgccgtcgatttcgatttgtaacat

SEQ ID NO: 3244 - protein, 100 aa, Neisseria gonorrhoeae
SSRQFNNAHQRTQRGIFGMQRQMHHVFRQTGIGFDGNRYACTVLFGDSGLSVLQAQACQCVRIHTRGRHGGMAGFLQRCGTAHDRISMINTDAADTDEAV

SEQ ID NO: 3245 - DNA, 141 bp, Neisseria gonorrhoeae
ttgataaacagcgtgttgcaaccgaaaaataatcattcggcgtcattcccgcgcaggcgggaatccatttctgaatttgggcaatcgctgtttaaatctgatgaactgagttttatcaatggattcccgcctgcgcgggaa

SEQ ID NO: 3246 - protein, 47 aa, Neisseria gonorrhoeae
LINSVLQPKNNHSASFPRRRESISEFGQSLFKSDELSFINGFPPARE

SEQ ID NO: 3247 - DNA, 93 bp, Neisseria gonorrhoeae
atgacggctgatgtaccggttcaaatttatccgaaacagtttgtcgggggcttgagtccgcgtaggtcggacatcaatgcccggcctacggtt

SEQ ID NO: 3248 - protein, 31 aa, Neisseria gonorrhoeae
MTADVPVQIYPKQFVGGLSPRRSDINARPTV

SEQ ID NO: 3249 - DNA, 129 bp, Neisseria gonorrhoeae
ttgaaccggtacatcagccgtcattcccgcgcaggcgggaatccattgataaaactcagttcatcagatttaaacagcgattgcccaaattcagaaatggattcccgcctgcgcgggaatgacgccgaa

SEQ ID NO: 3250 - protein, 43 aa, Neisseria gonorrhoeae
LNRYISRHSRAGGNPLIKLSSSDLNSDCPNSEMDSRLRGNDAE

SEQ ID NO: 3251 - DNA, 957 bp, Neisseria gonorrhoeae
ttgaatttacgttgttatagcggattaacaaaaatcaggacaaggcggcgggccgcagacagtacggatagtacggaaccggttcgcccggtgcttgggcgccttagggaaccgttccctttgagccggggcggggcaacgacgtaccggtttaaagttaatccgctatactgcgaaaaagacgataaaggtcgtctgaaaacccgaaacgaaaacaccatgaatcctttaatcaccgacttccaaactccgcaacaacgtacccccgtcatcgttgcccttgattttgccaacgaaaaagacacgctcggattcgtccgcaaccttgatccggcgttgtgccaaatcaaaatcggcaaagagctgtttaccgctacggggcgcagtttggcggaaagcctgattcatcagggtttcaaactctttcttgatttgaaataccacgatattccccacaccgtcgcgcaggcgtgtaaagtcgccgccgatatgggcgtgtggatggtcgatatgcacgcgtcgggcggcagacgtatgatggaagccgccgccgaagccgttgccggatacggcacgaaaccgctcttaatcggcgtaaccgtgttgaccagcatggagcaaagcgatttggcggaaatcggtttgaacaccgcccctgaagaacaagtcatccgtttggcaaaactggcacaaagttcgggcttggacggcgtggtctgttccgcccaagaagccgcgccgctgcgccgcgaattgggacgggattttgtcttggttacaccgggtatccgcttggacgttgccggcaacaacgacgaccaacgccgcattatgacacccgccgaagccttggcggcgggttcgacttatctggtgatgggccgccccgttacccgagccgccgatccggtcgccgtattgcgcgaagtgaaccgcgtggcaaaccttgaagcaaac

SEQ ID NO: 3252 - protein, 319 aa, Neisseria gonorrhoeae
LNLRCYSGLTKIRTRRRAADSTDSTEPVRPVLGRLREPFPLSRGGATTYRFKVNPLYCEKDDKGRLKTRNENTMNPLITDFQTPQQRTPVIVALDFANEKDTLGFVRNLDPALCQIKIGKELFTATGRSLAESLIHQGFKLFLDLKYHDIPHTVAQACKVAADMGVWMVDMHASGGRRMMEAAAEAVAGYGTKPLLIGVTVLTSMEQSDLAEIGLNTAPEEQVIRLAKLAQSSGLDGVVCSAQEAAPLRRELGRDFVLVTPGIRLDVAGNNDDQRRIMTPAEALAAGSTYLVMGRPVTRAADPVAVLREVNRVANLEAN

SEQ ID NO: 3253 - DNA, 960 bp, Neisseria gonorrhoeae
atgcccgccaagttccaacaagaaaccctcaaatcccgtttcgcacaagccaaagttcttgttgtcggcgacgtgatgctcgaccgctattggtttggcgacgtgtcccgaatttcgcccgaagcacccgtgccggtggcaaaaatcggacgaatcgaccaacgggcgggcggcgcggcgaacgttgcgcgcaacatcgcttcgttgggcggcagggcagggctgttgtccgtaaccggcgacgacgaagccgccgccgcgctcgacgcgctgatggtgcaggacggcgtcgcctcctatctgatgcgcgacaaacaaatcgccaccaccgtcaaactgcgcgtcgtcgcccgcaaccagcagcttatccgccttgattttgaagaacatcccaaccgcgaagtgttggaacaaatcaagcggaaataccgcgaaatcttgcccgaatacgacgcaatcattttttcggactacggcaaaggcggtctgtcgcatatctccgatatgatcgattgggcgaaacatgtcggcaaaaccgtcttaatcgaccccaaaggcgacgattacgaaaaatatgtcggcgcaactctgattacgcccaactgcgccgaattgaaagaagtggttggcagttggaaaaacgaaggcgatctgaccgaaaaagcgcaaaacctgcgccgccacctcgacttgaccgccgttttgctgacccggagcgaagagggcatgaccctgttcagcgaaggcgaacccatttaccagcccacccgcgcccaagaagtttacgacgtgtccggcgcaggcgacaccgtcattgccggaatgggcttggggctggcggcaggctgcaccatgcccgaagccatgtaccttgccaatactgcggccggggttgtcgtggcgaaactcggtacggcggtttgctcgtttgcagagttggttgaagcactggacgggcaa

SEQ ID NO: 3254 - protein, 320 aa, Neisseria gonorrhoeae
MPAKFQQETLKSRFAQAKVLVVGDVMLDRYWFGDVSRISPEAPVPVAKIGRIDQRAGGAANVARNIASLGGRAGLLSVTGDDEAAAALDALMVQDGVASYLMRDKQIATTVKLRVVARNQQLIRLDFEEHPNREVLEQIKRKYREILPEYDAIIFSDYGKGGLSHISDMIDWAKHVGKTVLIDPKGDDYEKYVGATLITPNCAELKEVVGSWKNEGDLTEKAQNLRRHLDLTAVLLTRSEEGMTLFSEGEPIYQPTRAQEVYDVSGAGDTVIAGMGLGLAAGCTMPEAMYLANTAAGVVVAKLGTAVCSFAELVEALDGQ

SEQ ID NO: 3255 - DNA, 1050 bp, Neisseria gonorrhoeae
atgaccatccaatgccgtctgaaaccctcaaaacaaaggaaaccgaatatgaccatcatcgtaacaggcgcggccggctttatcggcagcaacatcgtcaaagccctcaaccaacgcggcattaccgacatcgtcgccgtcgataatctgacaaaaggcgaaaaattcaaaaaccttgccgagtgcgaaatcgcccattatctcgacaaacacgaatttatccgccaagtgagggaacacattttaccttatcaaaacatcgaagccgttttccatcaaggcgcgtgttccgatacgatgaaccacgacggtttgtatatgatggaaaacaactaccagtacacgctggatttgttggactggtgtcaggacgaacgcatccccttcctttatgcctccagtgcggcggtttacggcaaaggcgaaatcttccgcgaagagcgcgaactcgaaaaaccgcttaatgtgtacggctactccaaattcctgtttgaccaagtattgcgccgccgcatgaaagaaggtctcaccgcccaagtcgtcggcttccgctacttcaacgtttacggacaacacgaacaacacaaaggccgcatggcatccgtcgccttccaccatttccaccaataccgcgaacacggttacgtcaacctgttcggcagcaacgacggctacggcaacggcgaacaaacccgcgacttcgtcagcgtcgaagacgtcgccaaaatcaacctctacttcttcgaccatcccgaactttccggcatctacaacctcggcaccggccgcagccaacagttcaacgaactcgccgccgccgccgtcaacgcctgccgcgccgccgaaggcaaatctgaattgagcttgaaagagttggtagaagaagaacttatccgctatatcccctttcccgacgcgctcaaaggcaaataccagggcttcacccaagccgacatcaccaaattgcgcgaagccggatataaggaagaatttttcgatgtcaaagcaggtgtcaaccgctacgtcaaatggatgctggaaaatttggct

SEQ ID NO: 3256 - protein, 350 aa, Neisseria gonorrhoeae
MTIQCRLKPSKQRKPNMTIIVTGAAGFIGSNIVKALNQRGITDIVAVDNLTKGEKFKNLAECEIAHYLDKHEFIRQVREHILPYQNIEAVFHQGACSDTMNHDGLYMMENNYQYTLDLLDWCQDERIPFLYASSAAVYGKGEIFREERELEKPLNVYGYSKFLFDQVLRRRMKEGLTAQVVGFRYFNVYGQHEQHKGRMASVAFHHFHQYREHGYVNLFGSNDGYGNGEQTRDFVSVEDVAKINLYFFDHPELSGIYNLGTGRSQQFNELAAAAVNACRAAEGKSELSLKELVEEELIRYIPFPDALKGKYQGFTQADITKLREAGYKEEFFDVKAGVNRYVKWMLENLA

SEQ ID NO: 3257 - DNA, 111 bp, Neisseria gonorrhoeae
gtgcagttgggcgcgttgttgcatttcggtcatcatcgaaatccatatataaagttaaacaaatcaaaatcgcctgatattttcagacgatttttttacgggcattcaaat

SEQ ID NO: 3258 - protein, 37 aa, Neisseria gonorrhoeae
VQLGALLHFGHHRNPYIKLNKSKSPDIFRRFFYGHSN

SEQ ID NO: 3259 - DNA, 1530 bp, Neisseria gonorrhoeae
atgcaacaacgcgcccaactgcaccgccaaatttggaaaatcgccgacgaagtacgcggcgcggtggatggctgggactttaaacaatacgttctcggcacacttttctaccgctttatcagcgaaaacttcaccgactatatgcaggccggcgacagcagcattgattacgccgctatgccggacagcatcatcacgcccgaaatcaaagacgatgccgtcaaagtcaaaggctatttcatctaccccggccagcttttttgcaatattgccgccgaagcccatcaaaacgaagagctcaacaccaagctgaaagaaatctttaccgcgattgaaagctccgcctccggctacccgtccgaacaaggcatcaaaggcttgtttgacgacttcgacaccaccagcagccggctcggcagcaccgttgccgacaaaaacaaacgccttgccgccgtccttaaaggcgtggcggaactcgatttcggcaattttgaagaccaccgcatcgaccttttcggtgatgcctacgaatacctgatttccaactacgccgccaacgcaggcaaatccggcggcgaatttttcaccccgcaaagcgtctccaagctgattgcgcggctggcggtgcacgggcaggagaaagtcaacaaaatctacgaccccgcctgcggctcgggcagcctgctcttgcaggcgaaaaaacagtttgacgaacacatcatcgaagaaggcttcttcgggcaggaaatcaaccacaccacctacaacctcgcccgcatgaatatgtttctgcacaacgtcaattacaacaaattccacatcgaattgggcgacacgctgaccaaccccaaactcaaagacagcaaaccctttgatgccgtcgtctccaatccgccctattccatcgactggataggcagcgacgaccccaccttgatcaacgacgaccgctttgcccccgcaggcgtactcgcaccgaaatccaaagccgattttgccttcatcctgcacgcactgaactacctttccggcagaggccgcgccgctatcgtctcattccccggcattttctatcgcggcggcgcagagcagaaaatccgccaatatctggtggagggcaactatgtggaaaccgtgattgcccttgcgcccaatctcttttacggcacctgcatcgccgtcaatatcctggttttgtccaaacacaaagacaataccgacatccaattcatcgacgcaagcggcttctttaaaaaagaaaccaacaacaacgtcttaaccgaagaacacattgccgaaatcgtcaaactcttcgccgacaaagccgatgtgccgcatatcgcccaaaacgccgcccagcaaaccgtcaaagacaacggctacaacctcgccgtcagcagctatgtcgaagccgaagacacccgcgaggtcatcgacatcagacagctcaacgccgaaatcagcgaaaccgtcgccaaaatcgaacggctgcggcgtgaaattgacgaagtgattgcagagattgaaacc

SEQ ID NO: 3260 - protein, 510 aa, Neisseria gonorrhoeae
MQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQGIKGLFDDFDTTSSRLGSTVADKNKRLAAVLKGVAELDFGNFEDHRIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSIDWIGSDDPTLINDDRFAPAGVLAPKSKADFAFILHALNYLSGRGRAAIVSFPGIFYRGGAEQKIRQYLVEGNYVETVIALAPNLFYGTCIAVNILVLSKHKDNTDIQFIDASGFFKKETNNNVLTEEHIAEIVKLFADKADVPHIAQNAAQQTVKDNGYNLAVSSYVEAEDTREVIDIRQLNAEISETVAKIERLRREIDEVIAEIET

SEQ ID NO: 3261 - DNA, 174 bp, Neisseria gonorrhoeae
ttgataaataattttttatggagatcgtctgaaaaatgggcttcagacggccttttgagtttcattgacaatcaatactgtttaaaacgtttactgccaccttgccgtcattcccgcacaggcgggaatccattttttgaatttcggcaactgcttttcaaatatcgggttctg

SEQ ID NO: 3262 - protein, 58 aa, Neisseria gonorrhoeae
LINNFLWRSSEKWASDGLLSFIDNQYCLKRLLPPCRHSRTGGNPFFEFRQLLFKYRVL

SEQ ID NO: 3263 - DNA, 117 bp, Neisseria gonorrhoeae; identical to SEQ ID NO: 2477

SEQ ID NO: 3264 - protein, 39 aa, Neisseria gonorrhoeae; identical to SEQ ID NO: 2478

SEQ ID NO: 3265 - DNA, 849 bp, Neisseria gonorrhoeae; identical to SEQ ID NO: 253

SEQ ID NO: 3266 - protein, 283 aa, Neisseria gonorrhoeae; identical to SEQ ID NO: 254

SEQ ID NO: 3267 - DNA, 99 bp, Neisseria gonorrhoeae
gtgagccgaaacccgccccgcaaccgccccacatcccgccgcagcgggaaggaaacggaaaacaaccatggatatgcaaagcaaagcgaaaaaattgat

SEQ ID NO: 3268 - protein, 33 aa, Neisseria gonorrhoeae
VSRNPPRNRPTSRRSGKETENNHGYAKQSEKID

SEQ ID NO: 3269 - DNA, 618 bp, Neisseria gonorrhoeae
atgcaaagcaaagcgaaaaaattgattgagatgattcagacggcaccggtggagtggaagccattgggggaggttttagttcgtacaaaaggaactaagataactgctggacaaatgaaagaaatgcataaagataatgcgccgttaaagatttttgcaggaggaaaaacttttgcattagttgactttgatgatgttcctgataaggatatccatagagagccttctattatcgttaaatcaagaggtattattgaattcgaatattacgataaaccattttcgcataaaaatgaaatgtggtcttatcattcagttaataaacatatttatataaaatatgtttattatttcttaaaaacacaagaaaactattttcgtaatatcggatcaaaaatgcaaatgccacaaatagcaacaccagatacagataactataaaatccccatcccatcattggaaacccaacaaaaaattgtaaaaatacttgacaaattcaccgagctggaagctacgctggaagctacgctggaagcggaattagccctgcgcaaacgccaataccggtattaccgcgacttacttttagattttgacaatcaaatcgggggggatagc

SEQ ID NO: 3270 - protein, 206 aa, Neisseria gonorrhoeae
MQSKAKKLIEMIQTAPVEWKPLGEVLVRTKGTKITAGQMKEMHKDNAPLKIFAGGKTFALVDFDDVPDKDIHREPSIIVKSRGIIEFEYYDKPFSHKNEMWSYHSVNKHIYIKYVYYFLKTQENYFRNIGSKMQMPQIATPDTDNYKIPIPSLETQQKIVKILDKFTELEATLEATLEAELALRKRQYRYYRDLLLDFDNQIGGDS

SEQ ID NO: 3271 - DNA, 621 bp, Neisseria gonorrhoeae; identical to SEQ ID NO: 313

SEQ ID NO: 3272 - protein, 207 aa, Neisseria gonorrhoeae; identical to SEQ ID NO: 314

SEQ ID NO: 3273 - DNA, 135 bp, Neisseria gonorrhoeae
taactcatttattatatttttaaatgacttaaataactctttaacagcacgctcattgtcttcatctgtaggctcaaacttttcacaccaattaattatatttacatcgccatgcaatatcctactgcatcgcaa

SEQ ID NO: 3274 - protein, 7 aa, Neisseria gonorrhoeae
LIYYIFK

SEQ ID NO: 3275 - DNA, 432 bp, Neisseria gonorrhoeae
atggcatttggttcgatgaattccagcgacgattctccgatgtccgacatcaacgttacgccgttggtggacgtgatgctggtgttgctgattgtgtttatgattactatgccggtgctgacgcattccatccctttggaactgccgaccgcgtccgagcaggcaaacaagcaggacaaacagcctaaagaccccctgcgcctgacgattgatgcgaacggcggctattatgtcggcggggattctgcaagcaaagtggaaatcggggaagtggaaagccgtctgaaagccgccaaggagcagaatgaaaacgtgattgtggcgattgcggcagacaaggcggtggaatacgattatgtaaacaaagctttagaagccgcccgtcaggcaggaatcaccaaaatcggttttgtaaccgaaaccaaggcgcaa

SEQ ID NO: 3276 - protein, 144 aa, Neisseria gonorrhoeae
MAFGSMNSSDDSPMSDINVTPLVDVMLVLLIVFMITMPVLTHSIPLELPTASEQANKQDKQPKDPLRLTIDANGGYYVGGDSASKVEIGEVESRLKAAKEQNENVIVAIAADKAVEYDYVNKALEAARQAGITKIGFVTETKAQ

SEQ ID NO: 3277 - DNA, 3096 bp, Neisseria gonorrhoeae
atgaacctcgaaaccaaacccatcgccgaaacgccgaatttcatcgtgctcgaccaatatgaaaaaatcgaacagtcgggcagctaccaatcggaaaaccggttggaagcggagttaatcgccgatttgcagaatcaggggtacgaataccgcaaggatttgaacagccaaagcaggctgctggaaaacctgcgcgcccagttgcagcggctgaacgatgtggcgttttcagacggcgaatgggcgcggtttttgacggaatatctggacaggccggctgaaaacattaccgataaaacccgcaaaatccacgacgaccatatttacgatttcgcttttgatgacggccgtctgaaaaacatttatctgctggacaagaaaaaccttgcccgcaaccatgtgcagcttatcaaccagtttgagcagacgggcacgcatgcaaaccgttatgacgttaccgtgttggtaaacggcctgccgctggtgcagattgaattgaaaaagcgcggtgtggcggtgcgcgaggcattcaatcaggtgcaccgttacagcaaagagagcttcaacagcggaaattcgctgttcaaattcctgcaaatcttcgtgatttccaacggcacggacacgcgctatttcgccaacaccaccaagcgcgacaaaaacagcttcgatttcacgatgaattgggcgcggtcggacaatcatccgattaaggatttgaaagactttaccgccacgttcctgcaaaaaagcgtattgctgagcgttttgctgcattacagcgtgttcgatgcgaatgatacgctgctgattatgcggccgtaccagattgccgccgccgaacgcattttgtggaaaatcaacagctcggcgcaggcgaagaattggagcgggccggaaagcggcggctatgtttggcataccacgggcagcggcaaaacgctgaccggctttaaggcggcgcgtctggcgacggaatcggcgtttatcgacaaggttttcttcgtggtggacaggaaggatttggactatcagacgatgaaggaataccaacgtttttcgcccgacagcgtaaacggctcggaaagtacggcgggcttgaaacgcaatttggaaaaagacggcaacaaaatcatcgttaccaccatccaaaagctgaacaacctgatgaaaagtgaagataatctgccggtttatcaccggcaggttgtatttattttcgacgaatgccaccgctcgcaattcggcgaagcgcaaaaaaacctgaaaaagaaatttaaaaaattctgccagttcggctttaccggcacgccgatttttcccgaaaacgctttgggcgcggaaaccacggcgggcgtgttcgggcgggagctgcattcttatgtgattaccgatgccatccgcgatgaaaaagtattgaaattcaaagtggattacaacgatgtacgcccgcagttcaaagccgtggaagcggaacaggacgagaaggaactgagtgccgccgaaaaccgccaagccctgctgcaccccgaacgcatccgcgaaatcacgcaatatatcctgagccggttcaggcagaaaacgcaccgcttgaatgcgggcggcaaaggcttcaacgccatgtttgccgtcagcagcgtggatgcggcgaagtgctattacgaagcgttcaaaacacaacaggcaggcagcctgcacccgttgaaaacagccaccattttttcctttgccgccaacgaagagcaaaacgccgtcggtgaaattgttgacgagacctttgaaccggaagcgatggacagcagcgcgaaagaatttttgcaggctgccatcaacgattacaacgcctgtttcaaaaccaatttcggcacggacagcaaagcctttcagaactactaccgcgatttggcaaaacgggtgaaaaaccgggaagtggacttgctgattgtggtcggcatgtttttgacgggttttgacgcaccgacgctgaatacgctgttcgtcgataaaaacctgcgctatcacggcctgatgcaggcgttttctcgcaccaaccgcatttacgatgctaccaaaaccttcggcaacattgtctgcttccgcgacttggagcaggcaaccattgatgcgatcacgctcttcggcgacaaaaacaccaaaaatgtagtgctggaaaaaagctacgaagaatacatgaacggctataccgacagccagaccggcgaagcacggcgcggttatctggatgtagcaaaagaattgcacgagcgtttccccgatcccgacaaaatcgaaacggaaaaagacaaaaaagattttgccaaactcttcggcgaatacctgcgggcggaaaatgtattgcagaactacgatgaatttgccgcgctgcgcgaattgcagaatgtggacgcggcggacgaagatgcgatgaaggcgtttcaggaaaaatactacctgagcgacgaagacgtgcaggaaatgcggaaagtgccgatgccgtctgaaagggcggtgcaggactaccgttccgcctataacgacatccgagactggctgcgccgccaaaaagcaggcgaacagaaagaacagtcaaaaatcgactgggacgatgtggtttttgaggtggatttgctcaaatcgcaggaaatcaatctggattacatcctgcaactggttttcgagcatcacaaaaaaatcaaaggcaaagcggagctggtggaagaaatccgccgcatcatccgcgccagcatcggccaccgcgccaaagagggcctgattgtggatttcatcaacgatacggatttggataaagtgcccgacgttcccgccatactggaaaccttttacacctacgcgcaagaggtgatgcggcacgaagcggcaggattgattgccgccgaaggcctgaacgaaaccgccgccaaacgctatttgaccggctcgctcaaacgcggctatgccagcgaaaacggtacggaactgaccgaaaccctgccgaaaatgagtccgctcaacccgcaatatctgacgaagaaacaaagcgtcttccaaaaaatcgcggcgtttgtggagaagtttgccggaataggggccgatatt

SEQ ID NO: 3278 - protein, 1032 aa, Neisseria gonorrhoeae
MNLETKPIAETPNFIVLDQYEKIEQSGSYQSENRLEAELIADLQNQGYEYRKDLNSQSRLLENLRAQLQRLNDVAFSDGEWARFLTEYLDRPAENITDKTRKIHDDHIYDFAFDDGRLKNIYLLDKKNLARNHVQLINQFEQTGTHANRYDVTVLVNGLPLVQIELKKRGVAVREAFNQVHRYSKESFNSGNSLFKFLQIFVISNGTDTRYFANTTKRDKNSFDFTMNWARSDNHPIKDLKDFTATFLQKSVLLSVLLHYSVFDANDTLLIMRPYQIAAAERILWKINSSAQAKNWSGPESGGYVWHTTGSGKTLTGFKAARLATESAFIDKVFFVVDRKDLDYQTMKEYQRFSPDSVNGSESTAGLKRNLEKDGNKIIVTTIQKLNNLMKSEDNLPVYHRQVVFIFDECHRSQFGEAQKNLKKKFKKFCQFGFTGTPIFPENALGAETTAGVFGRELHSYVITDAIRDEKVLKFKVDYNDVRPQFKAVEAEQDEKELSAAENRQALLHPERIREITQYILSRFRQKTHRLNAGGKGFNAMFAVSSVDAAKCYYEAFKTQQAGSLHPLKTATIFSFAANEEQNAVGEIVDETFEPEAMDSSAKEFLQAAINDYNACFKTNFGTDSKAFQNYYRDLAKRVKNREVDLLIVVGMFLTGFDAPTLNTLFVDKNLRYHGLMQAFSRTNRIYDATKTFGNIVCFRDLEQATIDAITLFGDKNTKNVVLEKSYEEYMNGYTDSQTGEARRGYLDVAKELHERFPDPDKIETEKDKKDFAKLFGEYLRAENVLQNYDEFAALRELQNVDAADEDAMKAFQEKYYLSDEDVQEMRKVPMPSERAVQDYRSAYNDIRDWLRRQKAGEQKEQSKIDWDDVVFEVDLLKSQEINLDYILQLVFEHHKKIKGKAELVEEIRRIIRASIGHRAKEGLIVDFINDTDLDKVPDVPAILETFYTYAQEVMRHEAAGLIAAEGLNETAAKRYLTGSLKRGYASENGTELTETLPKMSPLNPQYLTKKQSVFQKIAAFVEKFAGIGADI

SEQ ID NO: 3279 - DNA, 2307 bp, Neisseria gonorrhoeae
ttgtcgaggagatttaatatgcttgcccctgaattggaacagattttgcagcagctttaccgcgaggcgcgtaaggctcattatgaatttatcagcctcgagcatctgcttttggtactcatcgaagaagatgccgccgtgccgaacgtcttaaaactctgcggtgcggatttaaaagcggtgtccgaacagctcgccgccagcgttgccgaaaacacccccctgattcccgaccaccttttagacacggtcgaaacccggcccacgctcggcttccaacgcgtcatccagcgggcgatggtgcatacccaatcggcaggcaaaggcttggccgagcctttggacgttttggtcgcgctgatgagcgaaaccgacagccacgccgtttattttttgggtttgcaatctgttacgcgttttgaagttttgcgctgtattgcccacggctctcccgatgaagatgaagacgatggcaactatttttcagacggcatggacgacgataatgagaaccgcaccaaaccgggcaaaaaccctttatcggcgtacaccgtcaacctcaacgccgaagtcaaagccggccgcatcgaccctttgattggtcgcaaacacgaaatggaacggctggtgcaaatcctgtgccgccgccgcaaaaacaatccgcttttggtcggcgaagcaggcgtgggcaaaaccgcgctggcggacggtttggcacatcaaatcgtcaacgacgacattcccgacgcgctcaaagaggccgaagtgtacgcgctggatatgggttcgcttttggcgggcacaaaataccgcggcgactttgaagcgcgggtcaaatccgtcttgaaacagctcgaaaaaatcccgcacgccattttattcatcgacgaaatccacaccatcatcggcgcgggcagcaccggcggcggcacgatggacgcgtccaacctgctcaaacccgcattggcgaaaggttcattgcgctgtatcggcgcaaccacttacgacgaataccgtactatttttgacaaagaccacgccctaagccgccgcttccagaaaatcgacgtggtcgaacccaccgttgccgaaaccgttcaaatcctgcgcggcttgaaaccgatgttcgaagccttccaccaagtccgctacacgcaaggcgcactcgaagccgccgccgaactctccgcccgctacatcaacgagcgcttcctgcccgacaaagccatcgacgtaatggacgaagcaggcgcggcgcaacggattctgcccaaatccaaacagaaaaaagtcatcggcaaagcgcaaatcgaaaccgtcatcgccaaagtcgcgcggattcccgaaaagaccgtgtcgcacgacgacaaacaagtgttgcaattcctcggccgcgatttgaacaatatggtttacgggcaggaagacgccatcgacgcgctggtttccgccgtcaaaatgtcgcgttcgggcttggggctgcccgacaaaccgataggcagcttcctcttctccggccctaccggcgtcggcaaaaccgaagtcgccaaacagcttgcctactcaatgggcgtaccgctgcaacgctttgatatgtccgaatacatggaacgccacgccgtatcgcgactcatcggcgcgccaccgggctacgtcggctttgaacaaggcggccttttgaccgaagccgtcaacaagcagcctcattgcgtgttgctcttggacgaaatcgaaaaagcccatccagatattttcaacgtcctcctgcaagtcatggacgcaggcaaactgaccgataacaacggtaagagcgccgatttccgcaacgtcatcctgatcatgaccaccaacgcaggcgcagaaagcctcagccgacccagcctaggctttaccgccaaacgcgagcgcggcgacgaaatgcaggcaatcaacaaactcttcacgcccgagttccgcaaccgcttggacgcgatcatcccgtttgcacctttgtccgaacccatcatcgtcaaagtcgtggacaaattcctgctccagctcgaacaccggctcctcgacaaaaaagtcgaagccgaattcacaccggcattgcgtaaatacttggcagaaaaaggtttcgacccgcaaatgggcgcgcgcccgatgcaccgcctgattcaggaaaaaatccgcaaaccgctcgccgacgaactcctgttcggcaaactcgccgacggcggctttgtgcggatagactgggatgcggcgaaagaagaagccgtattgaagtttaagaaaagcaaggtcaaaataaaaaccgcctccgca

SEQ ID NO: 3280 - protein, 769 aa, Neisseria gonorrhoeae
LSRRFNMLAPELEQILQQLYREARKAHYEFISLEHLLLVLIEEDAAVPNVLKLCGADLKAVSEQLAASVAENTPLIPDHLLDTVETRPTLGFQRVIQRAMVHTQSAGKGLAEPLDVLVALMSETDSHAVYFLGLQSVTRFEVLRCIAHGSPDEDEDDGNYFSDGMDDDNENRTKPGKNPLSAYTVNLNAEVKAGRIDPLIGRKHEMERLVQILCRRRKNNPLLVGEAGVGKTALADGLAHQIVNDDIPDALKEAEVYALDMGSLLAGTKYRGDFEARVKSVLKQLEKIPHAILFIDEIHTIIGAGSTGGGTMDASNLLKPALAKGSLRCIGATTYDEYRTIFDKDHALSRRFQKIDVVEPTVAETVQILRGLKPMFEAFHQVRYTQGALEAAAELSARYINERFLPDKAIDVMDEAGAAQRILPKSKQKKVIGKAQIETVIAKVARIPEKTVSHDDKQVLQFLGRDLNNMVYGQEDAIDALVSAVKMSRSGLGLPDKPIGSFLFSGPTGVGKTEVAKQLAYSMGVPLQRFDMSEYMERHAVSRLIGAPPGYVGFEQGGLLTEAVNKQPHCVLLLDEIEKAHPDIFNVLLQVMDAGKLTDNNGKSADFRNVILIMTTNAGAESLSRPSLGFTAKRERGDEMQAINKLFTPEFRNRLDAIIPFAPLSEPIIVKVVDKFLLQLEHRLLDKKVEAEFTPALRKYLAEKGFDPQMGARPMHRLIQEKIRKPLADELLFGKLADGGFVRIDWDAAKEEAVLKFKKSKVKIKTASA

SEQ ID NO: 3281 - DNA, 411 bp, Neisseria gonorrhoeae
ttgttaagacaaaacgtcaagctatgttttcaaaaaagtgggaaaataggcgaaagtaccgaaaatacaacaaaaatgccgtctgaacgcggctttcaaatgggacacgctatgaccgcgcaacaccaatccgacacgcttttgcaccgcctgaacaccctgccgccgaaacgttacggcgtatttttattgaacgacgattacaccacgatggaatttgtcgttgaaatcctgaccgaaatctttatgctcgggcaggaacaggcggtagcggtaatgctctcggttcatcacgaaggcaaaggcctgtgcggcacttacacgcgcgatatcgcccaaaccaaacagcaacaagtcatgcagcgggcaaaagccgaaggacatccgctgcaatgtattgtcgaggagatt

SEQ ID NO: 3282 - protein, 137 aa, Neisseria gonorrhoeae
LLRQNVKLCFQKSGKIGESTENTTKMPSERGFQMGHAMTAQHQSDTLLHRLNTLPPKRYGVFLLNDDYTTMEFVVEILTEIFMLGQEQAVAVMLSVHHEGKGLCGTYTRDIAQTKQQQVMQRAKAEGHPLQCIVEEI

SEQ ID NO: 3283 - DNA, 240 bp, Neisseria gonorrhoeae
ttgctgattttgttaatttttaagtataggaagtttctaatggcaaccggtatcgtaaaatggtttaacgacgctaaaggttttggtttcatcactcctgacgaaggcggcgaagatttgttcgcacacttctcagcgatcaatatggaaggtttcaaaaccctgaaagaaggccaacgcgtctctttcgacgtaaccaccggccctaaaggcaaacaggccgccaacattcaggcagct

SEQ ID NO: 3284 - protein, 80 aa, Neisseria gonorrhoeae
LLILLIFKYRKFLMATGIVKWFNDAKGFGFITPDEGGEDLFAHFSAINMEGFKTLKEGQRVSFDVTTGPKGKQAANIQAA

SEQ ID NO: 3285 - DNA, 237 bp, Neisseria gonorrhoeae
ttgcacatttttttcatcagcactgattttcccttatccgtcaaaatactaagccacttgcccacaacagggtacacacaagttcaggataaggcgggcggggattggggacttttccgccatcggcaaaacggcagacaaaaacggcgggacattgcctgtcccgccgttttcaaatatacatttgaccgtacatcaggaattaagctgcctgaatgttggcggcctgtttgcctt

SEQ ID NO: 3286 - protein, 79 aa, Neisseria gonorrhoeae
LHIFFISTDFPLSVKILSHLPTTGYTQVQDKAGGDWGLFRHRQNGRQKRRDIACPAVFKYTFDRTSGIKLPECWRPVCL

SEQ ID NO: 3287 - DNA, 108 bp, Neisseria gonorrhoeae
atgccgtctgaagacgaaggcggcgcgttttgccccgtgcctgcccgtttgccgttttatgccgcaccgccttttaccggcgacattgcacatttttttcatcagcac

SEQ ID NO: 3288 - protein, 36 aa, Neisseria gonorrhoeae
MPSEDEGGAFCPVPARLPFYAAPPFTGDIAHFFHQH

SEQ ID NO: 3289 - DNA, 312 bp, Neisseria gonorrhoeae
ctgcatcgcaactaccaccccgtgtccttgacgtgccaaaataaaatcacaattatgcgaataaagtttgtataaatttctcctaacctcgtattcattatcaccagatgaataaaaaccaatcctctgaccttcatgatcaaatactgcaacaaaatctaagccgtttccatatctttcaaaaaagactagaaatttagaaaatttccgacaaatctgattaaaaagcgtattgagtgtcgtactcttacctttgttggctgcaccgtatagaataaaaattttagcttccaccattaccaccctccccac

SEQ ID NO: 3290 - protein, 24 aa, Neisseria gonorrhoeae
LHRNYHPVSLTCQNKITIMRIKFV

SEQ ID NO: 3291 - DNA, 1443 bp, Neisseria gonorrhoeae
gtgcggcataaaacggcaaacgggcaggcacggggcaaaacgcgccgccttcgtcttcagacggcatcggcagggcgttcagcttccggcaaccgtcatccccgcaatcagaatcgaaccgattttgttggacgaacgccgcaaagcgtcatccgccacgccgacgatgtcgcggtacatatcctgcaagcgtccggcaacggtaatctcgtggacggggtaggcaatcacgccgttttccacccaaaaacccgccgcgccgcgcgaatagtcgccggtaatggtgttcgcaccctgtcccatcaattcggttaccagcaatcccgtgcccatttctttcagcaggtcggattgcgtttcgtgcgtatggttcaaatacaggttgtgcgcgccgccggcgttgcccgtggtctgcattccgagtttgcgcgcgctgtaactgccgaggaaatagccttcgacaatgccgttttgaatcacgaagcgcggcgcggtggcaacaccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgtgccgacgaggtgtccgatcagcccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcattccgttttcgtcggcggcaacgacgctgcaggaaatgctgtggtgcgtgctttgccggtgtgcggcaaaaccgtgggtgttgccgtaaacgtattggtagtgtccggtttgcaccgccgcgccttcggagttttcgatgcggctgtccgtgtccaacgctgcctgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaagtcggcggtgccggcgcggcctttgcgtttgccgacgtaaacggtaatgtccagcgatttgtcctgctggaactcgatttgttcgatttcgcccaagcgcacgctgacgctttgtccgagcgattcgctgaagtcggcttcggcggcggtcgcgcccgctgcttttgccaagtcgagcgtgcggcggcagaggtcgaggagttcggaagcggtgtggttgaacagcataacaatctttcttggtggagcgttgtggcattt

SEQ ID NO: 3292 - protein, 481 aa, Neisseria gonorrhoeae
VRHKTANGQARGKTRRLRLQTASAGRSASGNRHPRNQNRTDFVGRTPQSVIRHADDVAVHILQASGNGNLVDGVGNHAVFHPKTRRAARIVAGNGVRTLSHQFGYQQSRAHFFQQVGLRFVRMVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGNDAAGNAVVRALPVCGKTVGVAVNVLVVSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 3293 - DNA, 1329 bp, Neisseria gonorrhoeae
atgctgttcaaccacaccgcttccgaactcctcgacctctgccgccgcacgctcgacttggcaaaagcagcgggcgcgaccgccgccgaagccgacttcagcgaatcgctcggacaaagcgtcagcgtgcgcttgggcgaaatcgaacaaatcgagttccagcaggacaaatcgctggacattaccgtttacgtcggcaaacgcaaaggccgcgccggcaccgccgacttctccgaacaagccctgcgcgacaccgtccgcgccgccgccgacatcgcccgccacaccgccgaagacggttgcgccggacttgccgaccccgagttgatggcgcaacacatcggcgaccccgacctttaccacgaatgggatttggatacggaagccgccgtcggcttggcaaaacaatgcgaacaggcagcgttggacacggacagccgcatcgaaaactccgaaggcgcggcggtgcaaaccggacactaccaatacgtttacggcaacacccacggttttgccgcacaccggcaaagcacgcaccacagcatttcctgcagcgtcgttgccgccgacgaaaacggaatgcagcgcgactactggtacgattccgcctgccgccatccggatatggacagccccgaaaccatcggtcaaaccgccgcccgccgcactttgcgccgactcggcagccgcagcatcccgacaggcagctaccccgtcctcttcgataccaccgtttcgggcgggctgatcggacacctcgtcggcacactctccggcggcgcgctctaccgccaaagcagtttcctgatcgacagcatcggcaaaaaagtcctgcccgatttcctcaacctgcgcgaagaaccgcacatcccccgctctttccgcagcagctattttgatgcggaaggtgttgccaccgcgccgcgcttcgtgattcaaaacggcattgtcgaaggctatttcctcggcagttacagcgcgcgcaaactcggaatgcagaccacgggcaacgccggcggcgcgcacaacctgtatttgaaccatacgcacgaaacgcaatccgacctgctgaaagaaatgggcacgggattgctggtaaccgaattgatgggacagggtgcgaacaccattaccggcgactattcgcgcggcgcggcgggtttttgggtggaaaacggcgtgattgcctaccccgtccacgagattaccgttgccggacgcttgcaggatatgtaccgcgacatcgtcggcgtggcggatgacgctttgcggcgttcgtccaacaaaatcggttcgattctgattgcggggatgacggttgccggaagc

SEQ ID NO: 3294 - protein, 443 aa, Neisseria gonorrhoeae
MLFNHTASELLDLCRRTLDLAKAAGATAAEADFSESLGQSVSVRLGEIEQIEFQQDKSLDITVYVGKRKGRAGTADFSEQALRDTVRAAADIARHTAEDGCAGLADPELMAQHIGDPDLYHEWDLDTEAAVGLAKQCEQAALDTDSRIENSEGAAVQTGHYQYVYGNTHGFAAHRQSTHHSISCSVVAADENGMQRDYWYDSACRHPDMDSPETIGQTAARRTLRRLGSRSIPTGSYPVLFDTTVSGGLIGHLVGTLSGGALYRQSSFLIDSIGKKVLPDFLNLREEPHIPRSFRSSYFDAEGVATAPRFVIQNGIVEGYFLGSYSARKLGMQTTGNAGGAHNLYLNHTHETQSDLLKEMGTGLLVTELMGQGANTITGDYSRGAAGFWVENGVIAYPVHEITVAGRLQDMYRDIVGVADDALRRSSNKIGSILIAGMTVAGS

SEQ ID NO: 3295 - DNA, 588 bp, Neisseria gonorrhoeae
ttgcagggcgtgcggtgcaaaaagccgtctgaacgcggcggcattctgttaaaatacgctattggaaaaaattcgagaatcaagatgtttgaacaagaagacgagtggatcagcaaaacccaaatgaaaaagcagatgaacggtttgcaggatttgggtatggaactgaccaggctctcaaacgacacgctgaaaaaaatcggtttggatgaagatttgtacgaggccgtcgttacctataaaaaaattacgtccaacggcgcgctcaaacgtcaggcgcaatttatcggacgtctgatgcgcgataccgatcccgcgcccatcgaggcgttccttgccaagctgcgcggcgacgatgcggcgcacaacgcctttttgcaacgcgtggaacaggcgcgtgtacggttgttggcagacgagggcgcgctgacgcagtttatgtccgattttccaaacgccggcgcgggcaggctgaggacgctcgtccgcaacaccaaaaaagaacaggaacaggacaaaccgccgaaaaacttccgcgccctgtttcaagaattgaaaaccgtgatggaaaacgggggcgcggaaatt

SEQ ID NO: 3296 - protein, 196 aa, Neisseria gonorrhoeae
LQGVRCKKPSERGGILLKYAIGKNSRIKMFEQEDEWISKTQMKKQMNGLQDLGMELTRLSNDTLKKIGLDEDLYEAVVTYKKITSNGALKRQAQFIGRLMRDTDPAPIEAFLAKLRGDDAAHNAFLQRVEQARVRLLADEGALTQFMSDFPNAGAGRLRTLVRNTKKEQEQDKPPKNFRALFQELKTVMENGGAEI

SEQ ID NO: 3297 - DNA, 732 bp, Neisseria gonorrhoeae
ttgtccaacccggccttcaaaaggcccgtcagcttcgccgaatcttcgggattgacggcgaaccagtatttcccgcccatcatcaccaggctgcccttttccaattgggcattgtcttcggcaaccacaccgaaggcgcggatttggtctttgtcaacgtgtttgcgggtgattgtttggctgaccgggttgttcatcccccgcaacatcatcgtacagccgttcagtatcaaggttgccgccaaaacggcggcggtcgttttacggaacaacattttatcttccaatctaaataacggcggatgccgtctgaaaatatgcctaaatttccgcgcccccgttttccatcacggttttcaattcttgaaacagggcgcggaagtttttcggcggtttgtcctgttcctgttcttttttggtgttgcggacgagcgtcctcagcctgcccgcgccggcgtttggaaaatcggacataaactgcgtcagcgcgccctcgtctgccaacaaccgtacacgcgcctgttccacgcgttgcaaaaaggcgttgtgcgccgcatcgtcgccgcgcagcttggcaaggaacgcctcgatgggcgcgggatcggtatcgcgcatcagacgtccgataaattgcgcctgacgtttgagcgcgccgttggacgtaatttttttataggtaacgacggcctcgtacaaatcttcatccaaaccgatttttttcagcgtgtcgtt

SEQ ID NO: 3298 - protein, 244 aa, Neisseria gonorrhoeae
LSNPAFKRPVSFAESSGLTANQYFPPIITRLPFSNWALSSATTPKARIWSLSTCLRVIVWLTGLFIPRNIIVQPFSIKVAAKTAAVVLRNNILSSNLNNGGCRLKICLNFRAPVFHHGFQFLKQGAEVFRRFVLFLFFFGVADERPQPARAGVWKIGHKLRQRALVCQQPYTRLFHALQKGVVRRIVAAQLGKERLDGRGIGIAHQTSDKLRLTFERAVGRNFFIGNDGLVQIFIQTDFFQRVV

SEQ ID NO: 3299 - DNA, 723 bp, Neisseria gonorrhoeae
ttggaagataaaatgttgttccgtaaaacgaccgccgccgttttggcggcaaccttgatactgaacggctgtacgatgatgttgcgggggatgaacaacccggtcagccaaacaatcacccgcaaacacgttgacaaagaccaaatccgcgccttcggtgtggttgccgaagacaatgcccaattggaaaagggcagcctggtgatgatgggcgggaaatactggttcgccgtcaatcccgaagattcggcgaagctgacgggccttttgaaggccgggttggacaagcccttccaaatagttgaggataccccgagctatgcccgccaccaagccctgccggtcaaattcgaagcgcccggcagccagaatttcagtaccggaggtctttgcctgcgctatgataccggcagacctgacgacatcgccaagctgaaacagcttgagtttaaagcggtcaaactcgacaatcggaccatttacacgcgctgcgtatccgccaaaggcaaatactacgccacgccgcaaaaactgaacgccgattatcattttgagcaaagtgtgcccgccgatatttattatacggttactgaaaaacataccgacaaatccaagctgtttggaaatatcttatatacgccccccttgttgatattggatgcggcggccgcggtgctggtcttgcctatggctctgattgcagccgcgaattcctcagacaaa

SEQ ID NO: 3300 - protein, 241 aa, Neisseria gonorrhoeae
LEDKMLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 3301 - DNA, 1698 bp, Neisseria gonorrhoeae
atgtcagtcaaaatccaaacccgccccgtcaataccgacgttttcaatcatttgctcgccgccggcgccgatcctttaatcgcccggctttgtgcctcgcgcggtgtgcaaagtcctgccgagttggacgacaaactcgcttccctcctgccttatcaatcgctgacgaattgcgaagccgccgccggccgtttggcggatgcggttgaacgcaaggaaaaaatcctgattgtcgccgactatgatgccgacggcgcgaccgcgtgtgccgtcggtttggacggtttggcggcgatgggcgcgaaagtggatttcctcgtgcccaaccgctttgagcacggctacggcttaacgcccgaactcgccgaaatcgccgccgcgcaaggcgtggatttgctgattacggtggataacggcattgccagtattgcaggcgtggcgcgcgcgcaggctctgggtttggatgtcatcgttaccgaccaccatttgccagccgataccgtacccgactgcatcatcgtcaatccgaaccaaaaaggctgcggttttccaagcaaaagcttggcgggcgtgggcgtgattttttatgtgttgacggcgttgcgtgccgaactgcgccgccgcaattatttttcagacggcatcaaagagccgaatctgggcggccttttggatttggtcgcactcggtaccgtcgccgatgtcgtccccctcgaccacaacaaccgcatcctcgtgtcgcaaggtttgaaacggatgcgttcgggcaaaatgcgccccggcatccgcgccttgtttgaagtggcgcggcgcgattggcgcaaggctcagccgtttgatatgggctttgcgttgggcccgcgcatcaacgccgccggacggctggacgatatgtcggtcggcatcgcctgcctgttggcgcgagatgattccgaagcgcaggaactggcggctcggttaaacaacctcaatatcgaacgccgcgaaatcgagcagtctatgctgcgagacgcgttgaacgcctttcccgaaaccctgccttcaggtcagacgactttggtggcgtatcgcgacgacttccatcaaggcgtggtcggcattgttgccagccgcctcaaagaccgtttttaccgtccgaccatcgtgtttgcgccggcggacaacggcgaagtgcgcggttcgggacgctccattcccaatctgcacttgcgcgatgctttggacttggtgtccaaacgccatcccgatttgattttgaaattcggcggacacgcgatggcggcgggtttaagcatacttgaacacaatattcccgcgtttcagacggcctttgaagaagccgtgcgtgagatggtgtgcgaagacgatttgtcgcaaacctatattactgacggcagcctgcccgcctgcgacatcacgttggaacaggcgcaaaacctcgcctgccacgtttgggggcagggctttgcgccgccgagctttaccgacgagttccacgtcgttcgccagcagcctttgggcgcggaaggcaaacacaaaaaagcgtggttgcaaaaagacggctgcgaatttgaagcgatgttctggcgttgcagcgaagacattcccgaatacatccgcacggtgtaccgccccgttgccaacgaatggcgcaacaacctcgaattgcagctttatatcgactactgggaagcggcg

SEQ ID NO: 3302 - protein, 566 aa, Neisseria gonorrhoeae
MSVKIQTRPVNTDVFNHLLAAGADPLIARLCASRGVQSPAELDDKLASLLPYQSLTNCEAAAGRLADAVERKEKILIVADYDADGATACAVGLDGLAAMGAKVDFLVPNRFEHGYGLTPELAEIAAAQGVDLLITVDNGIASIAGVARAQALGLDVIVTDHHLPADTVPDCIIVNPNQKGCGFPSKSLAGVGVIFYVLTALRAELRRRNYFSDGIKEPNLGGLLDLVALGTVADVVPLDHNNRILVSQGLKRMRSGKMRPGIRALFEVARRDWRKAQPFDMGFALGPRINAAGRLDDMSVGIACLLARDDSEAQELAARLNNLNIERREIEQSMLRDALNAFPETLPSGQTTLVAYRDDFHQGVVGIVASRLKDRFYRPTIVFAPADNGEVRGSGRSIPNLHLRDALDLVSKRHPDLILKFGGHAMAAGLSILEHNIPAFQTAFEEAVREMVCEDDLSQTYITDGSLPACDITLEQAQNLACHVWGQGFAPPSFTDEFHVVRQQPLGAEGKHKKAWLQKDGCEFEAMFWRCSEDIPEYIRTVYRPVANEWRNNLELQLYIDYWEAA

SEQ ID NO: 3303 - DNA, 195 bp, Neisseria gonorrhoeae
gtgttcagactgcatcaggcggtacgattccacaagatgccgaaaaccataagcaaaaggcgtagaaactacgccgtccgaatcacgccgccctcgcggcggcaacgcgtcattataacagattgccccttaaaaaatcagaccctgcttttgtggcggagtctgaaatttgatgcaccttatatattgcgtccc

SEQ ID NO: 3304 - protein, 65 aa, Neisseria gonorrhoeae
VFRLHQAVRFHKMPKTISKRRRNYAVRITPPSRRQRVIITDCPLKNQTLLLWRSLKFDAPYILRP

SEQ ID NO: 3305 - DNA, 1299 bp, Neisseria gonorrhoeae
ccaccctccccacttatgctctttcatcggcccgccgtgttcgatgtaatgcgcaaactcatcacggaaatgcttggtaaagctgcggacagggaagacggcggcatcggcaagggcgcagatggtgcggcctgccatttggttgccgacagaatccagcaaatccaagtcttccatgcggcctttgccttctacgatgcggcggacgatgcggtaaagccagccggtaccttcgcggcagggggtgcattggccgcaggattcgtcgtagtagaaatagcttaagcgttcgagggctttgaccatgcacacgtcttcgtccatcacgataatcgcgccggaaccgagcatcgagccggctttggaaatcgagtcatagtccatattggtctgcatcataatgtcggcaggcaatacgggggcggacgaaccgccgggaataacggctttgagttttttaccgccgcgcataccgcccgccattttcaagacttcggcaaacggcgtgcccaacggcacttcatagttgcccggacgctcgacatggccggaaatacaaaataatttggtaccgcctgcattcggaatacctttatcggcaaacgcctgtccgccgtcacggataataaacgggacggaggagaacgtttcggtattgttgatggtggtcggtttgccgtacaggccgaacgaggcggggaacggcggtttgaagcgcggctggccttttttgccttccaacgattcaagcaatgcggtttcttcgccgcaaatatatgcgccgtagccgtggtgggcgaagagttcgaattcaaaatccgaacccaaaatatttttacccaaaaagcctgcggcacgcgcctgctccaaagcggcttcaaagcgttgataaccttcgaaaatttcgccgtggatatagttgtagccggctttcgcgcccatcgcgtaaccggcaatgatcatgccttcaatcagggcatgaggattgaacatgatgatgtcgcggtctttaaatgtacccggctcgccttcgtcggtgttgcaaaccacatatttttcgcccgggaaagaacggggcataaagctccatttcaaaccggtcgggaagcccgcaccgccgcgcccgcgcaagccggaggttttgacttcgtcaatcacatcggtttgcgagatgttttcggacaggattttacgcagggcggtatagccgccgcgtttgacgtattcgtccaatgtccagcaatcgggattggcggtatccacttggtcaaaaatcacgcctgattggtaaatagccat

SEQ ID NO: 3306 - protein, 94 aa, Neisseria gonorrhoeae
PPSPLMLFHRPAVFDVMRKLITEMLGKAADREDGGIGKGADGAACHLVADRIQQIQVFHAAFAFYDAADDAVKPAGTFAAGGALAAGFVVVEIA

SEQ ID NO: 3307 - DNA, 708 bp, Neisseria gonorrhoeae
ttgcggcagcttggatgtttgattggttttttcagtgttggaatcattatgaatttgaaattagtgtttgaatcgggcgatcccgtcctgatcggtgtgtttgtgttgatgctgttgatgagtaccgtaacgtggtgtctggttgtcttgcgctgcatcaagctgtatcgggcgcgcaaagggaatgccgccgtcaaacggcatatgcgcgatactttgtcgctgaacgacgcggtcgaaaaagtgcgcgccgtcgatgcgcctttgtccaaactggcgcaagaggcattgcagtcttaccgcaactaccgccgaaacgaagcgtccgaactggcgcaggctttgccgttgaacgagtatttggtcattcaaatccgcaacagtatggcgcagattatgcgccggtttgattacgggatgaccgcgcttgcctccatcggcgcgaccgcgccgtttatcgggttgttcggcacggtttgggggatttaccacgccctgatcaatatcgggcaaagcgggcagatgagtattgcggcggttgccggcccgattggcgaggcactggtggcgacggcggcgggtttgttcgtggcgattccggcggtgttggcatacaacttcctcaatcgcggcacaaaaatactgacccaggatttggatgcgatggcgcacgatttgcatgtccgcctgcttaatcaaaaggatagc

SEQ ID NO: 3308 - protein, 236 aa, Neisseria gonorrhoeae
LRQLGCLIGFFSVGIIMNLKLVFESGDPVLIGVFVLMLLMSTVTWCLVVLRCIKLYRARKGNAAVKRHMRDTLSLNDAVEKVRAVDAPLSKLAQEALQSYRNYRRNEASELAQALPLNEYLVIQIRNSMAQIMRRFDYGMTALASIGATAPFIGLFGTVWGIYHALINIGQSGQMSIAAVAGPIGEALVATAAGLFVAIPAVLAYNFLNRGTKILTQDLDAMAHDLHVRLLNQKDS

SEQ ID NO: 3309 - DNA, 996 bp, Neisseria gonorrhoeae; identical to SEQ ID NO: 127

SEQ ID NO: 3310 - protein, 332 aa, Neisseria gonorrhoeae; identical to SEQ ID NO: 128

SEQ ID NO: 3311 - DNA, 1356 bp, Neisseria gonorrhoeae
atgctgaaaaaatggttgaataagatgctgccttccggtcggagcagtaaaaaagcggaaagtaaaacggtcattcctgccgaaagacacaacatcagtgccgaaatgttgagctttgccgccgaaaacgtcatacgccgcctgaaaggggcggggtttcaggcttatgtggtcggcggtgcggtcagagacctgctgctcggcatcgaacccaaagatttcgatgtcgcaactgatgccacgcccgaacaggtgcacaaactcttccgccgcagccgcatcatcggcaggcgttttcagattgtccatgtgatgaacggtgcggagattatcgaagtaacgacgtttcgcggcggtgcgaaggttcatcagaacgcgcacggcagaatcatgaaggacaacacctacggcagcatcgaagaagatgcgatgcggcgcgattttacctgcaatgccttgtattacgatcctgaaaaagaagagattttggatttccacaacgggattgccgatgttgccgcccgcaggctggttatgattggtaatgccgccgaacgctatcaggaagaccctgtcaggattttgcgcgccatccgcctgtcgggcaaattgggctttgagctgtcggaagaaaccgccgcaccgattgccgaatcgatatgccgtctgaagcacgaacctgtggcaaggctgttcgacgaaatcatgaaactgctgttttcagggcacgcgcgcgagtgtctgaaacgtttgaacggatttgacataccggacatccatccgctgctcaatgctttgcgcgtttcagacggcatcgccggaaaaatgacggcgcttgccctgaaaaataccgatgagcggctgcgtgccgacaaatcggtttcggtcggtttcgtactggcggccctgatgtggccagagttggaccgccattggaaaagcaatctgcaacagggtttgaaacctacgcccgccctgtccgatgcaatcaatacgatgcgcgaaaccgtcgaacgcggttggggcgtaccgcaacgcttttccgccacgatgcgtgaaatttggatgttccagccgcagtttgaaaaccgcaaaggcgcacgtccgcacaaactgtttgcacaggcgcgtttccgtgccgcctatgatttcctgctcttgcgcgccgaaaccggcaatgcggaccgcgcacttgccgagtggtggacggcgtttcagacggcatcggcggaacagcggacggaaatgaccaaaaacgaggccgccgcccggcacgaaaaaaacgaaggacaggcgaaaaaacgccgccgtcgcaggcgcaaacccaagccgaaggttgtgggaacggattgggaa

SEQ ID NO: 3312 - protein, 452 aa, Neisseria gonorrhoeae
MLKKWLNKMLPSGRSSKKAESKTVIPAERHNISAEMLSFAAENVIRRLKGAGFQAYVVGGAVRDLLLGIEPKDFDVATDATPEQVHKLFRRSRIIGRRFQIVHVMNGAEIIEVTTFRGGAKVHQNAHGRIMKDNTYGSIEEDAMRRDFTCNALYYDPEKEEILDFHNGIADVAARRLVMIGNAAERYQEDPVRILRAIRLSGKLGFELSEETAAPIAESICRLKHEPVARLFDEIMKLLFSGHARECLKRLNGFDIPDIHPLLNALRVSDGIAGKMTALALKNTDERLRADKSVSVGFVLAALMWPELDRHWKSNLQQGLKPTPALSDAINTMRETVERGWGVPQRFSATMREIWMFQPQFENRKGARPHKLFAQARFRAAYDFLLLRAETGNADRALAEWWTAFQTASAEQRTEMTKNEAAARHEKNEGQAKKRRRRRRKPKPKVVGTDWE

SEQ ID NO: 3313 - DNA, 234 bp, Neisseria gonorrhoeae
atgccgtctgaaacgccgtccaccactcggcaagtgcgcggtccgcattgccggtttcggcgcgcaagagcaggaaatcataggcggcacggaaacgcgcctgtgcaaacagtttgtgcggacgtgcgcctttgcggttttcaaactgcggctggaacatccaaatttcacgcatcgtggcggaaaagcgttgcggtacgccccaaccgcgttcgacggtttcgcgcatcgtat

SEQ ID NO: 3314 - protein, 78 aa, Neisseria gonorrhoeae
MPSETPSTTRQVRGPHCRFRRARAGNHRRHGNAPVQTVCADVRLCGFQTAAGTSKFHASWRKSVAVRPNRVRRFRASY

SEQ ID NO: 3315 - DNA, 132 bp, Neisseria gonorrhoeae
atgcccaaaatacattttttcatcaatttttccttgttgcttgaaccctgcccacccggacatcctttttccgggcggcagggtcagactttatttgcagggatgaagccccttacaaatcagaataataca

SEQ ID NO: 3316 - protein, 44 aa, Neisseria gonorrhoeae
MPKIHFFINFSLLLEPCPPGHPFSGRQGQTLFAGMKPLTNQNNT

SEQ ID NO: 3317 - DNA, 321 bp, Neisseria gonorrhoeae
atgaaaaaatgtattttgggcattttgaccgcgtgtgccgccatgcctgcatttgccgacagaatcagcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcggagatgaggcaatccgatgcagaaaattcgat

SEQ ID NO: 3318 - protein, 107 aa, Neisseria gonorrhoeae
MKKCILGILTACAAMPAFADRISDLEARLAQLEHRVAVLESGGNTVKIDLFGSNSTMYVCSVTPFQKTFEASDRNEGVARQKVRQACNRETSAMFCGDEAIRCRKFD

SEQ ID NO: 3319 - DNA, 951 bp, Neisseria gonorrhoeae
atgacccataccgtccacctgcacttggaagaaaccgacaacccgacgctgcaacgcctgtgcggttctttcgacagcaacctcgattcgctcgccaaagcactcgacatccatatcagccgccgtttcgagcattttaccttcaacggtgcatttgcacacgccggcaaacgcgcactgctcaaactcttggaaacggcgcagacgcgcgacctaaacgacagcatcatccgccttgccgccgtcgaaacccaaaccgaagatgccgggcatcaggaaaaaaatcacgaacacgcctattatttccgaaccaagcgcggcagcataggcggcagaacgccacggcagaacggctatatccgcgccctgctcgaccacgacatcgtattcggcctcgggccggcaggtacgggcaaaacctatcttgccgtcgccgccgccgtcgatgcgatggaaaaacaccaagtcgaacgcatcattttagttcggcctgccgtcgaagccggtgagaaactgggcttcctgcccggagacctgacccaaaaagtcgacccctacctccgtccgctttatgatgccctctatgacctgatgggctttgaccgtgtaaccaagctgattgaaaaaggcctgattgaaatcgccccgctcgcctatatgcgcggcaggacgctcaacggcgcatacatcatcctcgacgaagcgcaaaacaccacgcccgaacaaatgaaaatgttcctgacccgcatcggcttcggcgcgaaagccgtcattaccggcgacaccagccaaatcgacctgcccaaaaacatcaaatcgggattgaaagacgcacgtgagaaactgcacggcgtggcaggactgtatttccataccttcaccggcgaagacgttgtccggcatcctctggtgcaaaaaatcgtcgaagcctacgaatcggcagaacacgac

SEQ ID NO: 3320 - protein, 317 aa, Neisseria gonorrhoeae
MTHTVHLHLEETDNPTLQRLCGSFDSNLDSLAKALDIHISRRFEHFTFNGAFAHAGKRALLKLLETAQTRDLNDSIIRLAAVETQTEDAGHQEKNHEHAYYFRTKRGSIGGRTPRQNGYIRALLDHDIVFGLGPAGTGKTYLAVAAAVDAMEKHQVERIILVRPAVEAGEKLGFLPGDLTQKVDPYLRPLYDALYDLMGFDRVTKLIEKGLIEIAPLAYMRGRTLNGAYIILDEAQNTTPEQMKMFLTRIGFGAKAVITGDTSQIDLPKNIKSGLKDAREKLHGVAGLYFHTFTGEDVVRHPLVQKIVEAYESAEHD

SEQ ID NO: 3321 - DNA, 165 bp, Neisseria gonorrhoeae
ttgttggatctcgaccacttgcttgtctgccgtcattcccgcgcaggcgggaatccatcctcaatggtaagcaatgtcttattaaattcagaaaccgaatcttaccggtggattcccgcctgcgcgggaatgacggcatttcagtatttcagtagggcggattct

SEQ ID NO: 3322 - protein, 55 aa, Neisseria gonorrhoeae
LLDLDHLLVCRHSRAGGNPSSMVSNVLLNSETESYRWIPACAGMTAFQYFSRADS

SEQ ID NO: 3323 - DNA, 483 bp, Neisseria gonorrhoeae
ttggcacaatgcccgcaactgcgcctgaacatcggcggcagcggacaggaagaacagcggctgaaacagcaggcggcagacttgggcatcgcccatgccgttacatttttaggcgcactgcaacccgaagcaatcttggatttgatgaggaacagcgacgccttcatcctcgccagccgcaccgaaaccttcggcgtggtctatatcgaagccctctcgcaagggttgcccgtcatcgccatacattgcggcggcgcggaatccatcgtttcagacggcaacggatacctcgtttccgttgacgatgccgatgtcctagcccttctcaaaatatatgaacaccatgccgatttttccgccgaacagctcagaaccgactgcctcgcaacattcggcgaagatgccgttatcggcagactgattgccgtattccgtcaggcggcgcggaacacggcgcgaaaacgcccgaaaaatagattaaaa

SEQ ID NO: 3324 - protein, 161 aa, Neisseria gonorrhoeae
LAQCPQLRLNIGGSGQEEQRLKQQAADLGIAHAVTFLGALQPEAILDLMRNSDAFILASRTETFGVVYIEALSQGLPVIAIHCGGAESIVSDGNGYLVSVDDADVLALLKIYEHHADFSAEQLRTDCLATFGEDAVIGRLIAVFRQAARNTARKRPKNRLK

SEQ ID NO: 3325 - DNA, 300 bp, Neisseria gonorrhoeae
atgtccgaaccgttgcacgtcctcgtcatccccttatggtatccacgatccgaacaggatgtggacggaatatttttccaaaatcaagcacagaccctccaacgcaaaggcatcaaaaccgccatcctcgcccccatgttccgttatctgcggaaagaaacagcaagcatcctgaccggtccttacggttttgcccgataccggcaaagcggtttggacatctacgcatggcgcagcatgtatttcttccccgctttccgtttatcgacatcgaccgcatccgctgggtgcgcgccggtt

SEQ ID NO: 3326 - protein, 100 aa, Neisseria gonorrhoeae
MSEPLHVLVIPLWYPRSEQDVDGIFFQNQAQTLQRKGIKTAILAPMFRYLRKETASILTGPYGFARYRQSGLDIYAWRSMYFFPAFRLSTSTASAGCAPV

SEQ ID NO: 3327 - DNA, 333 bp, Neisseria gonorrhoeae
gtgcgcgccggtttgaaagccttcaaacactacatccgcgaaaacggactgcccgacctgattcacgcccactgcatgaactatgcaggcatacttgcccaaaaaatttccgaaaaatacggcattccctacgttttaaccgaacacagcagcaccatcacgcgcggtctgatccgtcaccaccaatggcagccgatggaaaaagcagcggcgcccgcctccgcacgtctcgccgtcagccgccatttcgcacacgtcctgcaacacaaatacggctgcgaatggcagtacctccccaacataccgggtggaatattcaagcaaacatttgaa

SEQ ID NO: 3328 - protein, 111 aa, Neisseria gonorrhoeae
VRAGLKAFKHYIRENGLPDLIHAHCMNYAGILAQKISEKYGIPYVLTEHSSTITRGLIRHHQWQPMEKAAAPASARLAVSRHFAHVLQHKYGCEWQYLPNIPGGIFKQTFE

SEQ ID NO: 3329 - DNA, 732 bp, Neisseria gonorrhoeae
ttggcggtttttcaagtaaggatacggatatgctgcgttctattttggcggcttccctgctggcggtatcttttcccggcggcggctgaggcattgaattacaatattgtcgaattttccgaatcggcgggtatcgaggtggctcaggatacaatgtccgcgcgtttccaggtggcggcggaaggacgggacaaaaatgccgtcaatgccgagtttgttaaaaaattcaacaatttcaccagaaaatcgaaaaatggtagctttaaaaccgaattggtatcgcgcagtgcgatgccgcgctatcaatataccaacggcagacgcattcaaacaggctgggaggagcgtgcggaatttaaggcggagggcagggattttgatgctttaaaccgttttattgctgatgttcagacggatgcttcgcttgaagataccgatttcagcgtgtcgcgcgaacgccgaaacgaggtcatcgatcaggtcagcaaggatgccgttttgcgtttcaaggcgcgtgccgaaaaactggcgggcgttctgggtgcgtccggttataaaatcgtcaaattgaattttgggcaaatcggcagccatattgcgggcgatggggctgttcgggcaaaaatgctgcgcgcgatgccgatggcggcaagcgtcaatatgaagggtacggattcagccgcaccgggtgtggaggaaatcagcatcagcatcaatgggacggttcagttc

SEQ ID NO: 3330 - protein, 244 aa, Neisseria gonorrhoeae
LAVFQVRIRICCVLFWRLPCWRYLFPAAAEALNYNIVEFSESAGIEVAQDTMSARFQVAAEGRDKNAVNAEFVKKFNNFTRKSKNGSFKTELVSRSAMPRYQYTNGRRIQTGWEERAEFKAEGRDFDALNRFIADVQTDASLEDTDFSVSRERRNEVIDQVSKDAVLRFKARAEKLAGVLGASGYKIVKLNFGQIGSHIAGDGAVRAKMLRAMPMAASVNMKGTDSAAPGVEEISISINGTVQF

SEQ ID NO: 3331 - DNA, 564 bp, Neisseria gonorrhoeae
atgagcatcaagtccgacaaatggatacgccgaatgagcgaagaattcggcatgattgatcccttcgagccgaaccaaatcaaagaagccgacggacagcgcatcatctcctacggtacgtccagctacggctacgatatccgctgcgccaatgaatttaaaatttttaccaacatcaacagcaccatcgtcgatcccaaaaacttcgacccgaaaaatttcgttaccgtcgaagacgactgctgcatcatcccgcccaattccttcgcactggcgcgcacggtcgaatatttccgcattccgcgcaacgtcctgaccgtctgtttgggcaaatccacctacgcccgctgcggcatcatcgtcaacgttaccccgttcgagccggaatgggaaggctacgttaccctcgagttttccaacaccacccccctgcccgccaaaatctacgcaggcgaaggcgtggcgcaagtcctcttcttcgagagcgacgaagtgtgtgaaacttcatacaaagaccgcaacggcaaatacatgggacaaaccggcgtaaccctgcccaaagcc

SEQ ID NO: 3332 - protein, 188 aa, Neisseria gonorrhoeae
MSIKSDKWIRRMSEEFGMIDPFEPNQIKEADGQRIISYGTSSYGYDIRCANEFKIFTNINSTIVDPKNFDPKNFVTVEDDCCIIPPNSFALARTVEYFRIPRNVLTVCLGKSTYARCGIIVNVTPFEPEWEGYVTLEFSNTTPLPAKIYAGEGVAQVLFFESDEVCETSYKDRNGKYMGQTGVTLPKA

SEQ ID NO: 3333 - DNA, 471 bp, Neisseria gonorrhoeae
ctccaactccgccagtttcttctcaatcgcctcttcggtcataaagctgcacatgctgtggttgttgaccagcataacgggggcatcgccgcacgcgcccatgcattcgccttcgacaagggtaaatttgccgtcgggcgtggtttcgccgtagccgataccgagtttttgtttgaggtattcgccggtcgccataccgccgcgcagagcgcagggcaggttggtacaaacggtcagtttgtatttgccgacaggctcaaggtcgtacatattgtagaaagtggcgacttcatatgcctgcgccggcgtgatgccgatgtagtcggcaacaaaagcgatggtttcgggggcgagccagcctttttcggtttgggcgatacgcaacgcgcccatgatggcggaacggcgttggtcggcgggatatttcgccaactcaatgtcgatttgttttaaggattttgcggataacat

SEQ ID NO: 3334 - protein, 150 aa, Neisseria gonorrhoeae
LQLRQFLLNRLFGHKAAHAVVVDQHNGGIAARAHAFAFDKGKFAVGRGFAVADTEFLFEVFAGRHTAAQSAGQVGTNGQFVFADRLKVVHIVESGDFICLRRRDADVVGNKSDGFGGEPAFFGLGDTQRAHDGGTALVGGIFRQLNVDLF

SEQ ID NO: 3335 - DNA, 849 bp, Neisseria gonorrhoeae
atggataaagaacgaattttaacccccgcagtcgtgttttccgtcgcactgctgcatttggcaatagtggcattgctctggcaggcgcacaagctgcccgtgatagagtcaggaaatgttatcgaatttgtcgatttgggcgattttggcggagggggcggcgcacccgaaggcgcaggcgcgcctgccgcgcccgaaccgcaacccgcgcccgatccgcccaaacctgtcgaaccgcccaagccggttttgaagccggcggttacaaaaaaggcggatgcggatattcagcaacctaaggaaaagccgaaacccgaagaaaaacctaagcccgaacccgaaccggaagcgaagcctgccccgaaaccggcggaaaaaccggcagagaagccgtctgaaaaacctgccgaacattccggtaatgcttctgccaaagccggcagcgagcagggtaatggggaaggtaagggaaccggtaccaaaggcgacggaacggggcgcggagaaggcagcggtaaaggaagcggcggtgccaaaggcgaacacggggaaggagccggcggcagcggcggcggaaccggtgtcggcagcagcaaaggcaatcctttacgcgccaacggcagcatcccgcgcccggcctatcccgcactttctatggaaaatgacgagcagggtatggttgttttgagcgttttggtttctccgggcggtcatgtcgagtccgtcaaagtggtgaaaagcagcggtttttcccgtttggacaatgcggcacgcaaagcggcgcaaaacgggcattttcaagccaatgcctggacggagtttaaagtccccgtcaagtttgaattgaat

SEQ ID NO: 3336 - protein, 283 aa, Neisseria gonorrhoeae
MDKERILTPAVVFSVALLHLAIVALLWQAHKLPVIESGNVIEFVDLGDFGGGGGAPEGAGAPAAPEPQPAPDPPKPVEPPKPVLKPAVTKKADADIQQPKEKPKPEEKPKPEPEPEAKPAPKPAEKPAEKPSEKPAEHSGNASAKAGSEQGNGEGKGTGTKGDGTGRGEGSGKGSGGAKGEHGEGAGGSGGGTGVGSSKGNPLRANGSIPRPAYPALSMENDEQGMVVLSVLVSPGGHVESVKVVKSSGFSRLDNAARKAAQNGHFQANAWTEFKVPVKFELN

SEQ ID NO: 3337 - DNA, 228 bp, Neisseria gonorrhoeae
atgattttaaatcgagtaaaatgtatctacgattattttcaacaagggggaagaatgaacccaaccaaacaatccaaaaaaagctacgaatctaagcgcgttttaaagcacgtttcatttaacactgaaaaagaagctaatttattggaattttccaataatttagacttctccaaatgggtaaaagaaaagctgaaacatgaacttgaattagaaaaactgaaaaaa

SEQ ID NO: 3338 - protein, 76 aa, Neisseria gonorrhoeae
MILNRVKCIYDYFQQGGRMNPTKQSKKSYESKRVLKHVSFNTEKEANLLEFSNNLDFSKWVKEKLKHELELEKLKK

SEQ ID NO: 3339 - DNA, 387 bp, Neisseria gonorrhoeae
atgcttaaacatctcgcattcctactgcccgccatgatgttcgccctccccgcccagaccgccgtcctaagcccctatcaggaaaccggctgcacctacgaaggcgggatcggaaaagacgggcttccttcaggcaaaggcatatggcgttgccgggatgggcgcggttataccggttcattcaaaaacggcaaattcgacgggcaaggcgtttataccgttgccgccggccgcgaagtatttctcgagccgttcaattccgacagtaccaaattccgcaatatggcattgtcgggcacgttcaaacaaggcttggcacacggcaggttcgccgcctcgcaaaacggcgaaaccctcttttattatgaaatgcgaacacggcatgat

SEQ ID NO: 3340 - protein, 129 aa, Neisseria gonorrhoeae
MLKHLAFLLPAMMFALPAQTAVLSPYQETGCTYEGGIGKDGLPSGKGIWRCRDGRGYTGSFKNGKFDGQGVYTVAAGREVFLEPFNSDSTKFRNMALSGTFKQGLAHGRFAASQNGETLFYYEMRTRHD

SEQ ID NO: 3341 - DNA, 897 bp, Neisseria gonorrhoeae
atgtggttcaagcagattagtttttatccgctcaacaaagaaaagctgcctgaggcggacgtacttgccgacaaacttgctgaagctgaatttacccattgccaaggtttggactggttcagcgaaggctttaccgcaccggtttctttttcgcccgaactcgttttccctgccgactttaccttgcgcgtcgccctgaaaaaagaggaaaaagtcctgcctgccggcgtcatccgcgatattttggaagagaaggtagcggaaatccaaaacaatgaagcccgcaatgtcggtcgcaaagaaaaacaagagcttaaagagcaaattacagacgacctgctgccccgagcgtttacccgcagcagccgtacagaagcggtgtttaacacccgccacggctacctgctcgtcaataacgcggcttccgccaaagcggaaaacatcctgaccaagctgcgcgaagctttgggaggtttggaagcctcgctgccgaataccaaacaatcgccctcttccctgatgaccggctggctgttgcaagggcattgcgaaggcggttttgaattagacagcgattgcgaactcaaaggtacgggcgatattgttcccgtcgtcaaagtatccaaacaagacttaaccgccgacgaagtggttcaacacgtcaaaaacggtaaaaccgttacccggctcggtttggtttggcgcgaacaaatcgcctttatcctcactcaagacttcacactcaagcgcatccaatacctcgacgtattgcaggaagaagccgaaagcaacggcgacgatgccgccggccttgccttcgcctcgcaaatcctgatggcggaatccgtcagcaccatgttggaagagctggtttcctatttgggcggctggcaagat

SEQ ID NO: 3342 - protein, 299 aa, Neisseria gonorrhoeae
MWFKQISFYPLNKEKLPEADVLADKLAEAEFTHCQGLDWFSEGFTAPVSFSPELVFPADFTLRVALKKEEKVLPAGVIRDILEEKVAEIQNNEARNVGRKEKQELKEQITDDLLPRAFTRSSRTEAVFNTRHGYLLVNNAASAKAENILTKLREALGGLEASLPNTKQSPSSLMTGWLLQGHCEGGFELDSDCELKGTGDIVPVVKVSKQDLTADEVVQHVKNGKTVTRLGLVWREQIAFILTQDFTLKRIQYLDVLQEEAESNGDDAAGLAFASQILMAESVSTMLEELVSYLGGWQD

SEQ ID NO: 3343 - DNA, 1500 bp, Neisseria gonorrhoeae
gtgttcagttctaccgaacggcacttgacacagaaagacccaatcatgaaaccaaccatcgcgcttatcggccgccccaacgtcggcaaatctaccttgttcaaccgtttgacgcgcaccaaagacgcgctcgtgcatgacctgccgggtctgacccgcgaccgccattacggacacggcaaagtcggcagcaaaccttattttgtcatcgataccggcggtttcgagccggttgtggacagcggcattttgcacgaaatggcaaaacaaaccttgcaggctgtcgatgaagccgatgcggttgtgtttttggtggacggccgtaccggtttaacaccgcaagacaagattattgccgaccgtttgcgccaaagtccgcgtcccgtttatttggccgtgaataaaggcgagggcggcgacagggccgtacttgccgccgagttttacgagctggcattgggcgagccgcacgttatttccggcgcgcacggcgacggcgtgtattacctgattgaagaaattttagaaaacttccccgagcctgaagccgaagaagccgatgcaaaacatcccgtttttgccgttatcggtcgtccgaacgtcggcaaatctacgctggttaacgccattctcggcgaaaaacgcgtcatcgccttcgatatggcaggcacaacgcgcgacagcatccacatcgatttcgagcgcgaaggcaaaccgtttaccatcatcgataccgcaggcgtgcgccgtcgcggcaaagtggatgaagcggtggaaaagttctccgttatcaaagccatgcaggcggttgaagcggcaaacgttgctgttttggtattggacgcgcaacaggacattgccgaccaagatgcgacgattgccggttttgctttggaagcgggacgcgcgctggtagttgccgtcaacaaatgggacggcatcagcgaagagcggcgcgaacaagtgaaacgcgacatttcccgcaaactgtatttcctcgattttgccaagttccactttatttccgcgttgaaagagcgcggtatagacggtttgtttgaaagcattcaagctgcctacaacgcggcgatgattaagatgccgacgccgaaaatcacgcgcgtattgcaaaccgccgtcgaacgccaacagccgccgcgtgccggcttggtgcgtccgaaaatgcgttatgcccaccaaggcggcatgaatccgccggtgattgtggttcacggcaattcgctgcacgcgatttccgacagctatacgcgctatctgacccagaccttccgcaaagccttcaacctgcaaggcacgccgttgcggattcaatacaatgtttcggaaaacccgtatgaaaatgcggaagacaaaccgaagaaaaaaccgctgcgccgcgtcagcctgagcaaccgtattgagaaacgcgaaggccgaaaggaagagaaaaaccgcttcaagaagaaaaccaaagtcagtgtgaaaaaacaattcagcaaa

SEQ ID NO: 3344 - protein, 500 aa, Neisseria gonorrhoeae
VFSSTERHLTQKDPIMKPTIALIGRPNVGKSTLFNRLTRTKDALVHDLPGLTRDRHYGHGKVGSKPYFVIDTGGFEPVVDSGILHEMAKQTLQAVDEADAVVFLVDGRTGLTPQDKIIADRLRQSPRPVYLAVNKGEGGDRAVLAAEFYELALGEPHVISGAHGDGVYYLIEEILENFPEPEAEEADAKHPVFAVIGRPNVGKSTLVNAILGEKRVIAFDMAGTTRDSIHIDFEREGKPFTIIDTAGVRRRGKVDEAVEKFSVIKAMQAVEAANVAVLVLDAQQDIADQDATIAGFALEAGRALVVAVNKWDGISEERREQVKRDISRKLYFLDFAKFHFISALKERGIDGLFESIQAAYNAAMIKMPTPKITRVLQTAVERQQPPRAGLVRPKMRYAHQGGMNPPVIVVHGNSLHAISDSYTRYLTQTFRKAFNLQGTPLRIQYNVSENPYENAEDKPKKKPLRRVSLSNRIEKREGRKEEKNRFKKKTKVSVKKQFSK

SEQ ID NO: 3345 - DNA, 627 bp, Neisseria gonorrhoeae
atggcagcccatctcgaagaacaacaagagttagacaactttaaatatttttggaaaaccacgggcaaatggctgtttgccctgctgattttggcggcactcggctacttgggatacacggtttaccaaaaccgtgcggcttcccaaaatcaggaagcggcggcggtgctggcaaacatcgtggaaaaggcgcaaaacaaagccccgcaaagcgaaatcaatgccgaactgtccaaactccaacaaagctacccccattccatttccgccgcccaagccacgctgatggcggcggcaaccgaatttgacgcgcagcgttacgatgttgccgaaggtcatttgaaatgggtgttgtccaaccaaaaagacagcctgattcaggcgttggcggcgcagcgtctgggcgttgtgttgttgcaacaaaaaaaatacgatgccgcgcttgccgcactcgacacgccggttgaggcggacttcgcccccctgctgatggaaactaaaggcgatgtttatgccgcacaggaaaaaagccaggaagccttaaaaaactacggacaggctttggaaaaaatgcctcaagattctgtcggtcgcgaattgcttcaaatgaaactcgattcgctgaaa

SEQ ID NO: 3346 - protein, 209 aa, Neisseria gonorrhoeae
MAAHLEEQQELDNFKYFWKTTGKWLFALLILAALGYLGYTVYQNRAASQNQEAAAVLANIVEKAQNKAPQSEINAELSKLQQSYPHSISAAQATLMAAATEFDAQRYDVAEGHLKWVLSNQKDSLIQALAAQRLGVVLLQQKKYDAALAALDTPVEADFAPLLMETKGDVYAAQEKSQEALKNYGQALEKMPQDSVGRELLQMKLDSLK

SEQ ID NO: 3347 - DNA, 1263 bp, Neisseria gonorrhoeae
atgaacgaccttctgcctgtcgggcaaaaagatttcaaactcacggctgtgttttggcaggcgtttgaggatacggtaaaccgttggacgcgagcttacggttatcagcaaatccgtacgccgattgtcgagcaaaccggtttgtttgtccgctccatcggcgaggaaaccgatgtagtcggcaaggaaatgtacaccttctccgattcaaacgattctttgagtttgagcctgcgtcccgaaggtacggcctcttgtctgcgtgcggtggtcgaacacaaccttctgtacaacagcccgcaaaagctgtggtatatggggccgatgttccgccgcgagcgtccgcaaaaaggacgctaccgccaatttcatcaggtcggtatcgaggctttgggttttgaagggccggatattgatgcggaaatcatcgcaatgtctgccgacttgtgggaaaaattgggtattcgcgaatacctgactttggaaatcaacagcttgggcaaccgtgaggaacgcgcggcacaccgtgcggcattggttgaatatctgacccgctatgaagcgcaactggacgaagacagcaaacgccgtctgaaaaccaatcctttgcgcgttttggatacgaaaaaccctgatttgcaggaaatctgcaatgccgcgccgcgtttggtagattacttgggcgaggcttcgcaaaaccactatgcacgcttcaaggcgatgttggacggtttgggtattcaatatattgaaaattcgcgcttggttcgcggtttggattattacaatcagacggtttttgagtggacgaccgacaaactcggcgcgcaggcgactgtgtgcggcggcggacgttacgacggtttgattgaagaactcggcggcaagcctgcgccgtccatcggctttgcgatgggcatcgaacggctgctgcttttggtgagcgaatacggttcgctggaagtgaacgccgcgcctgatgtctatgcaatgcaccaaggcgaaggggcggacttgcaggtgatgaaatacgcacaagccttgcgcgcgcaaggtttcaatgtaatacagcattccggctatcaaagcctgaaggcgcaaatgaaaaaagccgacaacagcggcgcgcgctttgccctgattgtcgcgcaagacgaactggcggacggtaccgttacgctcaaagacatgaacggcgcacacggtcagcaaaccgtttccgccaccgatttgacagatactttacaacaatggaagaacgca

SEQ ID NO: 3348 - protein, 421 aa, Neisseria gonorrhoeae
MNDLLPVGQKDFKLTAVFWQAFEDTVNRWTRAYGYQQIRTPIVEQTGLFVRSIGEETDVVGKEMYTFSDSNDSLSLSLRPEGTASCLRAVVEHNLLYNSPQKLWYMGPMFRRERPQKGRYRQFHQVGIEALGFEGPDIDAEIIAMSADLWEKLGIREYLTLEINSLGNREERAAHRAALVEYLTRYEAQLDEDSKRRLKTNPLRVLDTKNPDLQEICNAAPRLVDYLGEASQNHYARFKAMLDGLGIQYIENSRLVRGLDYYNQTVFEWTTDKLGAQATVCGGGRYDGLIEELGGKPAPSIGFAMGIERLLLLVSEYGSLEVNAAPDVYAMHQGEGADLQVMKYAQALRAQGFNVIQHSGYQSLKAQMKKADNSGARFALIVAQDELADGTVTLKDMNGAHGQQTVSATDLTDTLQQWKNA

SEQ ID NO: 3349 - DNA, 126 bp, Neisseria gonorrhoeae
gtgaggatggagatggtttgcgggcgggtaaaaatgccgtctgaaacagttttcagacggcatttgacttactctgcgcgcccttgcctgatttgtccgactgcaaactccgtctgccgcttggga

SEQ ID NO: 3350 - protein, 42 aa, Neisseria gonorrhoeae
VRMEMVCGRVKMPSETVFRRHLTYSARPCLICPTANSVCRLG

SEQ ID NO: 3351 - DNA, 696 bp, Neisseria gonorrhoeae
ttgccgcttctgtctgtcagccgtttcgggctgcacaccacatctgttcaaaggaaaaccatgtttcaaaattttgacttgggcgtgtttctgcttgctgtcctgcccgtgctgctcgccattaccgtcagggaggtggcgcgcggctatacggcgcgctactggggagacaacactgccgaacaatacggcaggctgacactgaaccccctgccccatatcgatttggtcggcacaatcatcgtaccgctgcttactttgatgttcacgcccttcctgttcggctgggcgcgtccgattcctatcgattcgcgcaacttccgcaacccgcgccttgcatggcgttgcattgccgcgtccggcccgctgtcgaatctggcgatggctgttctgtggggcgtggttttggtgctaactccgtatgccggcggggcgtatcagatgccgctggctcaaatggcaaactacggtattctgatcaatgcgattttgttcgcgctcaacatcatccccatcctgccttgggacggcggcattttcatcgacaccttcctgccggcgaaatattcgcaagcgttccgcaaaatcgaaccttatgggacgtggattatcctgctgcttatgctgaccggggttttgggtgcgtttattgcaccgattgtgcggctggtgattgcgtttgtgcagatgttcgtc

SEQ ID NO: 3352 - protein, 232 aa, Neisseria gonorrhoeae
LPLLSVSRFGLHTTSVQRKTMFQNFDLGVFLLAVLPVLLAITVREVARGYTARYWGDNTAEQYGRLTLNPLPHIDLVGTIIVPLLTLMFTPFLFGWARPIPIDSRNFRNPRLAWRCIAASGPLSNLAMAVLWGVVLVLTPYAGGAYQMPLAQMANYGILINAILFALNIIPILPWDGGIFIDTFLPAKYSQAFRKIEPYGTWIILLLMLTGVLGAFIAPIVRLVIAFVQMFV

SEQ ID NO: 3353 - DNA, 90 bp, Neisseria gonorrhoeae
ttgaattatatttataaaaaaggtgcaaataaggtgcaaataaaattagtttttcccaatgggttaaagaacaaatccgaaaagagttct

SEQ ID NO: 3354 - protein, 30 aa, Neisseria gonorrhoeae
LNYIYKKGANKVQIKLVFPNGLKNKSEKSS

SEQ ID NO: 3355 - DNA, 552 bp, Neisseria gonorrhoeae
ttgagattccgtttaccaatggctgacaaacgcttccaaatcggtattcttgggcttatgcacttcctctgtcggcgtgccgaccatcatcagcccgatgattttatccttatcctcgcaaccgaaagcctcccgcaacaatgggctgttgacccacatccccgtaatccagacattgtcgaatccctgagccgttgccgccagttgcagcgcatacgccgcacaacccgccgtcagcatctgctcccattccggtttcggcttaggcacatcgcggttcggcacaaacgttaccccgatgaccatcggcgccatattgcccactttttccgcctttttcatcgcatcgtcgccgaaattcagttcggcaaccgtttgcttcaacacatcgcgaaaacgttgcaatcctacctcgccttgaatcacggtaaaacggaaggggcgcatgttgccgtgatcggaaacttgggttgccgcctgcaatatttgttccaactccgccgcatcgggggcggggtgcttcagctttttggaagatcggcggttcgtcaa

SEQ ID NO: 3356 - protein, 184 aa, Neisseria gonorrhoeae
LRFRLPMADKRFQIGILGLMHFLCRRADHHQPDDFILILATESLPQQWAVDPHPRNPDIVESLSRCRQLQRIRRTTRRQHLLPFRFRLRHIAVRHKRYPDDHRRHIAHFFRLFHRIVAEIQFGNRLLQHIAKTLQSYLALNHGKTEGAHVAVIGNLGCRLQYLFQLRRIGGGVLQLFGRSAVRQ

SEQ ID NO: 3357 - DNA, 342 bp, Neisseria gonorrhoeae; identical to SEQ ID NO: 105

SEQ ID NO: 3358 - protein, 114 aa, Neisseria gonorrhoeae; identical to SEQ ID NO: 106

SEQ ID NO: 3359 - DNA, 153 bp, Neisseria gonorrhoeae
atgccgtctgaaaactgtttcagacggcatttttacccgcccgcaaaccatctccatcctcacaagcccttaaaaatccgctataatcgcccgcaatttgatttcagcaccccctttttgaaatggcacaaaaaatccaatccgtcaaaggca

SEQ ID NO: 3360 - protein, 51 aa, Neisseria gonorrhoeae
MPSENCFRRHFYPPANHLHPHKPLKIRYNRPQFDFSTPFLKWHKKSNPSKA

SEQ ID NO: 3361 - DNA, 729 bp, Neisseria gonorrhoeae
ttgtcgcactatccgattaataagcaaacaaaaaggctgcttggaaatttcaggcagcctttcaggaggattttgatggaacaaaaaaggcggtttgccgcttccctgctcctcgccgccgccctgccgctttgtgcacattcttttccctttgcggaagaaaaccccatagcctacggcaaagtcaaaatacaaagctggaaagcgcggcgggatttcaatattgtaaagcaggatttggatttttcctgcggggcggcttcggtggcgacgcttttgaacaatttttacgggcaaacgctgacggaagaagaagtgttggaaaaactgggtaaggaacagatgcgcgcgtcgtttgaggatatgcggcgcattatgcccgatttgggttttgaggcgaagggctatgccctgtctttcgagcagctcgcgcagttgaaaatccccgtcatcgtgtatctgaaataccgcaaggatgatcatttctcggtattgcgcggcataggcggcaatacggttttgcttgccgacccgtcgccgggtcatgtttcgatgagcagagcgcagtttttggaggcttggcaaacccgtgagggaaatttggcaggcaaaattttggcggtcgtgccgaaaaaagcggaggcgatttcaaataaattgtttttcacacatcatcccaagcggcagacggagtttgcagtcggacaaatcaggcaagggcgcgcagag

SEQ ID NO: 3362 - protein, 243 aa, Neisseria gonorrhoeae
LSHYPINKQTKRLLGNFRQPFRRILMEQKRRFAASLLLAAALPLCAHSFPFAEENPIAYGKVKIQSWKARRDFNIVKQDLDFSCGAASVATLLNNFYGQTLTEEEVLEKLGKEQMRASFEDMRRIMPDLGFEAKGYALSFEQLAQLKIPVIVYLKYRKDDHFSVLRGIGGNTVLLADPSPGHVSMSRAQFLEAWQTREGNLAGKILAVVPKKAEAISNKLFFTHHPKRQTEFAVGQIRQGRAE

SEQ ID NO: 3363 - DNA, 222 bp, Neisseria gonorrhoeae
atgatgaagaacaaatatattttaataaaagcagcaatcggcataaccgccatatccatattttatcttctgactcaaggaagcatcggcaaaactgaagaaccatcatatttcttgatgttcatgtttctcaactcgctttggtttgaagaaaataaaacagttatggctgccgttacggcaatgattgccgcccactttatatttgtcgcactatccgat

SEQ ID NO: 3364 - protein, 74 aa, Neisseria gonorrhoeae
MMKNKYILIKAAIGITAISIFYLLTQGSIGKTEEPSYFLMFMFLNSLWFEENKTVMAAVTAMIAAHFIFVALSD

SEQ ID NO: 3365 - DNA, 204 bp, Neisseria gonorrhoeae
atgccgtaccggtttaaatttaatccactatatatttatccgatatatcaacatctctctatcttattccgaattttattgttgaaacttgcattaaaaaccatacaagatgatgaagaacaaatatattttaataaaagcagcaatcggcataaccgccatatccatattttatcttctgactcaaggaagcatcggcaaaac

SEQ ID NO: 3366 - protein, 68 aa, Neisseria gonorrhoeae
MPYRFKFNPLYIYPIYQHLSILFRILLLKLALKTIQDDEEQIYFNKSSNRHNRHIHILSSDSRKHRQN

SEQ ID NO: 3367 - DNA, 102 bp, Neisseria gonorrhoeae
ttgttttttgatgaaattaaaataatgaaatatatggtaaacgttacaacggaagccttagcctcccgattgcagtatttcaattccaagatggatgccgca

SEQ ID NO: 3368 - protein, 34 aa, Neisseria gonorrhoeae
LFFDEIKIMKYMVNVTTEALASRLQYFNSKMDAA

SEQ ID NO: 3369 - DNA, 135 bp, Neisseria gonorrhoeae
ttggaattgaaatactgcaatcgggaggctaaggcttccgttgtaacgtttaccatatatttcattattttaatttcatcaaaaaacaaaattcaagattatacataccgccaatcgtttcttgattgttttgta

SEQ ID NO: 3370 - protein, 45 aa, Neisseria gonorrhoeae
LELKYCNREAKASVVTFTIYFIILISSKNKIQDYTYRQSFLDCFV

SEQ ID NO: 3371 - DNA, 99 bp, Neisseria gonorrhoeae
atgaaagatttatttttattttcatgttctgtttgtttattattctatttcttattattgattgcagaaaccattggaaaaacaatcaataagattaaa

SEQ ID NO: 3372 - protein, 33 aa, Neisseria gonorrhoeae
MKDLFLFSCSVCLLFYFLLLIAETIGKTINKIK

SEQ ID NO: 3373 - DNA, 90 bp, Neisseria gonorrhoeae
ttgcaaatccagcaatttgaatattgtcattgttccgtgcaaaaggaatctttattgatgtgttgtgtactgggtttcagcttggctttt

SEQ ID NO: 3374 - protein, 30 aa, Neisseria gonorrhoeae
LQIQQFEYCHCSVQKESLLMCCVLGFSLAF

SEQ ID NO: 3375 - DNA, 294 bp, Neisseria gonorrhoeae
ttggaagtgagaggaggtaaggtagtgtttgctgttattttcttttcgacattgggctgtattttagcatggataagagatattcctaaaataaaatcaaaaaaaattttggcaagatccttatatattataggaataataaatgtaataatcagctatgtattaattaaaaatatattggtttctgtttcggatggaggtggaataaaatatgttgcaatatatttatcaaatctttttttttggacagtattgatgtatgttcttgtgaaaagattatctaaaaagccaagc

SEQ ID NO: 3376 - protein, 98 aa, Neisseria gonorrhoeae
LEVRGGKVVFAVIFFSTLGCILAWIRDIPKIKSKKILARSLYIIGIINVIISYVLIKNILVSVSDGGGIKYVAIYLSNLFFWTVLMYVLVKRLSKKPS

SEQ ID NO: 3377 - DNA, 258 bp, Neisseria gonorrhoeae
ttgtttcttatccttacatcttcctgccttgtcaatcaaataaagacagaagactatacaaaaactgaccgacatactgaaaatacctatccccttccatgcaatctccgcaccattgacccaatagatcagactgagaaacaacaaagccacagtataaatcaacgtaaaaaatatagcgtaaagcgcaataaagggaacttttatctcacggttgttttttataatatattcagcaacttgatttccgaatatacc

SEQ ID NO: 3378 - protein, 86 aa, Neisseria gonorrhoeae
LFLILTSSCLVNQIKTEDYTKTDRHTENTYPLPCNLRTIDPIDQTEKQQSHSINQRKKYSVKRNKGNFYLTVVFYNIFSNLISEYT

SEQ ID NO: 3379 - DNA, 288 bp, Neisseria gonorrhoeae
atggatgatctaatactatattttttatcaggtatattcggaaatcaagttgctgaatatattataaaaaacaaccgtgagataaaagttccctttattgcgctttacgctatattttttacgttgatttatactgtggctttgttgtttctcagtctgatctattgggtcaatggtgcggagattgcatggaaggggataggtattttcagtatgtcggtcagtttttgtatagtcttctgtctttatttgattgacaaggcaggaagatgtaaggataagaaacaa

SEQ ID NO: 3380 - protein, 96 aa, Neisseria gonorrhoeae
MDDLILYFLSGIFGNQVAEYIIKNNREIKVPFIALYAIFFTLIYTVALLFLSLIYWVNGAEIAWKGIGIFSMSVSFCIVFCLYLIDKAGRCKDKKQ

SEQ ID NO: 3381 - DNA, 90 bp, Neisseria gonorrhoeae
ttgttaatccactatagtttaaacaactttatttttgattttatcccaagtataaacctgacaatcgtatttaaaagccggatctacgcc

SEQ ID NO: 3382 - protein, 30 aa, Neisseria gonorrhoeae
LLIHYSLNNFIFDFIPSINLTIVFKSRIYA

SEQ ID NO: 3383 - DNA, 204 bp, Neisseria gonorrhoeae
ttgatgggggggcaatatagttctttagaaaattttgctttatccgtactaagggaaaaaattataaacaatactgtttccagtgatgaaaaattattgattattaatgattttttatcaggttttcttgagtttgatcctgagacaggggaacctgtcggggagacgcttaaaattgagcaaatgattgatttctttttagtc

SEQ ID NO: 3384 - protein, 68 aa, Neisseria gonorrhoeae
LMGGQYSSLENFALSVLREKIINNTVSSDEKLLIINDFLSGFLEFDPETGEPVGETLKIEQMIDFFLV

SEQ ID NO: 3385 - DNA, 540 bp, Neisseria gonorrhoeae
atgaaacgtatctttttgcccgccttgcccgccatcctgcctttatccgcttatgccgacctgcccttgacgattgaagacataatgaccgacaagggaaaatggaaactggaaacttcccttacctatctgaatagcgaaaacagccgcgccgcacttgccgcaccggtttacattcaaaccggcgcaacctcgtttatccccattccgaccgaaattcaagaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaaccccgccctaatcagctttcttgaaagcacggtttacgaaaaatcgcgcaacaaagcctcgttaatcaaaaaaagggggctttgccccttttataacttaaggataaattatgaatat

SEQ ID NO: 3386 - protein, 180 aa, Neisseria gonorrhoeae
MKRIFLPALPAILPLSAYADLPLTIEDIMTDKGKWKLETSLTYLNSENSRAALAAPVYIQTGATSFIPIPTEIQENGSNTDMLAGTLGLRYGLTGNTDIYGSGSYLWHEERKLDGNGKTRNKRMSDISAGISHTFLKDGKNPALISFLESTVYEKSRNKASLIKKRGLCPFYNLRINYEY

SEQ ID NO: 3387 - DNA, 921 bp, Neisseria gonorrhoeae
atgaaaaaacgcaataatcctcttccgctgttgaacggtgtcaaacccagttatttggtgctgccgcatgaaaagcagttttacgggctgccgctgctgcattttctgtgcatccgctttccttttttgggagcggacgattggcggaggcggttgaacagcggttttgtggtcggttcggatggtgcggcgttggacgaacattctttgttcgagcccggtaagacgatgttttattaccgtgaaaccggttgtgagagcgagccgcgtattccgtttgaagaaaagattttgtttgtcgatgaacatttgattgtggtggacaagccgcattttctgcccgtcatccccggcgggcgttttttgcgggaaacgctgctcacgcgtctgcgcctgcgtcccgaattgcagcatttgaatgttgaagacattacgccgattcaccgcttggacaaggatacggcgggtgtgatgctgctgtcgcacaatcctgccacacgcggggcttatcagacgatgtttcaaaacaaaacggtatggaaaacgtatgaggcgcttgcgccgacaaagacggatttgccgtatccgctcgatgtggtttcgcgtttggtaaggggtgagaaattttttacgacgcaagaggccgaaggcgtgccgaatgcgcacacgacggtcgaattgattgaaaacaggggggaattcagcctttaccgccttacgccgcataccggcaagaaacaccagttacgcgtgcatatgatgggtttgggtatgccgctgttgaatgacgcgctctatcccgtgccgtctgaagcgggtagcgaggattatcggaaacctttgaagcttttggcaaaaaagattgcgtttgcagatcctttgtcgggtcgggaaagggtgttttgcagcgggttttgcctg

SEQ ID NO: 3388 - protein, 307 aa, Neisseria gonorrhoeae
MKKRNNPLPLLNGVKPSYLVLPHEKQFYGLPLLHFLCIRFPFLGADDWRRRLNSGFVVGSDGAALDEHSLFEPGKTMFYYRETGCESEPRIPFEEKILFVDEHLIVVDKPHFLPVIPGGRFLRETLLTRLRLRPELQHLNVEDITPIHRLDKDTAGVMLLSHNPATRGAYQTMFQNKTVWKTYEALAPTKTDLPYPLDVVSRLVRGEKFFTTQEAEGVPNAHTTVELIENRGEFSLYRLTPHTGKKHQLRVHMMGLGMPLLNDALYPVPSEAGSEDYRKPLKLLAKKIAFADPLSGRERVFCSGFCL

SEQ ID NO: 3389 - DNA, 1188 bp, Neisseria gonorrhoeae
tcggtcaacctccccgaatacgatgtcctgcgtaccgatgatggcaacgacgtcggcgagcatatggccttttgccatttcgtccatgccttgcaggtgggcgaagccgggtgcgcggattttcaggcggtagggtttgtttgcgccgtctgaaatgatgtaaacgccgaactcgcctttcgggtgttcgacagcggtgtaggtctcgccctcgggaacgtgcataccctcggtaaagagtttgaaatggtgaatcaggtcttccatacctgttttcatttcggtacgtttgggcggagcgaatttgtggtttgcggtaatgaccgggccgggattgacgcgcaaccagtcggcgcattgtttgatgatgcgtacggattggcgcatttcttccatacggcagaggtaacggtcgtagcagtcgccgttgacgccgacggggatgtcgaaatccattttgtcgtacacttcgtagggctgtgtcttacgcacgtcccattccacgccggaaccgcgaagcatcacaccggtaaagcctttttgcatggcgcgctcgggagagacaacgccgatgccgacggtacgctgtttccagatgcggttgtcggtcaggagggtttcgagtgtgtcgatatttttggggaagcgttcgcagaaggcatcgataaagtcaagcatcgtgccttcgcgggattcgttgagctgcttcaatactttggcattgcgaaatttgctgctctcgtatttgggcataaagccgggtaggtcgcggtaaacgccgccgggacggaagtaggcggcgtgcatacgtgcgccggacacggcttcgtacaagtccatcagctcttcgcggtcgcggaaggcgtagaggatggcggtcatcgcgccgatgtcgaaggcgtgcgaaccgatgcccatcaagtgattgaggatgcgcgttacttcggcgaacatcacgcggatgtattgggcgcggataggcacatcgataccggcaagtttttctaccgccaagcaatacgcctgctcgttgaccatcatggaaacgtagtccaaacggtccatatagggcagggcttgcagataggttttggtttccgccagtttttcggtgccccggtgcaggaggccgatatgcggatcggcacggacgatttgttcgccgtccagctccaaaatcatacgcaa

SEQ ID NO: 3390 - protein, 50 aa, Neisseria gonorrhoeae
SVNLPEYDVLRTDDGNDVGEHMAFCHFVHALQVGEAGCADFQAVGFVCAV

SEQ ID NO: 3391 - DNA, 489 bp, Neisseria gonorrhoeae
atgcgtgcggtcatacagaaaacggtaggtgcaaaggtggatgtcgtgtccgaagccggcacggaaacctgcggcaaaatcgacggcgggtttgtcgtgttactcggtgtaacgcatagcgacacagaaaaagatgcacgctatatcgccgacaaaatcgcacatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcgccggcagaacaggcgcaacggctttacctgcgaacggcggagctgttacgcggacacgggattcatgtcgaaacagggcgtttccgcacgcatatgcaggtgtcgctctgcaacgacgggccggtaaccatactgctggactctttcatgacgcggatttccccaaaaatgaaggttgttccggat

SEQ ID NO: 3392 - protein, 163 aa, Neisseria gonorrhoeae
MRAVIQKTVGAKVDVVSEAGTETCGKIDGGFVVLLGVTHSDTEKDARYIADKIAHLRVFEDEAGKLNLSLKDVGGAVLLVSQFTLYADAASGRRPSFSQAAPAEQAQRLYLRTAELLRGHGIHVETGRFRTHMQVSLCNDGPVTILLDSFMTRISPKMKVVPD

SEQ ID NO: 3393 - DNA, 639 bp, Neisseria gonorrhoeae
atgctgaaacccgaaaccatacacatacccggccctgccggcattttagaaaccatccatatcccgtccgaacaagtaccggcacgcggtgttgccgtcatcaatcatcccaaccccctccaaggcgggacgaacaccaacaaagtcatccaaaccgccgccaaagcattgagcaagctcggcttccactgctaccttcccaaccttcgcggcgtaggcggcagcgaaggcacacatgattacggacgcggcgaaacgcaagactgcctcgccgtcatcgattatgcccgcgcccaacatcccgaagccccggaatttgccttatccggcttttccttcggcggctatgtcgccacatttgccgcacaagtgagcatacccgatttattgctgctcatcggcgcggcagtctgccactataccgaccgccccgagccgtccgccgttcccaacgttgccaaaacgctgatgatacacggcgcggaagacgaagtcgtcgaaatcgaaaaagccctgaaatgggcagaaccgcaagatttgcccgtcattaccatcgccggttcgacgcacttctttcacggcaaactcatcgtcctgcgcgacaccatcctccgcttcgcacccgtatgcctgaacgga

SEQ ID NO: 3394 - protein, 213 aa, Neisseria gonorrhoeae
MLKPETIHIPGPAGILETIHIPSEQVPARGVAVINHPNPLQGGTNTNKVIQTAAKALSKLGFHCYLPNLRGVGGSEGTHDYGRGETQDCLAVIDYARAQHPEAPEFALSGFSFGGYVATFAAQVSIPDLLLLIGAAVCHYTDRPEPSAVPNVAKTLMIHGAEDEVVEIEKALKWAEPQDLPVITIAGSTHFFHGKLIVLRDTILRFAPVCLNG

SEQ ID NO: 3395 - DNA, 789 bp, Neisseria gonorrhoeae
atggcaagacatccctaccgccgcctgcgtcctgcaaaatccggctttcccgaagtcggtatttccgaagaaggcaatatccgttcgcttcacttgggcagcgacaccgttcaaagctcgatgaacctcgaccgcccgtccgagctggtgctctcttacagccgcgcgatgatgggctggctgctgtttgcggaacgcctgccgcaacatatcacccaaatcggcttgggcggcggttcgtttgcacgctggacagacacctacctgcccgacacgcgccaaaccgccgtggacatcaatcctcaggtcatcgccattgcccgcaacctgtttgagttgcctttcgagggcggaaaatttgaaattatcgaagcagacggtgcggaatacatcaaagtcttccgccacaacaccgatatcatcttggtggacggattcgacggcgaacaaatcatcgatacgctggttgaagaaccgtttttcagagactgccgcaacgcactctcttcagacggcatattcgttaccaactggtggagcggcgacaaacgctatcaacgcttcatcgaacggttgttgagcgtttttgaagggcgcgtattggaacttcctgccgaaagccacggcaatgtcgcggtaatggccttccaaagcagccccaaagagcaaaacatagacaaactcaaaaaacgtgccgacaaactgagcaacgcatacggattggacttccaccgcatgctcgccggcctgaaagcgtccaaccccaacaacggcaagcatttccacctt

SEQ ID NO: 3396 - protein, 263 aa, Neisseria gonorrhoeae
MARHPYRRLRPAKSGFPEVGISEEGNIRSLHLGSDTVQSSMNLDRPSELVLSYSRAMMGWLLFAERLPQHITQIGLGGGSFARWTDTYLPDTRQTAVDINPQVIAIARNLFELPFEGGKFEIIEADGAEYIKVFRHNTDIILVDGFDGEQIIDTLVEEPFFRDCRNALSSDGIFVTNWWSGDKRYQRFIERLLSVFEGRVLELPAESHGNVAVMAFQSSPKEQNIDKLKKRADKLSNAYGLDFHRMLAGLKASNPNNGKHFHL

SEQ ID NO: 3397 - DNA, 192 bp, Neisseria gonorrhoeae
atgcaaaacagcccgactgttttacacaatcgggctgtcaaatctggtgccggcaccaagagtcgaactcgggaccccctgattacaagtcaggtgctctaccaactgagctataccggcaaagaaggcgaattatgcaggcaacttcacactttggcaagaaatttgttcgaccccctcataaaaatacac

SEQ ID NO: 3398 - protein, 64 aa, Neisseria gonorrhoeae
MQNSPTVLHNRAVKSGAGTKSRTRDPLITSQVLYQLSYTGKEGELCRQLHTLARNLFDPLIKIH

SEQ ID NO: 3399 - DNA, 789 bp, Neisseria gonorrhoeae
atgattactgtgaacacactgcaaaaaatgaaggcggccggcgagaaaatcgttatgctgaccgcttacgaatccagttttgccgcgctgatggacgatgccggcgtggatgtgctgttggtcggggattctttgggaatggcggttcaggggcgacagtcgacgctgccggtcagcctgcgcgatatgtgctatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggtcaaactcgaaggcggcgtgtggatggcggaaacgactgaatttctgcaaatgcgcggaattccggtctgtgcccacatcggtctgaccccgcaatccgtgtttgccttcggcggatataaagttcaggggcgcggcggcaaggcgcaggcgttgcttaacgatgccaaggcgcatgatgaagccggagctgccgtcgtactgatggaatgcgtgccggcggaactggcaaaaaaggtaactgaaactgtttcctgtccgaccatcggcatcggggcgggcgcggattgcgacggtcaggttttggtgatgcacgatatgctcggtattttcccgggcaaaacggcgaaattcgtcaaaaactttatgcgcgggcaaagcagcatccaggctgcggttcgggcgtatgttgccgaagtcaaagccaaaaccttccctgctgcggaacatatttttgcagat

SEQ ID NO: 3400 - protein, 263 aa, Neisseria gonorrhoeae
MITVNTLQKMKAAGEKIVMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDEAGAAVVLMECVPAELAKKVTETVSCPTIGIGAGADCDGQVLVMHDMLGIFPGKTAKFVKNFMRGQSSIQAAVRAYVAEVKAKTFPAAEHIFAD

SEQ ID NO: 3401 - DNA, 819 bp, Neisseria gonorrhoeae
atgttccgcagcagggaaggttttggctttgacttcggcaacatacgcccgaaccgcagcctggatgctgctttgcccgcgcataaagtttttgacgaatttcgccgttttgcccgggaaaataccgagcatatcgtgcatcaccaaaacctgaccgtcgcaatccgcgcccgccccgatgccgatggtcggacaggaaacagtttcagttaccttttttgccagttccgccggcacgcattccatcagtacgacggcagctccggcttcatcatgcgccttggcatcgttaagcaacgcctgcgccttgccgccgcgcccctgaactttatatccgccgaaggcaaacacggattgcggggtcagaccgatgtgggcacagaccggaattccgcgcatttgcagaaattcagtcgtttccgccatccacacgccgccttcgagtttgaccatatgcgcgccggcagccatcagttcggcggcggcggcaaacgcctgctccttactctgctgatatgcaccaaacggcaaatcgctgacaatcatcgcattttttgcaccgcgtgctacacattcggtgtgatagcacatatcgcgcaggctgaccggcagcgtcgactgtcgcccctgaaccgccattcccaaagaatccccgaccaacagcacatccacgccggcatcgtccatcagcgcggcaaaactggattcgtaagcggtcagcataacgattttctcgccggccgccttcattttttgcagtgtgttcacagtaatcatcagatattgttaccccgcccttttcagacggccttttcagtt

SEQ ID NO: 3402 - protein, 273 aa, Neisseria gonorrhoeae
MFRSREGFGFDFGNIRPNRSLDAALPAHKVFDEFRRFARENTEHIVHHQNLTVAIRARPDADGRTGNSFSYLFCQFRRHAFHQYDGSSGFIMRLGIVKQRLRLAAAPLNFISAEGKHGLRGQTDVGTDRNSAHLQKFSRFRHPHAAFEFDHMRAGSHQFGGGGKRLLLTLLICTKRQIADNHRIFCTACYTFGVIAHIAQADRQRRLSPLNRHSQRIPDQQHIHAGIVHQRGKTGFVSGQHNDFLAGRLHFLQCVHSNHQILLPRPFQTAFSV

SEQ ID NO: 3403 - DNA, 174 bp, Neisseria gonorrhoeae
ttgcagattgaacaaggtctgctgccgatgccgtctgaaagccgtttcagacggcattttgttttgccgtgcgcggcgcgtataatcggcgcgttttgtcgggcaggaagcccgaaggataaggattaccgtaatgcaaatcatacataccattcgagaactgcgcacgtggcg

SEQ ID NO: 3404 - protein, 58 aa, Neisseria gonorrhoeae
LQIEQGLLPMPSESRFRRHFVLPCAARIIGAFCRAGSPKDKDYRNANHTYHSRTAHVA

SEQ ID NO: 3405 - DNA, 591 bp, Neisseria gonorrhoeae
ttggccaccgtagttctcctcacggacgatacgcggtgtgatttcgcgcggctcaatggtaacaggttggtaaatcacgcgtttttgctcttcgtcataacgcatttccacatagccggaaatcgggaagtctttgcggaacggatgtccgacaaagccgtaatcggtcaggatgcggcgcaagtcgggatggttgttgaacatgatgccgtacaaatcgaaggcttcgcgctcgtaccaatccgcgctgttgtaaatatcggctacggattcgactacagggaagtcgtcgtctgaaacccagacgcgtacgcggatgcgttgattgtttttaacggaaagcaactgactgacaacggcaaagcgtttgccctgccatgcttcgtttttgtaagtgctgtaatcgacgccgcacaagtcaaccagaagctcgaaatgcaaatcttcatggtcgtgcaatgcggtcatgactgaaatatagtgctcgggcagacactcgacggtaatctcgcccaaagctgaaatgactttgcctgcctgatcgccaagcacgccgacgacggtctcgtataagttttgaatgcttgccat

SEQ ID NO: 3406 - protein, 98 aa, Neisseria gonorrhoeae
LATVVLLTDDTRCDFARLNGNRLVNHAFLLFVITHFHIAGNREVFAERMSDKAVIGQDAAQVGMVVEHDAVQIEGFALVPIRAVVNIGYGFDYREVVV

SEQ ID NO: 3407 - DNA, 669 bp, Neisseria gonorrhoeae
ttggtggatacgctggtggcgcagatcatgcagcaggcagaccggcatgcggagcagtcccaaagaccggacgggcaggcaatccgaaacgatgccgtccgccggctgcaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaaagcgcactgcgtcagttttatgagcggcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcgttcgacggtttcattatggcgcagcagcttcccgagccgctggcttcgcagtttgccggtatgaaccgtggcgacgttacccgcaatccggtcaaattgggcgaacgctattacctgttcaaactcggcgcggtcgggaaaaaccccgacgcgcagcctttcgagttggtcagaaaccagttggaacaaggtttgaggcaggaaaaagcccgcttgaaaatcgatgcccttttggaagaaaacggtgtcaaaccg

SEQ ID NO: 3408 - protein, 223 aa, Neisseria gonorrhoeae
LVDTLVAQIMQQADRHAEQSQRPDGQAIRNDAVRRLQTLEVLKNRALKEGLDKDKDVQNRFKIAEASFYAEEYVRFLERSETVSESALRQFYERQIRMIKLQQVSFATEEEARQAQQLLLKGLSFEGLMKRYPNDEQAFDGFIMAQQLPEPLASQFAGMNRGDVTRNPVKLGERYYLFKLGAVGKNPDAQPFELVRNQLEQGLRQEKARLKIDALLEENGVKP

SEQ ID NO: 3409 - DNA, 777 bp, Neisseria gonorrhoeae
gtggcatttgtgccgaccatgggcaatctgcatgaagggcatcttgcccttgttcgcgaagccagaaaacgcgccgacaacgttgttgtcagcatattcgtcaaccgcttgcaattcggtcagggcgaggatttcgacaaatatccgcgtactttgcaacaggatgcggacaaacttgccgccgaaggcgttgccgttgttttcgcgcccgatgagaaagaactctatccgaacgtggaacagcgttacaacgtcgaaccgccccatttgcaaaacgaattgtgcggcaaattccgccccggccattttcgcggcgtggcgacggtggtgtccaagctgttcaatatcgttttgccggatgttgcctgtttcggcaaaaaagattaccagcagcttgccgtgattaaaggtttgaccgaggatttgaatttcgatatcgaaattgtccccgtcgatacggggcgggcggcggacggtttggcactctccagccgcaaccggtacttgagcgttggggaacgcgccgaagcaccgcgcctgtaccgcgagctgcaggctgttgccgaatcgctgaagcaggccggtttggattatgcgggtttggagcggcaggctgccgaccatttgaccgctgcgggctggctggtcgattatgtggaaatccgccgcgccgatacgctcgaaatggcgcgggcgggagataagaaactggtggtcttggccgccgcccgtctggggacgacgcgtctgattgacaatgtggaagtcggcctgcct

SEQ ID NO: 3410 - protein, 259 aa, Neisseria gonorrhoeae
VAFVPTMGNLHEGHLALVREARKRADNVVVSIFVNRLQFGQGEDFDKYPRTLQQDADKLAAEGVAVVFAPDEKELYPNVEQRYNVEPPHLQNELCGKFRPGHFRGVATVVSKLFNIVLPDVACFGKKDYQQLAVIKGLTEDLNFDIEIVPVDTGRAADGLALSSRNRYLSVGERAEAPRLYRELQAVAESLKQAGLDYAGLERQAADHLTAAGWLVDYVEIRRADTLEMARAGDKKLVVLAAARLGTTRLIDNVEVGLP

SEQ ID NO: 3411 - DNA, 99 bp, Neisseria gonorrhoeae
atgtatgatttgcattacggtaatccttatccttcgggcttcctgcccgacaaaacgcgccgattatacgcgccgcgcacggcaaaacaaaatgccgtc

SEQ ID NO: 3412 - protein, 33 aa, Neisseria gonorrhoeae
MYDLHYGNPYPSGFLPDKTRRLYAPRTAKQNAV

SEQ ID NO: 3413 - DNA, 93 bp, Neisseria gonorrhoeae
ttgtccggcatcgcatacaggcaaaccgacgcaatctcaaaacacagccctgccttcgggcgggttttgcaaatctacaaaccgtttggcttg

SEQ ID NO: 3414 - protein, 31 aa, Neisseria gonorrhoeae
LSGIAYRQTDAISKHSPAFGRVLQIYKPFGL

SEQ ID NO: 3415 - DNA, 111 bp, Neisseria gonorrhoeae
gtgaaacgggcgggtaacataatcatcctttatccgacatccgtccgaaccttcagacggcatattgagtatctagacaaggcgtcactttatcacaagccaaacggtttg

SEQ ID NO: 3416 - protein, 37 aa, Neisseria gonorrhoeae
VKRAGNIIILYPTSVRTFRRHIEYLDKASLYHKPNGL

SEQ ID NO: 3417 - DNA, 732 bp, Neisseria gonorrhoeae
atgattatgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaacgggcggggtggctgcggaacgtattgagggaagggggaaatcagcatctggacgggttggaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgccccaagcggcggttgccgatgcggtgttcggcgtacaggcacgcgaaaaggaaaaggcaatcgaagctttgcagcgtttggcgaagctcgatacgaaatattgccccccactt

SEQ ID NO: 3418 - protein, 244 aa, Neisseria gonorrhoeae
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKRAGWLRNVLREGGNQHLDGLEEVLAQSDDVQKRRIFLLLVQAAVQQGGVAQKASKAVRRAALKYEHLPQAAVADAVFGVQAREKEKAIEALQRLAKLDTKYCPPL

SEQ ID NO: 3419 - DNA, 1122 bp, Neisseria gonorrhoeae
ttgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaa

SEQ ID NO: 3420 - protein, 374 aa, Neisseria gonorrhoeae
LPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 3421 - DNA, 120 bp, Neisseria gonorrhoeae
gtgcgaactgcgtgccgtttgcccgaatgccccggcttcccggcaaaccttatgccgtctgaaaggatgggcctgcattatttccggggttttcgggaaggctcgggcaaggcgattccg

SEQ ID NO: 3422 - protein, 40 aa, Neisseria gonorrhoeae
VRTACRLPECPGFPANLMPSERMGLHYFRGFREGSGKAIP

SEQ ID NO: 3423 - DNA, 702 bp, Neisseria gonorrhoeae
ttgtttcgggcggcgccgggtgttaaggtagccggtatcgacaggttgacgaggaatattttgatgaaactgtatatttacgaccattgcccgttttgcgtgcgtgcgcggatggctgccgggctgtttggtgctgacgttgaagaagtcgtgctggcaaacgacgacgaggcaacgccgatcggtatgatcggtgcgaaacaagtgcccgtcctgcaaaaagaagacggttcgtttatgggcgagagtttggacattgtgtgccatttcgaccgagaaggccgtctgaaagacgaagtccgccccgagatacaggcgtggctggacaaggtaggcggatacaacaacaaattggttcagccacgcttgatcaaaatcgggctgcccgaatttgtaacgccggaagcggtgaaatatttcacagacaaaaaagagaaaagcatcggcagcttttccgccaatttgaataaaaccgcccaataccttgaacggataaacgcagatttgcaagagttggagaatttgatggacggtacttcagacggcatcaacggtggaatcggtatggaggatattttggttttccccgttttgaggaatctgaccgtggtgcgcggcatcgcgttccctcggaagacgatggattatttaatcggtatgagtgaaaaatcaggcgtgccgctttatttcgacagggcattg

SEQ ID NO: 3424 - protein, 234 aa, Neisseria gonorrhoeae
LFRAAPGVKVAGIDRLTRNILMKLYIYDHCPFCVRARMAAGLFGADVEEVVLANDDEATPIGMIGAKQVPVLQKEDGSFMGESLDIVCHFDREGRLKDEVRPEIQAWLDKVGGYNNKLVQPRLIKIGLPEFVTPEAVKYFTDKKEKSIGSFSANLNKTAQYLERINADLQELENLMDGTSDGINGGIGMEDILVFPVLRNLTVVRGIAFPRKTMDYLIGMSEKSGVPLYFDRAL

SEQ ID NO: 3425 - DNA, 864 bp, Neisseria gonorrhoeae
atgaaagcaaaaatcctgacttccgttgcgctgcttgcctgttccggcagcctgtttgcccaaacgctggcaaccgttaacggtcagaaaatcgacagttccgtcatcgatgcgcaggttgccgcattccgtgcggaaaacagccgtgccgaagacacgccgcaactgcgccaatccctgctggaaaacgaagtggtcaacaccgtggtcgcacaggaagtgaaacgcctgaaactcgaccggtcggcagagtttaaagatgcgcttgccaaattgcgtgccgaagcgaaaaagtcgggcgacgacaagaaaccgtccttcaaaaccgtttggcaggcggtaaaatatggcttgaacggcgaggcatacgcactgcatatcgccaaaacccaaccggtttccgagcaggaagtaaaagccgtttacgacaatatcagcggtttttataaaggcacgcaggaagtccagttgggcgaaatcctgaccgacaaggaagaaaatgcgaaaaaagcggttgccgatttgaaggcgaaaaaaggttttgatgccgttttgaaacaatactcgctcaacgaccgcaccaaacggaccggcgcgccggacggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtgaaagtgccttcttttgacgaaatgaaaggacagattgccggcaaccttcaggcggaacggattgaccgtgccgtcggtgcgctgttgggtaaggcaaacatcaaacctgcaaaa

SEQ ID NO: 3426 - protein, 288 aa, Neisseria gonorrhoeae
MKAKILTSVALLACSGSLFAQTLATVNGQKIDSSVIDAQVAAFRAENSRAEDTPQLRQSLLENEVVNTVVAQEVKRLKLDRSAEFKDALAKLRAEAKKSGDDKKPSFKTVWQAVKYGLNGEAYALHIAKTQPVSEQEVKAVYDNISGFYKGTQEVQLGEILTDKEENAKKAVADLKAKKGFDAVLKQYSLNDRTKRTGAPDGYVPLKDLEQGVPPLYQAIKDLKKGEFTATPLKNGDFYGVYYVNDSREVKVPSFDEMKGQIAGNLQAERIDRAVGALLGKANIKPAK

SEQ ID NO: 3427 - DNA, 636 bp, Neisseria gonorrhoeae
ttgcacggcacgccgcacccgtcggccggcaggatgacacccgttaaggaaactctgatgaaacacaccgtatccgcatcggtcatcctgcttttgaccgcttgcgcgcaattacctcaaaataacgaaaacctgtggcagccgtccgaacacatcagcagttttgcagcggaagggcggttggcagtcaaagcggaagggaaaggttcgtatgcaaatttcgattggacataccaaccgcccgtggaaaccatcaatatcaacacccctttgggcagtacgctcggacagttgtgtcaagacagggacggcgcattggcagtggacggcaaaggaaatgtctatcaggcagagggtacggaagacttgagcaggcagctggtcggtttcaaactgccaatccaatatctgcatatctgggcggaaggcaggcgtgtggcgggcgcgccttaccgcatccgttcagacggcatattggaacaatacggttggacaatcggcagaaccgccgacagtggggggcaagtccgaacgttgcaactgaataacggaaatttgaacatcaggctggttttcaccgaaattggaatgccgtctgaaaccgaaaccccggaacgctgtgcggcgcgcacgaga

SEQ ID NO: 3428 - protein, 212 aa, Neisseria gonorrhoeae
LHGTPHPSAGRMTPVKETLMKHTVSASVILLLTACAQLPQNNENLWQPSEHISSFAAEGRLAVKAEGKGSYANFDWTYQPPVETININTPLGSTLGQLCQDRDGALAVDGKGNVYQAEGTEDLSRQLVGFKLPIQYLHIWAEGRRVAGAPYRIRSDGILEQYGWTIGRTADSGGQVRTLQLNNGNLNIRLVFTEIGMPSETETPERCAARTR

SEQ ID NO: 3429 - DNA, 843 bp, Neisseria gonorrhoeae
atgaatattgcggacggacggcaggcgtttcccgcacctgcaaaactgaatctcgatttgaggattaccggcaggcgggaagacggttatcacaatatcgaaagcatattctgcctgatagatttgcaggataccgtatatttgaaaccgagggacgacggcaaaatcatcctgcacaatcctgtcggcggaataccgcaggaagccgatttgagctaccgtgccgcatcgttgctgcaaaaatatgcgcgcaaccttgccggcgtggaaatatggctggacaaaaaaatcccgaccggcgccggcttgggaggggggagttccgatgccgcaacggttttgctggtgttgaaccgttggtggcagtgtggtttgacgcagtggcagctcattgatttgggtgcggctttgggtgcggacgtaccgttttttattttcggaaaaaatgcttttgcaagcgggataggtaaaaaactgataggaatggatattccgaaacagtggtatgttattgtcaaacctcccgtccacgtttccaccgcaaaaattttcacatacgaaggcttgacacgggattctgcctcaagcataatgccgactttccaaaacctgcaaccgttcagaaacgatatgcaggcagtggtatttaaagaataccctgaagtttggaaagcttattccgagttgtcgaaatacggttctgcaatgatgaccggctcaggagcctgtatatttgcagcatttcaagctaggaatagcgcatacaatatataccgacaagtttcaggtttgtacgaggcatatttggcagagggtctttcaaaacatcctttgttgtccgta

SEQ ID NO: 3430 - protein, 281 aa, Neisseria gonorrhoeae
MNIADGRQAFPAPAKLNLDLRITGRREDGYHNIESIFCLIDLQDTVYLKPRDDGKIILHNPVGGIPQEADLSYRAASLLQKYARNLAGVEIWLDKKIPTGAGLGGGSSDAATVLLVLNRWWQCGLTQWQLIDLGAALGADVPFFIFGKNAFASGIGKKLIGMDIPKQWYVIVKPPVHVSTAKIFTYEGLTRDSASSIMPTFQNLQPFRNDMQAVVFKEYPEVWKAYSELSKYGSAMMTGSGACIFAAFQARNSAYNIYRQVSGLYEAYLAEGLSKHPLLSV

SEQ ID NO: 3431 - DNA, 1191 bp, Neisseria gonorrhoeae
ttgattccagcatgcgaaggttcgaatccttcctccccagccagacaaaagcgtgtaagcctgcttacacgctttttatttcatagaaataaaaatattgaaacgcctttgtttgtgtcggatgttgcaggtataatgccgggcttggtacaagcggagggaagcattgtgttttctgagcggaagttaaacataaaatcaggtgagaatatggctgcgtacgacagtttgatggtatttacaggcaatgccaatcccgaattggcacaacgtgttgtcaggcatttggacatttctttgggcaatgcttccgtatccaagttttcagacggcgaagttgccgtcgaactgttggaaaacgtacgcgggcgcgacgttttcatccttcagccgacctgtgcgccgaccaatgacaacctgatggaaatcctgacgatggcggatgcactgaagcgtgcttcggcaggtcgtattaccacagccattccgtatttcggctatgcgcgccaagaccgccgtccgcgttccgtccgcgttccgatttctgccaaactggtggcaaatatgctgtattcggcagggatcgaccgtgttttgactgtcgatttgcatgccgaccagattcaaggtttcttcgatattccggtggacaatatttatgccactccgattttgttgaacgacatcaagcagcagcggattgaaaatctgaccgtcgtcagcccggacatcggcggtgtcgtccgcgcccgcgccgttgcaaaatccctgaatgccgacttggcaatcatcgacaaacgccgcccgaaagccaatgtggcggaagtcatgaacatcatcggcgatattcaaggcaaaacctgtctgattgtggacgatatgattgacactgcaaatacgctgtgcaaagccgccgtcgccttgaaagagcgcggtgcagaacgtgtcttggcttatgccagccacgccgtattctccggagaggcggtcagccgtattgcctcatccgaaatcgaccaggtggtcgtaaccgataccattcctttgtctgaagcggctaaaaactgcgaccgtatccgtcaggtaacgattgcaggtttgttggccgaaaccgtccgccgcattagcaatgaagaatccgtctcatatcttttcaatgaagaagtgatgacaggcagcatgttgctgccg

SEQ ID NO: 3432 - protein, 397 aa, Neisseria gonorrhoeae
LIPACEGSNPSSPARQKRVSLLTRFLFHRNKNIETPLFVSDVAGIMPGLVQAEGSIVFSERKLNIKSGENMAAYDSLMVFTGNANPELAQRVVRHLDISLGNASVSKFSDGEVAVELLENVRGRDVFILQPTCAPTNDNLMEILTMADALKRASAGRITTAIPYFGYARQDRRPRSVRVPISAKLVANMLYSAGIDRVLTVDLHADQIQGFFDIPVDNIYATPILLNDIKQQRIENLTVVSPDIGGVVRARAVAKSLNADLAIIDKRRPKANVAEVMNIIGDIQGKTCLIVDDMIDTANTLCKAAVALKERGAERVLAYASHAVFSGEAVSRIASSEIDQVVVTDTIPLSEAAKNCDRIRQVTIAGLLAETVRRISNEESVSYLFNEEVMTGSMLLP

SEQ ID NO: 3433 - DNA, 591 bp, Neisseria gonorrhoeae
gtgcaaaatgtcgccggcaaccacttcggcacaatccaaatccaagaaagcagggatattggcaggcaacgcaagcacttcaacagccgtgttcagcagagatacgcgaccgccttgcaatttaacggcttgagaattttcagcgttaacaatgtgcaggggaacgcggatgcgtacaagttgatcggctttcacagcttggaagtcgatgtgttggacttcgcggcggaacgggtgcatttggaaatcgcggacgataacgtctttggtttcgccgttcagagacaatttaatcaacgcagtatggaaagattctttttccaatgcgtaaaatacggttttgtgatctacggcaatggcaacaggctcttgaccttcaccgtacagaataccggggatttggccttcgcgacgcaggcggcggctcgcaccagtgccttgtgcttcacgaacagaggcttgaatttcataagtcatgttaaatactccaagttaggtaaaatcgccgtcatcggccgcgaccagcttaagacggcatcggggttacggcagcaacatgctgcctgtcatcacttcttcattgaaaagata

SEQ ID NO: 3434 - protein, 197 aa, Neisseria gonorrhoeae
VQNVAGNHFGTIQIQESRDIGRQRKHFNSRVQQRYATALQFNGLRIFSVNNVQGNADAYKLIGFHSLEVDVLDFAAERVHLEIADDNVFGFAVQRQFNQRSMERFFFQCVKYGFVIYGNGNRLLTFTVQNTGDLAFATQAAARTSALCFTNRGLNFISHVKYSKLGKIAVIGRDQLKTASGLRQQHAACHHFFIEKI

SEQ ID NO: 3435 - DNA, 570 bp, Neisseria gonorrhoeae
atgacttatgaaattcaagcctctgttcgtgaagcacaaggcactggtgcgagccgccgcctgcgtcgcgaaggccaaatccccggtattctgtacggtgaaggtcaagagcctgttgccattgccgtagatcacaaaaccgtattttacgcattggaaaaagaatctttccatactgcgttgattaaattgtctctgaacggcgaaaccaaagacgttatcgtccgcgatttccaaatgcacccgttccgccgcgaagtccaacacatcgacttccaagctgtgaaagccgatcaacttgtacgcatccgcgttcccctgcacattgttaacgctgaaaattctcaagccgttaaattgcaaggcggtcgcgtatctctgctgaacacggctgttgaagtgcttgcgttgcctgccaatatccctgctttcttggatttggattgtgccgaagtggttgccggcgacattttgcacttgtcagacatcaaactgcctgaaggtgtagaaagcgtttccctgaaacgtaacgaaaatctggctgttgctaccgttaccggtaaaaagcgc

SEQ ID NO: 3436 - protein, 190 aa, Neisseria gonorrhoeae
MTYEIQASVREAQGTGASRRLRREGQIPGILYGEGQEPVAIAVDHKTVFYALEKESFHTALIKLSLNGETKDVIVRDFQMHPFRREVQHIDFQAVKADQLVRIRVPLHIVNAENSQAVKLQGGRVSLLNTAVEVLALPANIPAFLDLDCAEVVAGDILHLSDIKLPEGVESVSLKRNENLAVATVTGKKR

SEQ ID NO: 3437 - DNA, 1323 bp, Neisseria gonorrhoeae
gtgttcataattcaatgcgggataatcggtttattaaaatcgcaaaacccaaaaccatacgcccaagacggcgcgaaagcaagaaaaatccgcccgatcagacaccctaagcgtataatcggcaggctgaaacactcacacaatttagaatatttcatgacagcacataaaatcctgcccgtccttcttcccatcatcttaggcgtttctcacgcaacggctgcatcgcccgcgcccaacagaccgacggtacacgccgcccccacgctccaaacacccgaaaccctcacggcggcacacatcgttatcgaccttcaaagcaggcagactttatccgccaaaaacaccaatacccctgtcgaaccggcggcactaacccaactgatgaccgcatatttggttttcaaaaacatgaaatcgggaaatatccaatctgaagaaaacttaaaaatacccgaatccgcatgggcttcagaaggaagcagaatgtttgtacgtcccggcgatacggtcagcaccgacaaactcttaaaaggcatgattgccctatgcgcaaacgatgccgccctaacccttgccgaccggctgggcaacggctcgattgaaaattttgtgcaacaaatgaacaaagaagcccgacgcttgggcatgaagaacaccgtattcaaaaacccgacaggcttgggtagagaaggacaggtttccaccgccaaagacctctccctgctgtctgaagcattgatgcgcgactttccggaatattacccgctgttttccatcaaatcgttcaagtttgaaaacatagaacaaaacaaccgcaatatccttttatatagggacaacaatgtaaacggcctgaaagccgggcacacagaaagcggcggctacaaccttgccgtgtcatactccggcaacggcaggcacatccttgtcatcacactaggttcggaatcggcggaaacccgcgcatcggacaacagcaagctgctgaaccgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaagaagcgaaaatggcagaacagattttggaaaccatacagccgattcccgccccggtaaaaaaagggcagattttaggaaaaatcaaaatcaggcaaaacggacataccattgccgaaaaagaaatcgtcgcactggaaaacgtagaaaaaagaagccggtggcaaaggctttggacgcgtctgacagggcag

SEQ ID NO: 3438 - protein, 441 aa, Neisseria gonorrhoeae
VFIIQCGIIGLLKSQNPKPYAQDGAKARKIRPIRHPKRIIGRLKHSHNLEYFMTAHKILPVLLPIILGVSHATAASPAPNRPTVHAAPTLQTPETLTAAHIVIDLQSRQTLSAKNTNTPVEPAALTQLMTAYLVFKNMKSGNIQSEENLKIPESAWASEGSRMFVRPGDTVSTDKLLKGMIALCANDAALTLADRLGNGSIENFVQQMNKEARRLGMKNTVFKNPTGLGREGQVSTAKDLSLLSEALMRDFPEYYPLFSIKSFKFENIEQNNRNILLYRDNNVNGLKAGHTESGGYNLAVSYSGNGRHILVITLGSESAETRASDNSKLLNRALQAFDTPKIYPKGKTVAQIQISGGSKKTVRAGFLKEAYITLPHKEAKMAEQILETIQPIPAPVKKGQILGKIKIRQNGHTIAEKEIVALENVEKRSRWQRLWTRLTGQ

SEQ ID NO: 3439 - DNA, 1899 bp, Neisseria gonorrhoeae
atgaccgcacgcataagccgtcctccttacctgaacgtgcaatgccgtctgaaaaggcttcagacggcatcggtatcggaaatgccattacggtttgacaccgttttcttccaaaagggcatcgattttcaagcgggctttttcctgcctcaaaccttgttccaactggtttctgaccaactcgaaaggctgcgcgtcggggtttttcccgaccgcgccgagtttgaacaggtaatagcgttcgcccaatttgaccggattgcgggtaacgtcgccacggttcataccggcaaactgcgaagccagcggctcgggaagctgctgcgccataatgaaaccgtcgaacgcctgctcgtcgttcggataacgcttcatcagcccttcaaaagacagccctttgagcaggagctgctgcgcctgacgcgcctcctcttcggttgcgaagctgacctgctgcaatttgatcatgcggatttgccgctcataaaactgacgcagtgcgctttcggaaaccgtttccgaacgttccagaaaacggacgtactcctcggcataaaaagacgcttcggcgattttaaagcggttttggacatccttatccttatccaaaccttccttcaatgccctgtttttcaaaacttccaaagtttgcagccggcggacggcatcgtttcggattgcctgcccgtccggtctttgggactgctccgcatgccggtctgcctgctgcatgatctgcgccaccagcgtatccaccaaagccgggtcgatttcgggtgctttggctgccgcaaaacctgccaacattgcagcaataactgcggcagcggtctttttctgtttcatggtattccctgtcctgcgcggcggcaaaacgcctgtatgaacgtcttgccgccgtatcccgttttcagattattttgcaggtttgatgtttgccttacccaacagcgcaccgacggcacggtcaatccgttccgcctgaaggttgccggcaatctgtcctttcatttcgtcaaaagaaggcactttcacctcgcggctgtcgttgacataataaacgccgtagaaatcgccgtttttcagcggcgttgccgtaaattcgccttttttcaagtccttaattgcctgataaagcggcggaacaccctgttccaaatctttcagcggcacatatccgtccggcgcgccggtccgtttggtgcggtcgttgagcgagtattgtttcaaaacggcatcaaaaccttttttcgccttcaaatcggcaaccgcttttttcgcattttcttccttgtcggtcaggatttcgcccaactggacttcctgcgtgcctttataaaaaccgctgatattgtcgtaaacggcttttacttcctgctcggaaaccggttgggttttggcgatatgcagtgcgtatgcctcgccgttcaagccatattttaccgcctgccaaacggttttgaaggacggtttcttgtcgtcgcccgactttttcgcttcggcacgcaatttggcaagcgcatctttaaactctgccgaccggtcgagtttcaggcgtttcacttcctgtgcgaccacggtgttgaccacttcgttttccagcagggattggcgcagttgcggcgtgtcttcggcacggctgttttccgcacggaatgcggcaacctgcgcatcgatgacggaactgtcgattttctgaccgttaacggttgccagcgtttgggcaaacaggctgccggaacaggcaagcagcgcaacggaagtcaggatttttgctttcataatcttctctctttaaattttaaattgaaatattcaggcagacttcattcagtccgccgtatggaaatactcgtcaggggtagccgcccggatgccgagcgcgtgaatcatgccgcc

SEQ ID NO: 3440 - protein, 633 aa, Neisseria gonorrhoeae
MTARISRPPYLNVQCRLKRLQTASVSEMPLRFDTVFFQKGIDFQAGFFLPQTLFQLVSDQLERLRVGVFPDRAEFEQVIAFAQFDRIAGNVATVHTGKLRSQRLGKLLRHNETVERLLVVRITLHQPFKRQPFEQELLRLTRLLFGCEADLLQFDHADLPLIKLTQCAFGNRFRTFQKTDVLLGIKRRFGDFKAVLDILILIQTFLQCPVFQNFQSLQPADGIVSDCLPVRSLGLLRMPVCLLHDLRHQRIHQSRVDFGCFGCRKTCQHCSNNCGSGLFLFHGIPCPARRQNACMNVLPPYPVFRLFCRFDVCLTQQRTDGTVNPFRLKVAGNLSFHFVKRRHFHLAAVVDIINAVEIAVFQRRCRKFAFFQVLNCLIKRRNTLFQIFQRHISVRRAGPFGAVVERVLFQNGIKTFFRLQIGNRFFRIFFLVGQDFAQLDFLRAFIKTADIVVNGFYFLLGNRLGFGDMQCVCLAVQAIFYRLPNGFEGRFLVVARLFRFGTQFGKRIFKLCRPVEFQAFHFLCDHGVDHFVFQQGLAQLRRVFGTAVFRTECGNLRIDDGTVDFLTVNGCQRLGKQAAGTGKQRNGSQDFCFHNLLSLNFKLKYSGRLHSVRRMEILVRGSRPDAERVNHAA

SEQ ID NO: 3441 - DNA, 501 bp, Neisseria gonorrhoeae
ctcgtcacgcgcgatggtggaagtgcgcttgattttttgttggagctgaatcaggccgtaaatcagagcttccgcagtcggcggacaacccggcacataaacgtccaccggcacgacacggtcggcaccgcgcacaacggaataagaatagtgataatagccgccgccgttggcacacgaacccatagacaatacccagcgcggctcggcgagctggtcgtacacgcgacgcagggctggcgccattttattggtcagcgtacctgccacaatcatcaggtcggcctgacgtggggacggacggaaaatgataccgaaacggtcaaggtcataacgcgccatacccgcatgcatcatttccacggcgcagcaggccaatccgaaagtaaccggccacaatgaaccggtacgcatatggttcaacaccgtatccgcgctggtggtgatgaaaccttttttcaaaacgccttctattcccattccagcgcaccttttttccat

SEQ ID NO: 3442 - protein, 133 aa, Neisseria gonorrhoeae
LVTRDGGSALDFLLELNQAVNQSFRSRRTTRHINVHRHDTVGTAHNGIRIVIIAAAVGTRTHRQYPARLGELVVHATQGWRHFIGQRTCHNHQVGLTWGRTENDTETVKVITRHTRMHHFHGAAGQSESNRPQ

SEQ ID NO: 3443 - DNA, 1524 bp, Neisseria gonorrhoeae
atgaacacgccccttccttattccgattacctcatccgcatcctgacggcatctgtctatgatgtagcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcacgcacaaggcgtggcgttgtccgcacagcgtttgggctgccgtgccgttatcgtcatgccggagactacgccgaaaattaaagtggatgcggttaaaagccgtggcggcgaggtggttttgcggggtgtttcatacaacgatgcctacgattatgcgatggagctggcggaacaggaagggctgacctatatcgcgccgtttgacgatcccgatgtgattgcgggacaggggacggtggggatggaaattgtcagccagcatcccgatccaatccgcgccgtattcgtaccgatagggggcggcggtttggcggcgggcgtggcggcatttatcaaacaggttcgtcccgaaattaaagttatcggcgtacagaccaacgattcctgctgtatgaagcagtcggtcgaagcaggcgaaatcgtccatttgaaagatgtcgggctgttttcagacggtacggcggtcaaagtcgtcggaaacggaaccttccgcctctgcaaagaacttttggatgaaatcattacagtcgataccgatgcggtttgcggcgcggtcaaggatattttcgatgacacgcgcagcattaccgagccggccggcgcgttggcgttggcgggtctgaaagcctatattgcccgagaaggtgcggaaaaccaaaccctgattgccgttaccagcggtgcgaatatgaattttcaccgtttgcgccacgtttcggaacggagcgaattgggcgagggcaacgaaggtatttttgccgttaccatccccgaagaacgcggcagcttccttaagtttgtcaatatattgggaaataggaatattaccgagttcaactaccgctacggcggcgatgaaaaagcgcatatctttgtcggacttcaagcggcaggcccgcaggatttggcggttatcggcagccggttggatgaggcgggattgcccaatgtcgatttgaccaataatgagattgccaaaatccatatccgctatatggtcggagggcggacggacaaagtagggcacgagcgtctggtcagttttgagtttccggagcgtccgggcgcgttggcgcgctttttgaaccatatgcagggcggttggaacattacgctcttccattaccgcaaccacggtgcggattacgggcggattttggtcggtatcgacgtgccgccgcacgatgccgccgcatttgacggtttcttggaaagtctgggatacagctatcacgaggaaacgcaaaatgccgcgtacaagctgtttcttgcc

SEQ ID NO: 3444 - protein, 508 aa, Neisseria gonorrhoeae
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSRGGEVVLRGVSYNDAYDYAMELAEQEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNGTFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGGDEKAHIFVGLQAAGPQDLAVIGSRLDEAGLPNVDLTNNEIAKIHIRYMVGGRTDKVGHERLVSFEFPERPGALARFLNHMQGGWNITLFHYRNHGADYGRILVGIDVPPHDAAAFDGFLESLGYSYHEETQNAAYKLFLA

SEQ ID NO: 3445 - DNA, 1074 bp, Neisseria gonorrhoeae
atgagtattaccattcaaaacttaaacaaaaaacgcttcggcaattttcacgcgctgaaaaacatcaacctcaacgtccccgccggcaaactcgtttccctgctcggtccctccggcggcggcaaaaccacacttttacgcattatcgccggactggaaaacgccgacggcggccaaattctctttgacggccaagacgtaaccgccaagcatgtgcgcgagcgcaaagtcggtttcgtgttccaacactacgccctcttccgccacatgaatgtgtttgacaacgtcgctttcggtttgaccgtattgcccaagcccgaacgcccgtccaaaggacaaatccgcgccaaagtcgaagaattgctcaaactcgtacaactctcccacctcgccaaatcctatccgcaccaactctccggcgggcaacgccagcgcatcgccctcgcccgcgcgcttgcggtcgaaccgaaactcctgcttttggacgaacccttcggcgcgctggatgccaaagtgcgcaaagaattacgcacctggctgcgcgacattcatcacaacctcggcgtaaccagcattctggtgactcacgaccaagaagaagccctcgaagtttccgacgaaatcgtcgtgatgaaccatggcaaaatcgaacaaaccggcagtgccgaagccatttaccgcaaacccgaaaacgccttcgttaccgagttcctcggcgaagccgacgcatttgaaggacgcatcgaaaaaggcatctggcattacaacggcttcgcgtggaaattggacgcgcaatacaaatggcaggagcaaaccgccaccggctatatccgcccgcacgaatggcagatcgccgccgaacacgaaaccccgatgatccgtgccgaaatcgaaaaaatccacgccgtcggcgcattgacgcacgttttggtgaaacacggcaaacaagacgtgcatatcacactggctggcagcgatgccgcgcgctacccaatcgccgaaggcaaaaaattaaacttaattccgaaacaggtttatgttttttctcaaaacgagttgattgaatattcgatt

SEQ ID NO: 3446 - protein, 358 aa, Neisseria gonorrhoeae
MSITIQNLNKKRFGNFHALKNINLNVPAGKLVSLLGPSGGGKTTLLRIIAGLENADGGQILFDGQDVTAKHVRERKVGFVFQHYALFRHMNVFDNVAFGLTVLPKPERPSKGQIRAKVEELLKLVQLSHLAKSYPHQLSGGQRQRIALARALAVEPKLLLLDEPFGALDAKVRKELRTWLRDIHHNLGVTSILVTHDQEEALEVSDEIVVMNHGKIEQTGSAEAIYRKPENAFVTEFLGEADAFEGRIEKGIWHYNGFAWKLDAQYKWQEQTATGYIRPHEWQIAAEHETPMIRAEIEKIHAVGALTHVLVKHGKQDVHITLAGSDAARYPIAEGKKLNLIPKQVYVFSQNELIEYSI

SEQ ID NO: 3447 - DNA, 768 bp, Neisseria gonorrhoeae
atgttgctgattgccgccgcgctgggctttctgctgctgatgctggtcgtgccgctcgtcgccgtgttttacgaagccttaaaaggcggttgggatttgtacctgaaatccttaagcgatcccgaagcgtggtctgccgtcaaattgacgctgattaccgcgctgattgtcgttcccgtcaatgccgtcttgggcgtggcgatggcgtggctgttgacccgttttgactttctcggcaagcagttgctgaccaccctgctcgatttgccgttctccgtatcgcccgtggttgccggtttgatgttcgtcttattgttcggcgcgcacacggcgttgggcagccggctggaagcgcaaggcatacagattatcttcgccattcccggcattgttttgacggcgctgttcgttacctttccctttgccgcacgcgaaatcatccctttaatgcagacacagggcgacagcgaagaacaggcggcattggtactcggcgcaagcggttggcagatgttttggcgcgttaccctgcccaacatcaaatggacgctgctctacggcatcatcctcaccaacgcccgtgcgatgggcgagttcggcgcggtcagcgtggtatcgggacacatacgcggcgaaaccaacactatcccgcttttggtcgaaatcttctacaacgaatacaacttcaccggcgcattctccctctccggcgtattggcacttttagcactggcgacgctggcggtgcagaacatcatcaccaaatta

SEQ ID NO: 3448 - protein, 256 aa, Neisseria gonorrhoeae
MLLIAAALGFLLLMLVVPLVAVFYEALKGGWDLYLKSLSDPEAWSAVKLTLITALIVVPVNAVLGVAMAWLLTRFDFLGKQLLTTLLDLPFSVSPVVAGLMFVLLFGAHTALGSRLEAQGIQIIFAIPGIVLTALFVTFPFAAREIIPLMQTQGDSEEQAALVLGASGWQMFWRVTLPNIKWTLLYGIILTNARAMGEFGAVSVVSGHIRGETNTIPLLVEIFYNEYNFTGAFSLSGVLALLALATLAVQNIITKL

SEQ ID NO: 3449 - DNA, 762 bp, Neisseria gonorrhoeae
gtgcctgtcgcttctggtggttttgccgtttgcgatgatggcggcggaaatcggctggggcggctttcggaacacgattgccgagccgaacgtgctggcggcggtgcggctgagtttgcggatgtcgttttatgcgatgctgaccaatgtgtcgtgttcggcacactggtggcttgggtgttggtgcgctatgaatttccgggcaaggacctggcgaacgcgctggttgatttgccgtttgcgctgccgacggcggttacgggtatcgcgttggcggccctgtatgcgcccaacggttggataggccgttttttcgaacctttgggcatcaaaatcgcgtttacgcccgtcggcatttggattgcgctggttgtcgtcagcctgccctttatcgtccgcgccgtgcagccggtattggaggaattgtcgggcgaatatgaggaagcggcggcgactttgggcgcaaaccgtttcacaacgttccgccgcgtgctgctgccggaaatcacgccggcactcttgaccggcgcgggcatgatgttcgcgcgggcaacgggggaatacggttcggtgatttttatcgcgggcagcattccgatgatttccgaaatcctgccgctgattattacgggcaagctggaacaattcgacgtgcagggcgcgtcggcggtggcgttgtttatgctgctggtttcgtttgtgattctgtttgcgctgaacgtgctgcagtgggcgttgggcaggcgttcgggtgcgaagggt

SEQ ID NO: 3450 - protein, 254 aa, Neisseria gonorrhoeae
VPVASGGFAVCDDGGGNRLGRLSEHDCRAERAGGGAAEFADVVLCDADQCVVFGTLVAWVLVRYEFPGKDLANALVDLPFALPTAVTGIALAALYAPNGWIGRFFEPLGIKIAFTPVGIWIALVVVSLPFIVRAVQPVLEELSGEYEEAAATLGANRFTTFRRVLLPEITPALLTGAGMMFARATGEYGSVIFIAGSIPMISEILPLIITGKLEQFDVQGASAVALFMLLVSFVILFALNVLQWALGRRSGAKG

SEQ ID NO: 3451 - DNA, 2211 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctt

SEQ ID NO: 3452 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 3453 - DNA, 378 bp, Neisseria gonorrhoeae
ttcccattccagcgcaccttttttccattcgtaaacaaagcctaccgtcaggacgacgataaacaccagcatagaccaaaagccgtacgcgcccaaatctttgaacacgactgcccacggcagcataaacgcaacctccaaatcgaagaggatgaacaggatgtcgacgaggtaatagcgcacgtcgaacttcatccttgcgttttcaaaggattcaaaaccgcatttgtaaggcgcgtctttttcggcatagtggcgtttcgggcccaaaatcgtgccgagcaggataaacagtacgccggccgcgaggccgacgaggataaagacaaagacgggaaaataagcggacaacatggttacacccaaatccgttaacaa

SEQ ID NO: 3454 - protein, 124 aa, Neisseria gonorrhoeae
FPFQRTFFPFVNKAYRQDDDKHQHRPKAVRAQIFEHDCPRQHKRNLQIEEDEQDVDEVIAHVELHPCVFKGFKTAFVRRVFFGIVAFRAQNRAEQDKQYAGREADEDKDKDGKISGQHGYTQIR

SEQ ID NO: 3455 - DNA, 276 bp, Neisseria gonorrhoeae
atgccggctgtcgatttgatccgcgaacgcctgcagacgctcgatcctctggtgttggaaatcggcgatgagagccatctgcacaaaggacacgcgggcaataccggcggcggacattatgccgttttggtcgtcagcggccgttttgaaggtttaagccgtctgaaccgtcagaaaacggtcaaatcgctgctcaaagatttattttcaggcggcatgattcacgcgctcggcatccgggcggctacccctgacgagtatttccatacggcggac

SEQ ID NO: 3456 - protein, 92 aa, Neisseria gonorrhoeae
MPAVDLIRERLQTLDPLVLEIGDESHLHKGHAGNTGGGHYAVLVVSGRFEGLSRLNRQKTVKSLLKDLFSGGMIHALGIRAATPDEYFHTAD

SEQ ID NO: 3457 - DNA, 93 bp, Neisseria gonorrhoeae
atgccgcctgaaaaacggaaaaaatggaaagtttggtgcaaagacgaatttgttataaagcggttggcagtttttcaagcgggcgcgatgttc

SEQ ID NO: 3458 - protein, 31 aa, Neisseria gonorrhoeae
MPPEKRKKWKVWCKDEFVIKRLAVFQAGAMF

SEQ ID NO: 3459 - DNA, 330 bp, Neisseria gonorrhoeae
atgcagattttatcttttcaggcggacattgcggaacgtatgctggaaggtacggaaggcgagtcggtcaacgaaaacgcacaatttgtccgtacggacaacggctattggattgcgtggcatgaaggcgtggcggcactgcttgcgcccgatacgccgccgggcattccctgtttttgggtggaaggggcggaaagccttgaagagttgtgcgcgatggtggaacgcggcgagtttgacgaagtggaagagtttgacggcgatgacgacgcgtggctcgaagcggctaaagattgcggacaccacggcgacgcttgcgcctgcggacat

SEQ ID NO: 3460 - protein, 110 aa, Neisseria gonorrhoeae
MQILSFQADIAERMLEGTEGESVNENAQFVRTDNGYWIAWHEGVAALLAPDTPPGIPCFWVEGAESLEELCAMVERGEFDEVEEFDGDDDAWLEAAKDCGHHGDACACGH

SEQ ID NO: 3461 - DNA, 327 bp, Neisseria gonorrhoeae
atgcctttaatgtccgcaggcgcaagcgtcgccgtggtgtccgcaatctttagccgcttcgagccacgcgtcgtcatcgccgtcaaactcttccacttcgtcaaactcgccgcgttccaccatcgcgcacaactcttcaaggctttccgccccttccacccaaaaacagggaatgcccggcggcgtatcgggcgcaagcagtgccgccacgccttcatgccacgcaatccaatagccgttgtccgtacggacaaattgtgcgttttcgttgaccgactcgccttccgtaccttccagcatacgttccgcaatgtccgcctgaaaaga

SEQ ID NO: 3462 - protein, 109 aa, Neisseria gonorrhoeae
MPLMSAGASVAVVSAIFSRFEPRVVIAVKLFHFVKLAAFHHRAQLFKAFRPFHPKTGNARRRIGRKQCRHAFMPRNPIAVVRTDKLCVFVDRLAFRTFQHTFRNVRLKR

SEQ ID NO: 3463 - DNA, 411 bp, Neisseria gonorrhoeae
ttgacggaaaaccatcatataaaggaacacttatgcagattttatcttttcaggcggacattgcggaacgtatgctggaaggtacggaaggcgagtcggtcaacgaaaacgcacaatttgtccgtacggacaacggctattggattgcgtggcatgaaggcgtggcggcactgcttgcgcccgatacgccgccgggcattccctgtttttgggtggaaggggcggaaagccttgaagagttgtgcgcgatggtggaacgcggcgagtttgacgaagtggaagagtttgacggcgatgacgacgcgtggctcgaagcggctaaagattgcggacaccacggcgacgcttgcgcctgcggacattaaaggcatggcaggcttgccgcaaggggtgcaaggctttgccgttttt

SEQ ID NO: 3464 - protein, 137 aa, Neisseria gonorrhoeae
LTENHHIKEHLCRFYLFRRTLRNVCWKVRKASRSTKTHNLSVRTTAIGLRGMKAWRHCLRPIRRRAFPVFGWKGRKALKSCARWWNAASLTKWKSLTAMTTRGSKRLKIADTTATLAPADIKGMAGLPQGVQGFAVF

SEQ ID NO: 3465 - DNA, 147 bp, Neisseria gonorrhoeae
ttgaataaaaattatcttggtattataataaggcagcatcaattattttgggactgcaacaaacgcaaagcattgatttgcgtttgttgcaaacttattattatagcaggttgcggcgcggacttaatgggaattgtttatagagca

SEQ ID NO: 3466 - protein, 49 aa, Neisseria gonorrhoeae
LNKNYLGIIIRQHQLFWDCNKRKALICVCCKLIIIAGCGADLMGIVYRA

SEQ ID NO: 3467 - DNA, 507 bp, Neisseria gonorrhoeae
atgacaatgattttaagcattttaagcctgttttttatcattagactgttatttttagccgtctctattaaacatgaaaaagccttgattgccaaaggggcgaaacaatacggaaaaaccaattccacggtgcttgcggcagttcatacgctttattatttggcgtgttttgtttgggtatggctttctgacactgcttttaatggcatatccttgattggtacactgacggtgatggcttcatttgtgatattatcattgattattaagcagttgggggagatttggacggttaaaatctatattttgccaaatcatcaaattaatcgttcgtggttgtttaaaacattccgccacccgaattattttttaaacatcatacccgaactgattggcatcgccttattatgtcaagcgtggtatgttttattgattggcctgcccatttatttgctggtcttatttaagcgtatccgacaagaagaacaggcgatggcaacacttttt

SEQ ID NO: 3468 - protein, 169 aa, Neisseria gonorrhoeae
MTMILSILSLFFIIRLLFLAVSIKHEKALIAKGAKQYGKTNSTVLAAVHTLYYLACFVWVWLSDTAFNGISLIGTLTVMASFVILSLIIKQLGEIWTVKIYILPNHQINRSWLFKTFRHPNYFLNIIPELIGIALLCQAWYVLLIGLPIYLLVLFKRIRQEEQAMATLF

SEQ ID NO: 3469 - DNA, 390 bp, Neisseria gonorrhoeae
gtgttcaacaacgcggctcaaacttggaaccacaccttctactggctgggtttcacgcccaaaggccaaggcaaaccttccggcgaactggccgccgccatcgatgccgaatggggcagcttcgagaaattccaagaagcgttcaatgcctgcgcggccggaactttcggatccggttgggcgtggctggtaaaaacccctgccggcggattggctttggtttccacttccaacgcggcaactccgctgaccactgaaaacacgccgctcttgacttgcgacgtgtgggaacacgcctactacatcgactaccgcaacagccgccccaactacctggaaggtttttgggaaatcgtcaactgggacgaagtcgccaaacgttttgccgca

SEQ ID NO: 3470 - protein, 130 aa, Neisseria gonorrhoeae
VFNNAAQTWNHTFYWLGFTPKGQGKPSGELAAAIDAEWGSFEKFQEAFNACAAGTFGSGWAWLVKTPAGGLALVSTSNAATPLTTENTPLLTCDVWEHAYYIDYRNSRPNYLEGFWEIVNWDEVAKRFAA

SEQ ID NO: 3471 - DNA, 126 bp, Neisseria gonorrhoeae
atggttacacccaaatccgttaacaaaatttctacaataatttcgtattttagcgaatttcaaaaaccattaaaaggtaaatatcggcaaaacgcccaaaaaaacccaataaatacaatcatgtta

SEQ ID NO: 3472 - protein, 42 aa, Neisseria gonorrhoeae
MVTPKSVNKISTIISYFSEFQKPLKGKYRQNAQKNPINTIML

SEQ ID NO: 3473 - DNA, 402 bp, Neisseria gonorrhoeae
ttgtccccgcatctgagcaaagagactttggaattccactacggcaaacaccatcaaacctacatcaccaacctgaacaatcaaatcaaaggcaccgaatttgaaaacctgcctttggaagagattgtgaaaaaaatcttcgggcggcgtgttcaacaacgcggctcaaacttggaaccacaccttctactggctgggtttcacgcccaaaggccaaggcaaaccttccggcgaactggccgccgccatcgatgccgaatggggcagcttcgagaaattccaagaagcgttcaatgcctgcgcggccggaactttcggatccggttgggcgtggctggtaaaaacccctgccggcggattggctttggtttccacttccaacgcggcaactccgctgaccac

SEQ ID NO: 3474 - protein, 134 aa, Neisseria gonorrhoeae
LSPHLSKETLEFHYGKHHQTYITNLNNQIKGTEFENLPLEEIVKKIFGRRVQQRGSNLEPHLLLAGFHAQRPRQTFRRTGRRHRCRMGQLREIPRSVQCLRGRNFRIRLGVAGKNPCRRIGFGFHFQRGNSADH

SEQ ID NO: 3475 - DNA, 243 bp, Neisseria gonorrhoeae
atgcggggacaatgcgtccggctcataaggcagttgcggcagcttatgttccattttgtgctcctaatgttgtttttggatgttgtgttttggcagtgttgctgcaaacgaatcggcggctcacgcattctacctgttttgagtgatggaaaccaattaaacctgctttgcgttataatagaagattgcaatttcggcatgacagattggatgtaccatgaacgattacgcagctatgccgcc

SEQ ID NO: 3476 - protein, 81 aa, Neisseria gonorrhoeae
MRGQCVRLIRQLRQLMFHFVLLMLFLDVVFWQCCCKRIGGSRILPVLSDGNQLNLLCVIIEDCNFGMTDWMYHERLRSYAA

SEQ ID NO: 3477 - DNA, 1404 bp, Neisseria gonorrhoeae
atgaacgattacgcagctatgccgcctgaaggccgtgaggtcggcgcattgtcgctgcctccgcattcgatggaggcggaacaatccgttttgggcggtttgatgctggaaaatccggcttgggacaggattgccgatgtggtttcgggagaggatttctaccgccacgaacaccgcctgattttccgatccattgccaaattaatcaatgagggccgtcccgcagatgtgattacggttcaggaagatttgcagcggaacgaagaattggaagcggcaggcggatttgaatatctgattacactggcgcaaaacaccccgtctgccgcaaacatccgccgctacgccgaaatcgtacgcgagcgttccattatgcgccaactcgccgaagtggggacggaaatcgcccgcagcgcatacaatccgcaaggcagggacgcggggcggcttttggatgaggcggaaaacaaagtgtttcaaatcgccgaaagcaccgccaaatccaagcagggctttttggagatgcccgatttgctgaaagaagtcgtacagcgcatcgatatgctttattcgcgcgacaatcccgatgaagttaccggcgtaccgacagggttcatcgaccttgataaaaaaacctcgggtctgcagcccggcgacctgattatcgtcgccggccgcccgtctatgggtaaaaccgcgttctccatcaatattgccgagtatgtcgccattgaaaaacatttgcccgtcgccgttttctcgatggaaatgggcggtgcgcagttggtcatgcgtatgctcggctcggtcggacggctggatcaaagcgttttgaaaaccggcaggctcgaagacgaacactggggccgtctgaacgaagcagtcgtcaaactctcagacgcgcccgtgtacatcgacgagaccccgggcctgactgcgctcgaactgcgcgcccgcgcccgtcgtctcgcccgtcaatttaacaataagctgggattaatcgtcattgactacctgcaactgatggcggcatccggccgttcggacaaccgcgcttccgagcttggcgaaatttcccgttccctcaaagccctggcaaaagagttgcaagtccccatcatcgccctgtcgcaattgagccgcactgtcgaacagcgcaccgacaaacgcccgatgatgtccgacctccgcgaatccggtgctatcgagcaggatgccgacctgattatgttcatgtaccgcgacgaatactacaaccaggactcacccatgaaaggccttgccgaatgtatcatcggcaaacaccgcaacggtcccgtcggtaaaatcttcctcacatggacgggacaattcaccaaattcgacaatgctgcctatattcccgaggaggcaaagatagaagat

SEQ ID NO: 3478 - protein, 468 aa, Neisseria gonorrhoeae
MNDYAAMPPEGREVGALSLPPHSMEAEQSVLGGLMLENPAWDRIADVVSGEDFYRHEHRLIFRSIAKLINEGRPADVITVQEDLQRNEELEAAGGFEYLITLAQNTPSAANIRRYAEIVRERSIMRQLAEVGTEIARSAYNPQGRDAGRLLDEAENKVFQIAESTAKSKQGFLEMPDLLKEVVQRIDMLYSRDNPDEVTGVPTGFIDLDKKTSGLQPGDLIIVAGRPSMGKTAFSINIAEYVAIEKHLPVAVFSMEMGGAQLVMRMLGSVGRLDQSVLKTGRLEDEHWGRLNEAVVKLSDAPVYIDETPGLTALELRARARRLARQFNNKLGLIVIDYLQLMAASGRSDNRASELGEISRSLKALAKELQVPIIALSQLSRTVEQRTDKRPMMSDLRESGAIEQDADLIMFMYRDEYYNQDSPMKGLAECIIGKHRNGPVGKIFLTWTGQFTKFDNAAYIPEEAKIED

SEQ ID NO: 3479 - DNA, 708 bp, Neisseria gonorrhoeae
ttgaatttaatccactatacattaccaattaacgtcctattgcttatgtgtacacgaaaacaacaaggtttcacgctaacagagctgctcatcgtgatggccattgcagccattatggcgacgatagccctccccaatatgagtgggtggattgcatcacgccgcattgccagtcacgcggagcaggttgccaaccttttgcgtttttccaggggcgaagccgtccggctcaatctccctgtctatatctgtcctgttcaagttaaaaaagacggtgcgtccaacaatagatgtgacttcagcaagaaggggtggggaatgttggctttcggcgacaaaaacggcaataaggaatatgacggcgatgtggcggatgttttcctccgcagcgtggtattgaatgatgatatcaatgataagcggattgattatgccttcaaccatatcgctttcggttcgtctcagccgaccgccgaccgtgtagtttggacgttcaatcaaaacgggacgttcggttatacgacagaccagcatcttacagagcgatccagctttttttattccgacggttatatccaaatcgtgctgacagatgcgagagcagtttcagatgccgataggaaattccgttcggcggtggttttgattgacagcagcggcagggtcgaagtttgtcgtaaaaacgatacgcgcgccgtatgcaaacat

SEQ ID NO: 3480 - protein, 236 aa, Neisseria gonorrhoeae
LNLIHYTLPINVLLLMCTRKQQGFTLTELLIVMAIAAIMATIALPNMSGWIASRRIASHAEQVANLLRFSRGEAVRLNLPVYICPVQVKKDGASNNRCDFSKKGWGMLAFGDKNGNKEYDGDVADVFLRSVVLNDDINDKRIDYAFNHIAFGSSQPTADRVVWTFNQNGTFGYTTDQHLTERSSFFYSDGYIQIVLTDARAVSDADRKFRSAVVLIDSSGRVEVCRKNDTRAVCKH

SEQ ID NO: 3481 - DNA, 609 bp, Neisseria gonorrhoeae
atgaagaataatgattgcttgcgcctgaaaaatccccagtccggtatggcgttgatagaagtcttggtcgctatgctcgttctgaccatcggtattttggcattgctgtccgtacagttgcggacagtcgcttccgtcagggaggcggaaacgcaaaccatcgtcagccaaatcacgcaaaacctgatggaaggaatgttgatgaatccgaccattgatttggacagcaacaagaaaaactatagtctttacatgggaaaacagacactatcagctgtggatggtgagtttatgcttgatgccgagaaaagtaaggcgcagttggcagaggaacaattgaagagatttagtcatgagctgaaaaatgccttgccggatgcggtagctattcattacgccgtctgcaaggattcgtcgggtgacgcgccgacattgtccgacagcggtgctttttcttcaaattgcgacaataaggcaaacggggatactttgattaaagtattgtgggtaaatgattcggcaggggattcggatatttcccgtacgaatcttgaagtgagcggcgacaatatcgtatatacctatcaggcaagggtcggaggtcgtgaa

SEQ ID NO: 3482 - protein, 203 aa, Neisseria gonorrhoeae
MKNNDCLRLKNPQSGMALIEVLVAMLVLTIGILALLSVQLRTVASVREAETQTIVSQITQNLMEGMLMNPTIDLDSNKKNYSLYMGKQTLSAVDGEFMLDAEKSKAQLAEEQLKRFSHELKNALPDAVAIHYAVCKDSSGDAPTLSDSGAFSSNCDNKANGDTLIKVLWVNDSAGDSDISRTNLEVSGDNIVYTYQARVGGRE

SEQ ID NO: 3483 - DNA, 966 bp, Neisseria gonorrhoeae
atgctaaacgtaccaaagggcggttatgatggtatgaagggttttaccattgttgaatttctggttgcgggcctgctcagtataattgtcctgatagcggtcgtatcgagttactttacatcccggaaattaaatgatgtggcaaacgagcgtcttgccattcaacaggatttgcggaatgcggcaacattaattgtccgcgatgcaagaatggcggggagcttcggttgtttcaatatgtccgagcatactaaagacgatattgttgattcaagtaatcaaactcaatctaaccttgcaaaacccggtgccaaacaagaaaatccccttttttccttaaaaaggagcggcatggataaacaactgattcccgttgctgaatccatagatattaaatatccgggttttatccagcgccttaacgcattggttttccaatacggtatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcagaaacatgtggtcaatgcctatgcggtcggcaggtttggcaataatgaggaaagtttgttccgcttccaattggatgataagggcaagtggggtaatcctcagttgctcgtgaaaaaggttaaacgtatggatgtgcggtatatttatgtttccggttgtcctgaagatgaagatgccggcaaagaggaaaaattcagatatacgaataaattcgacaaatccaaaaatgctgttacgcctgccggggtggaggttttattggatagcggccttaatgccaagattgccgcttcttcagacaatagtatttatgcttaccgtatcaatgcgacaatacgcgggggaaatgtatgcgcaaacagaacactt

SEQ ID NO: 3484 - protein, 322 aa, Neisseria gonorrhoeae
MLNVPKGGYDGMKGFTIVEFLVAGLLSIIVLIAVVSSYFTSRKLNDVANERLAIQQDLRNAATLIVRDARMAGSFGCFNMSEHTKDDIVDSSNQTQSNLAKPGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 3485 - DNA, 1524 bp, Neisseria gonorrhoeae
aatccctctgccgtatttgtattctacaatcatattatcgtcagtaatgacttccgccccagccgaaggttccgtcatccgaatcagcatacgagagacaaccttttgtgctgcagcatccacggtgctgctgtcaaatacgtgcctgccgctttccggccaaatcaaccgggaaaggcgttgcttgagcagttctttattagggaaaactaccggggttgccgagccgactaccatatgcccgtagcggtatgcatagggaatactgtgtacggcggtagcaaaagcatgcgggctgtgcgtggtattaaacattacaataccatccggggtaaggtggctttgcacctgttttaaaaattccgcactcaacaggttagtggaataggcacgccagtaccaagtcgaattcatcaaaatcaggtcgaatttttcatcaggatggcgacgcagccatttcctaccgtcatccaatacaatttcaacacgtttgtcctgcaaaagcggtgcgatttgcggctcgtccgcgataaggctacggtatgccggattgatttccgcaacgatcatcgactgcatttccggaatggcagacaagacgcgcgcccacgaacctgtactcaatccaacgacgaaaatgcggcgtatgccggacttcagggagggtagcagataggcacgttcgatgccgttgacactattgaatatatcggtattgtatgcgccgtcgtatacattcgccccataaacaaccttatcaccatctctatggtaaaccgcaacaatgccgtgtttgttttcaatcaacctatccggacggccagcaatattttgaaagacagaatccggcagtaggaacatgaggatgccgaacattagggaaactgctaccgacactgcattcagtcggagacttttttggaacagtgtacaaaacaaagggacagcagcagaaatcaaacagatgagcaggtaaatctgttgggtggacaagaaatcaagtatcacaaagccgataaggaccggacccaatgcactgccggcaacgttggcgaaataaacattggaaacctgtcgtccggatttgttgccatccgtacccacatggtgtacaagtgggaaaatcaaccccctgacgacggcagacagggtaatgaagataccggcgtggtggacgaagccggaaaaacccgtcaacaaccacgcagcacccaaaatcaaaaaatcggcaatacccgcccacaagaagcactgcccgataaagggaatatcaacaaagcggctgcggcaaatccgtttgccaaaatacgcgccgacggcgataccggtcagaaaacaggcaagagtaaatgaaaatgcctgaggcacggactgtgctgcgaacgaaaacatccttacccacaagacttctatacccaagctcaataatccgctaaggaaagaaagcatataaatcaaactagtattcggtttagtgttcaccatatccatcctttctgtaacgcagccatactgaagcagcaa

SEQ ID NO: 3486 - protein, 118 aa, Neisseria gonorrhoeae
NPSAVFVFYNHIIVSNDFRPSRRFRHPNQHTRDNLLCCSIHGAAVKYVPAAFRPNQPGKALLEQFFIRENYRGCRADYHMPVAVCIGNTVYGGSKSMRAVRGIKHYNTIRGKVALHLF

SEQ ID NO: 3487 - DNA, 375 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaa

SEQ ID NO: 3488 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 3489 - DNA, 294 bp, Neisseria gonorrhoeae
ttgactgtggaatattttatgttgctggcaacagacggggaggatgtgcatgaagcgcgtatggcggcacgtcccgaacactttaaacggctggaaacgctgaaatcggaaggccgtctgctgacggcaggcccaaacctgctgccggacaatcccgaacgtgtttcgggcagcttgattgtggcacagttcgagtctttggatgcggcgcaggcttgggctgaagacgatccctatgttcatgccggcgtgtacagcgaagtgctgatcaagccgtttaaagcggtgttcaaa

SEQ ID NO: 3490 - protein, 98 aa, Neisseria gonorrhoeae
LTVEYFMLLATDGEDVHEARMAARPEHFKRLETLKSEGRLLTAGPNLLPDNPERVSGSLIVAQFESLDAAQAWAEDDPYVHAGVYSEVLIKPFKAVFK

SEQ ID NO: 3491 - DNA, 609 bp, Neisseria gonorrhoeae
atgcgcaaacagaacactttgacaggaatcccgacttctgacggacagagggggtccgcactgtttatcgtgctgatggtgatgatagtcgtggcctttttggttgtaactgccgcccagtcctacaataccgaacagaggatcagtgccaacgaatcagacaggaaattggctttgtctttagccgaggcggctttgcgggagggcgaatttcaggttttggatttggaatatgctgcggacagtaaggttacgtttagcgaaaactgtgaaaaaggtctgtgtaccgcagtgaatgtgcggacaaataataatggtagtgaagaggcttttggcaatatcgtggtgcaaggcaagcccgccgttgaggcggtgaagcgttcttgccctgcaaagtctggcaaaaattctaccgacctgtgcattgacaataaagggatggaatataataaaggcgcggcaggcgtcagcaaaatgccgcgctatattatcgaatatttaggcgtgaagaacggacaaaatgtttatcgggttactgccaaggcttggggtaagaatgccaataccgtggtcgtccttcaatcttatgtaggcaataatgatgagcaa

SEQ ID NO: 3492 - protein, 203 aa, Neisseria gonorrhoeae
MRKQNTLTGIPTSDGQRGSALFIVLMVMIVVAFLVVTAAQSYNTEQRISANESDRKLALSLAEAALREGEFQVLDLEYAADSKVTFSENCEKGLCTAVNVRTNNNGSEEAFGNIVVQGKPAVEAVKRSCPAKSGKNSTDLCIDNKGMEYNKGAAGVSKMPRYIIEYLGVKNGQNVYRVTAKAWGKNANTVVVLQSYVGNNDEQ

SEQ ID NO: 3493 - DNA, 486 bp, Neisseria gonorrhoeae
atgatgagcaataaaatggaacaaaaagggtttacattgattgagatgatgatagttgtcacgatactcggcatcatcagcgtcattgccataccttcttatcagagttatattgaaaaaggctatcagtcccagctttatacggagatggtcggtatcaacaatgttctcaaacagtttattttgaaaaatccccaggacgataatgataccctcaagagcaaactgaaaatatttgtctcaggctataagatgaatccgaaaattgccaaaaaatatagtgtttcggtaaggtttgtcgatgcggaaaaaccaagggcatacaggttggtcggcgttccgaacgcggggacgggttatactttgtcggtatggatgaacagcgtgggcgacggatacaaatgccgtgatgccacttctgcccaggcctattcggacaccttgtccgcagatagcggctgtgaagctttctctaatcgtaaaaaa

SEQ ID NO: 3494 - protein, 162 aa, Neisseria gonorrhoeae
MMSNKMEQKGFTLIEMMIVVTILGIISVIAIPSYQSYIEKGYQSQLYTEMVGINNVLKQFILKNPQDDNDTLKSKLKIFVSGYKMNPKIAKKYSVSVRFVDAEKPRAYRLVGVPNAGTGYTLSVWMNSVGDGYKCRDATSAQAYSDTLSADSGCEAFSNRKK

SEQ ID NO: 3495 - DNA, 231 bp, Neisseria gonorrhoeae
gtgaagctttctctaatcgtaaaaaatagggctgttttgccaatgccgtctgaagatcaattttcagacggtattttttatgggcattttgaaatgaattatgccatcaaccatcccgagatgcctgacgagccgacccctatcaatacggtaaacaacatagaaaaacggcaggccgcaaaggcggttaacgcgatggcaataagttcgtgcggcttgtcggatacaaaa

SEQ ID NO: 3496 - protein, 77 aa, Neisseria gonorrhoeae
VKLSLIVKNRAVLPMPSEDQFSDGIFYGHFEMNYAINHPEMPDEPTPINTVNNIEKRQAAKAVNAMAISSCGLSDTK

SEQ ID NO: 3497 - DNA, 306 bp, Neisseria gonorrhoeae; identical to SEQ ID NO: 255

SEQ ID NO: 3498 - protein, 102 aa, Neisseria gonorrhoeae; identical to SEQ ID NO: 256

SEQ ID NO: 3499 - DNA, 150 bp, Neisseria gonorrhoeae
atgatggggacgacaataaatctttcatttccgcccactccaaaaataagcggacaacaggccggacagcgtgccggcgggaacataccacgcgccgtcaacggtcaggtaaacggcggatgcgacaaacaggttgacaaatcaaggtat

SEQ ID NO: 3500 - protein, 50 aa, Neisseria gonorrhoeae
MMGTTINLSFPPTPKISGQQAGQRAGGNIPRAVNGQVNGGCDKQVDKSRY

SEQ ID NO: 3501 - DNA, 237 bp, Neisseria gonorrhoeae
atggcattctccgaaatccaaaaacggaaagcagccggtttgcctgcattcaatatgcctttttatatgggcgcatgctttatcttctacattacttggataggttttgccgcattccgcgcggcagtagcgcccatgttcggcaacgtggcagcttggggtttcggcatggcgtttcctgccgtatttctggttttactgaggggaatgtggaaaaatctttccgcatcaatacct

SEQ ID NO: 3502 - protein, 79 aa, Neisseria gonorrhoeae
MAFSEIQKRKAAGLPAFNMPFYMGACFIFYITWIGFAAFRAAVAPMFGNVAAWGFGMAFPAVFLVLLRGMWKNLSASIP

SEQ ID NO: 3503 - DNA, 240 bp, Neisseria gonorrhoeae
gtggcaaattcggagccgccggcaaagttcatccccgtcatcagcagcatttccagccggcccatacctttttgcccgccctgcataccgagtatcaatgcccaaggcaaaagcccaatcagcatgggcgaactttcttttatgccgcgtatgaattcatcacgtggagaggctgtgtgcgtcatgttaatgtttatatatgaagagacggggcggtatcatacacaggcagaatgtttt

SEQ ID NO: 3504 - protein, 80 aa, Neisseria gonorrhoeae
VANSEPPAKFIPVISSISSRPIPFCPPCIPSINAQGKSPISMGELSFMPRMNSSRGEAVCVMLMFIYEETGRYHTQAECF

SEQ ID NO: 3505 - DNA, 633 bp, Neisseria gonorrhoeae
gtgttcaccatatccatcctttctgtaacgcagccatactgaagcagcaatcagaaggttaaggcaggctgtcagcgcaatggtttgggagagggtaaaaaagacgtagaaaaattcggcggcggcaagcgatccgagtgccgcacccaaagtgttgaaaaaatataaggtaccgatagactcgccaacattatgtattttccggttaaaaaaacaggtcagcaagggcaaggtcgcgcccatcataaaggtaggaagcagcaataagaggaaattggcagcagcgatgatgggcaaatcagcctcaactaaaagatgccccaagccggaaatcagacccttgcttaccaaaccgaacagaccgatggatacttcagcgatgcaaaacagggggatgatacttgaaggaaaacggtcagcaatgcgtccgccgaaatacgcacctacacccaagccgaccataaatacagaaataatgacagtaatcgaactcaaatcgatacctatgtggctgaatagaagcctctgccagctgacctggtaaatcagggcgcagaagccagaggcgaaaaacaccagcgacaatcctttcagggttttacttgcggtcgaattcatattttctattttcaa

SEQ ID NO: 3506 - protein, 13 aa, Neisseria gonorrhoeae
VFTISILSVTQPY

SEQ ID NO: 3507 - DNA, 453 bp, Neisseria gonorrhoeae
atggtcgacgcggtcgttaaaactcccgaatttttaccttttacttctgtaggaatattccgttttggtgctgatataacacagtacaaaaacatactggaaacttttatgtatgaacctcctgatgagtttggaacagaatattatgaatctcccgactcaaatttactcatttccgtcgaaaaaaacaaaattatttcgatattttgttatcaggagttatattttatgggcgttaatataataggtctgaattttgaagattttaaacagcttttccatcaccctaaatcatacggtgttgataaatattatttatcaaatgaatcttatccgacatatgtctatgagtttgatgaaataggagtacaagcatgggaagcaaaagggaaaattgttactatcattgccgggggcaaagacaattattcgacagaaccttactacgatgaa

SEQ ID NO: 3508 - protein, 151 aa, Neisseria gonorrhoeae
MVDAVVKTPEFLPFTSVGIFRFGADITQYKNILETFMYEPPDEFGTEYYESPDSNLLISVEKNKIISIFCYQELYFMGVNIIGLNFEDFKQLFHHPKSYGVDKYYLSNESYPTYVYEFDEIGVQAWEAKGKIVTIIAGGKDNYSTEPYYDE

SEQ ID NO: 3509 - DNA, 546 bp, Neisseria gonorrhoeae
ttgctttctcatttggatatgaaatttgtcagcgaccttttgtccgtcatcttgttttttgctacttataccgttaccaaaaatatgattgccgctgcggcggttgccttggttgcaggcgtggttcaggcggctttcctgtattggaagcataaaaggctggatacgatgcagtgggtcggactggtgctgattgtcgtattcggcggcgcaaccattgttttgggcgacagccgcttcattatgtggaagccgacagtattgttctggtgcggggcgttattcctgctgggcagccaccttgcgggtaaaaacggcttgaaagcgagtatcggcagggagattcagcttccggatgccgtatggggaaaattgacatatatgtgggtcggttttctgatttttatgggtattgccaactggtttgtgtttactaggtttgaagcgcaatgggttaactataagatgttcggttcgactgcgctgatgctttttttctttattattcagggtatttatctgagtacctatctgaaaaaggaggat

SEQ ID NO: 3510 - protein, 182 aa, Neisseria gonorrhoeae
LLSHLDMKFVSDLLSVILFFATYTVTKNMIAAAAVALVAGVVQAAFLYWKHKRLDTMQWVGLVLIVVFGGATIVLGDSRFIMWKPTVLFWCGALFLLGSHLAGKNGLKASIGREIQLPDAVWGKLTYMWVGFLIFMGIANWFVFTRFEAQWVNYKMFGSTALMLFFFIIQGIYLSTYLKKED

SEQ ID NO: 3511 - DNA, 498 bp, Neisseria gonorrhoeae
gtgtataatctccaatctttgaaaccggccgtatgcaggagcaggacgatgaatattgaagtagaaatgaaagtgttggacgagaggatggcggattttatccctgcctatgcgacggagggttctgcaggtttggatttgcgcgcctgtttggatgaggaagtcgttttgcagccgggcgaaacgtttcttgtgccgacaggtttggcaatttatttggcgaatcccgcatatgccgctgttttgctgccacgttccggcttggggcataaacacggcattgtcttgggcaatttggtcggtttgattgactccgattaccaaggggaattgaaggtgtcgttatggaacaggggtagcgaaccgtttgccgtcaagccgttcgagcgtatcgcacaaatggttatcgtgccggtcgtacaggcgggcttcaaacgtgtcgaggaatttgtcggaagcagccggggtgagggcggcttcggcagtacgggttctcac

SEQ ID NO: 3512 - protein, 166 aa, Neisseria gonorrhoeae
VYNLQSLKPAVCRSRTMNIEVEMKVLDERMADFIPAYATEGSAGLDLRACLDEEVVLQPGETFLVPTGLAIYLANPAYAAVLLPRSGLGHKHGIVLGNLVGLIDSDYQGELKVSLWNRGSEPFAVKPFERIAQMVIVPVVQAGFKRVEEFVGSSRGEGGFGSTGSH

SEQ ID NO: 3513 - DNA, 195 bp, Neisseria gonorrhoeae
atgccgcctgaaccgtccttcagacggcattctatatctttagtgagaacccgtactgccgaagccgccctcaccccggctgcttccgacaaattcctcgacacgtttgaagcccgcctgtacgaccggcacgataaccatttgtgcgatacgctcgaacggcttgacggcaaacggttcgctacccctgttcca

SEQ ID NO: 3514 - protein, 65 aa, Neisseria gonorrhoeae
MPPEPSFRRHSISLVRTRTAEAALTPAASDKFLDTFEARLYDRHDNHLCDTLERLDGKRFATPVP

SEQ ID NO: 3515 - DNA, 1185 bp, Neisseria gonorrhoeae
atgaataccttactcaagcagctcaaaccatatccctttgcccgactgcgcgaggcgatgcagggcatttccgcgcctgaaggcatggaagccgtcccactgcatatcggcgaaccgaaacacccgacaccgaaagtcattacggatgcgctgaccgcctcattgcgcgagttggaaaaatatccgctgactgcgggtctgcctgaactgcgtcaggcgtgtgcgaactggttaaaacgccgttatgacggcttgacggtcaatccggataatgaaattctgccggttttgggcagtagggaggcgttgttttcttttgttcaaaccgtgttgaaccctgtttcagacggcctaaaacccgtaatcgtcagcccgaatcccttttatcagatttatgaaggtgcgacacttttgggcggcggtgaaatccattttgccaattgccccgcgccgtctttcaaccccgattggcgcagtatttccgaagaggtttgggaacgcaccaaactggtgttcgtctgctcgcccaacaaccccagcggcagcgtgccggatttggacggatggagagaagtttttgatttacaggataaatatggtttcattattgcctcggatgaatgctattccgaaatctattttgacggcaacaaacctttgggctgcctgcaagccgccgcacagtcggggcgaagcaggcaaaaactgcttatgttcaccagtttgtccaagcggtccaatgttccgggcctgcgttccggttttgtcgccggtgatgcggaactgcttaagaactttctgctttaccgaacctatcacggcagcgcaatgagtattcccgtgcagcgtgccagtattgccgcctggaatgacgaacaacacgttatcgacaaccgccgtatgtatcaggaaaaatttgagcgcgttattcccattttgcaacaggtatttgacgttaaattaccggatgcctcgttttacatctggttgaaagtccccaatggcgacgatttggcattcgcacgcaatttatggcaaaaagccgctatccaagtattgcccggacgctttttggcgcgggataccgagcaggggaatcccggggaaggttatgtccgtatcgctttggttgccgatgtcgcaacttgtgtcaaagctgcggaaaccattgtttccctatatcgg

SEQ ID NO: 3516 - protein, 395 aa, Neisseria gonorrhoeae
MNTLLKQLKPYPFARLREAMQGISAPEGMEAVPLHIGEPKHPTPKVITDALTASLRELEKYPLTAGLPELRQACANWLKRRYDGLTVNPDNEILPVLGSREALFSFVQTVLNPVSDGLKPVIVSPNPFYQIYEGATLLGGGEIHFANCPAPSFNPDWRSISEEVWERTKLVFVCSPNNPSGSVPDLDGWREVFDLQDKYGFIIASDECYSEIYFDGNKPLGCLQAAAQSGRSRQKLLMFTSLSKRSNVPGLRSGFVAGDAELLKNFLLYRTYHGSAMSIPVQRASIAAWNDEQHVIDNRRMYQEKFERVIPILQQVFDVKLPDASFYIWLKVPNGDDLAFARNLWQKAAIQVLPGRFLARDTEQGNPGEGYVRIALVADVATCVKAAETIVSLYR

SEQ ID NO: 3517 - DNA, 777 bp, Neisseria gonorrhoeae
atgttttttgtcctttcccctgcgaaaaaccttaacgaaaaagacccttgccctgtcagcgagtttacccaacccgatcttttggcggaatctgaaatcctgatgcgccaactgagggagcttgcccctcaacaaattgcagagttgatgcacgtttccgacaaaatcgcacttctaaacgccgaacgaaatgcagcgtggcacacgccgtttacgccggaaaacgccaaacaggcggtctttatgttcaacggcgatgtttacgaaggtatggatgcaaacacattgaataccaatcaaatacaatatctgcaagggcatgtacgcctgctgtccggtttgtacggtcttcttcgcccgttagacctgatacagccttaccgtctggaaatgggaacgtccttcgccaatttgcgcggcaagaacctgtatgagttttggggcggcatcattaccaaccttttaaatgacacgcttgcccaagcaggcagcaatacgcttgtcaaccttgcctcacaggaatatttcaagtccgtcaacacgaaaaaacttcgggcgcggctgattaccccgatatttaaagacgaaaaaaacggtaaatataaaatcatcagtttctatgccaaacgcgcgcgcggattgatggtgcgctatgcggcagaacacaatattaccgatcctgaaatgctgaaaaattttaattacgaaggctacgcattcaatgacgcggcttccaatgaaagcgaatgggtgtttatgcgttcggaacaaataaag

SEQ ID NO: 3518 - protein, 259 aa, Neisseria gonorrhoeae
MFFVLSPAKNLNEKDPCPVSEFTQPDLLAESEILMRQLRELAPQQIAELMHVSDKIALLNAERNAAWHTPFTPENAKQAVFMFNGDVYEGMDANTLNTNQIQYLQGHVRLLSGLYGLLRPLDLIQPYRLEMGTSFANLRGKNLYEFWGGIITNLLNDTLAQAGSNTLVNLASQEYFKSVNTKKLRARLITPIFKDEKNGKYKIISFYAKRARGLMVRYAAEHNITDPEMLKNFNYEGYAFNDAASNESEWVFMRSEQIK

SEQ ID NO: 3519 - DNA, 99 bp, Neisseria gonorrhoeae
ttggcaaaatgtataaacttcattattattcctactcttcaagaagacggaagcgtggcagagcggtttaatgcaacggtcttgaaaaccgtcgagggt

SEQ ID NO: 3520 - protein, 33 aa, Neisseria gonorrhoeae
LAKCINFIIIPTLQEDGSVAERFNATVLKTVEG

SEQ ID NO: 3521 - DNA, 90 bp, Neisseria gonorrhoeae
gtgggttcgaatcccgccgtttccgccgcaaagcaaaaccgccctgattcagggcggttcttttttgttcaggttgtgttaattactata

SEQ ID NO: 3522 - protein, 30 aa, Neisseria gonorrhoeae
VGSNPAVSAAKQNRPDSGRFFFVQVVLITI

SEQ ID NO: 3523 - DNA, 222 bp, Neisseria gonorrhoeae
atgcaaatatgcacagatgtttttgaaaaaagatggaaatatgtcataatttataaaattggctttaaaatacagcttcggccggaacctctgcctatccgcaccctatcgtccgtattgcctatgcctgatgacgaaatttacagactgtacgcggtcaaaccgtattcagccgccaacccacaggggatacatcttgcaaaaacaacagacaaatcaaac

SEQ ID NO: 3524 - protein, 74 aa, Neisseria gonorrhoeae
MQICTDVFEKRWKYVIIYKIGFKIQLRPEPLPIRTLSSVLPMPDDEIYRLYAVKPYSAANPQGIHLAKTTDKSN

SEQ ID NO: 3525 - DNA, 120 bp, Neisseria gonorrhoeae
atgtgtaaacatttgtattagccgtaggaaatcaccgcattgctcaaactgcaggccgggaaaataaactcgtaagcccgcaaacggcgtatcactgttcaaactgctgtgcggcttcat

SEQ ID NO: 3526 - protein, 6 aa, Neisseria gonorrhoeae
MCKHLY

SEQ ID NO: 3527 - DNA, 234 bp, Neisseria gonorrhoeae
gtgtgggttcataattcttgtccgcctaaaagaacaggaagctccaagaatgaaaaacatggagacggcggtcgaagtcaaatatcagcggaatcaaaaattgctgaattaacaaataaaattattcccggaatgtccaaaaatgaacgcttaaagattaagcaaaaaatcaaaaatattgccaaaaatgccaatcgaaaaacaaaaggagaagagcatggtcgacgcggtcgt

SEQ ID NO: 3528 - protein, 78 aa, Neisseria gonorrhoeae
VWVHNSCPPKRTGSSKNEKHGDGGRSQISAESKIAELTNKIIPGMSKNERLKIKQKIKNIAKNANRKTKGEEHGRRGR

SEQ ID NO: 3529 - DNA, 150 bp, Neisseria gonorrhoeae
ttgttaatgagtgctttgtcttcttatggggcggattctactttgcaagaaggtaataatggctccttatcatggaacgataaagcatcggcatctaaaattgagtggcattgggtacttctgctaatgcatcgaattttggtatttcct

SEQ ID NO: 3530 - protein, 50 aa, Neisseria gonorrhoeae
LLMSALSSYGADSTLQEGNNGSLSWNDKASASKIEWHWVLLLMHRILVFP

SEQ ID NO: 3531 - DNA, 228 bp, Neisseria gonorrhoeae
ttttttcagtttttctaattcaagttcatgtttcagcttttcttttacccatttggagaagtctaaattattggaaaattccaataaattagcttctttttcagtgttaaatgaaacgtgctttaaaacgcgcttagattcgtagctttttttggattgtttggttgggttcattcttcccccttgttgaaaataatcgtagatacattttactcgatttaaaatcat

SEQ ID NO: 3532 - protein, 5 aa, Neisseria gonorrhoeae
FFQFF

SEQ ID NO: 3533 - DNA, 555 bp, Neisseria gonorrhoeae
atggatgctttaaaattattgacgaaccgccgatcttccaaaaagctgaagcaccccgcccccgatgcggcggagttggaacaaatattgcaggcggcaacccaagtttccgatcacggcaacatgcgccccttccgttttaccgtgattcaaggcgaggtaggattgcaacgttttcgcgatgtgttgaagcaaacggttgccgaactgaatttcggcgacgatgcgatgaaaaaggcggaaaaagtgggcaatatggcgccgatggtcatcggggtaacgtttgtgccgaaccgcgatgtgcctaagccgaaaccggaatgggagcagatgctgacggcgggttgtgcggcgtatgcgctgcaactggcggcaacggctcagggattcgacaatgtctggattacggggatgtgggtcaacagcccattgttgcgggaggctttcggttgcgaggataaggataaaatcatcgggctgatgatggtcggcacgccgacagaggaagtgcataagcccaagaataccgatttggaagcgtttgtcagccattgg

SEQ ID NO: 3534 - protein, 185 aa, Neisseria gonorrhoeae
MDALKLLTNRRSSKKLKHPAPDAAELEQILQAATQVSDHGNMRPFRFTVIQGEVGLQRFRDVLKQTVAELNFGDDAMKKAEKVGNMAPMVIGVTFVPNRDVPKPKPEWEQMLTAGCAAYALQLAATAQGFDNVWITGMWVNSPLLREAFGCEDKDKIIGLMMVGTPTEEVHKPKNTDLEAFVSHW

SEQ ID NO: 3535 - DNA, 120 bp, Neisseria gonorrhoeae
ttgcaatcttgcggcatcttcttattgcatttttttatggtaatgtatatggtaaattttggacaaacgggaatttaccataatggcaaaaatcatcacgccgctgtcggcaaatcaagt

SEQ ID NO: 3536 - protein, 40 aa, Neisseria gonorrhoeae
LQSCGIFLLHFFMVMYMVNFGQTGIYHNGKNHHAAVGKSS

SEQ ID NO: 3537 - DNA, 1122 bp, Neisseria gonorrhoeae
ttgtcggacggcggagggttggctttgtgggtctatccgacgggcaggcggagttggaagctgtcgtttatgcaggacggaaggcaacagacaatttcgctggggcggtatcctgatttctcgctggctgaggcgcgggaatggcgggaggaggtgcgccgaaaacgggcacacggggaaaatgtcgtcaataagaaggtgcgggcggattttgcttttgagaaggtggcgcgtgattggtttgtgcgttggtcgaaggggcggtctgaaaagtatgccggacaggttatgcggaattttgaacggtgggtttttccggctatcggcaatcttgatatccgtcaagtcaggacggcggacgtggtcggctgcctgcgtgtgatggaggcgcgcggtatcgttgatacgttgcgcaaaacgaaaaacagtctgaagatggtgtttgcgtttgcggtcggttcgggaatgatggaaatcaaccctgtcgcgcaaatcggttcgggtgtgtttgaacgggtgaaaaccaaaaacatgacggcgttgagtccgtccgaattgccgcgcctgattgattttttggagcagcgcaatgaatttgcggtttatgcgggcagggtgcatatccatcctgtaacgcggttttgtatctattggctgctgttgacgatgacgcggattcgggaggcggcgttgatggagtggtcggagttggacggggaggtttggcgtatccccgccgaacggaaaaaggagcggcgggggcatgatgtgccgctgtcgcgggcgatgcggtgggtgttggatcaggcgcgggggctgaatgtgaacgggcggtttgtgtttgaaagtgtgaattttcaagggcatatcaataaggaaagtccgcacgtggcgatgcggcggtcggggctggatacgacggcgcacggtttgcgctcgcttgcgcgtacttatttgcgcgaggttctgaaggtgtataatgatgtggcggaaaagctgcttgcccattcgttggggacgaggacgcaaacggcttacaaccgctcggagctttgggaggagcgtaaggatgcgccggaacggtgggggaatgatgttttgaggcttgccgacaacggaaaa

SEQ ID NO: 3538 - protein, 374 aa, Neisseria gonorrhoeae
LSDGGGLALWVYPTGRRSWKLSFMQDGRQQTISLGRYPDFSLAEAREWREEVRRKRAHGENVVNKKVRADFAFEKVARDWFVRWSKGRSEKYAGQVMRNFERWVFPAIGNLDIRQVRTADVVGCLRVMEARGIVDTLRKTKNSLKMVFAFAVGSGMMEINPVAQIGSGVFERVKTKNMTALSPSELPRLIDFLEQRNEFAVYAGRVHIHPVTRFCIYWLLLTMTRIREAALMEWSELDGEVWRIPAERKKERRGHDVPLSRAMRWVLDQARGLNVNGRFVFESVNFQGHINKESPHVAMRRSGLDTTAHGLRSLARTYLREVLKVYNDVAEKLLAHSLGTRTQTAYNRSELWEERKDAPERWGNDVLRLADNGK

SEQ ID NO: 3539 - DNA, 1536 bp, Neisseria gonorrhoeae
atgaacatcaccaaaccgggcgcaaggatagaccgcccgaccatccgcgaactgattgcctacgcaacctgccgcaaccaccccatttcaaactcgacactgctgcgtatggaaaaagacggacggataccgtgccgtctgaacccccctcgcatcccccgtatgggacacccgcgaagttttggaagcattagggttgcagcaataaaaaaacgcccgattagggcgttttcacataatgcggaaacagctttcttatctacatttccacataacgcaaaacacacaaaaaaatcattttccgttgtcggcaagcctcaaaacatcattcccccaccgttccggcgcatccttacgctcctcccaaagctccgagcggttgtaagccgtttgcgtcctcgtccccaacgaatgggcaagcagcttttccgccacatcattatacaccttcagaacctcgcgcaaataagtacgcgcaagcgagcgcaaaccgtgcgccgtcgtatccagccccgaccgccgcatcgccacgtgcggactttccttattgatatgcccttgaaaattcacactttcaaacacaaaccgcccgttcacattcagcccccgcgcctgatccaacacccaccgcatcgcccgcgacagcggcacatcatgcccccgccgctcctttttccgttcggcggggatacgccaaacctccccgtccaactccgaccactccatcaacgccgcctcccgaatccgcgtcatcgtcaacagcagccaatagatacaaaaccgcgttacaggatggatatgcaccctgcccgcataaaccgcaaattcattgcgctgctccaaaaaatcaatcaggcgcggcaattcggacggactcaacgccgtcatgtttttggttttcacccgttcaaacacacccgaaccgatttgcgcgacagggttgatttccatcattcccgaaccgaccgcaaacgcaaacaccatcttcagactgtttttcgttttgcgcaacgtatcaacgataccgcgcgcctccatcacacgcaggcagccgaccacgtccgccgtcctgacttgacggatatcaagattgccgatagccggaaaaacccaccgttcaaaattccgcataacctgtccggcatacttttcagaccgccccttcgaccaacgcacaaaccaatcacgcgccaccttctcaaaagcaaaatccgcccgcaccttcttattgacgacattttccccgtgtgcccgttttcggcgcacctcctcccgccattcccgcgcctcagccagcgagaaatcaggataccgccccagcgaaattgtctgttgccttccgtcctgcataaacgacagcttccaactccgcctgcccgtcggatagacccacaaagccaaccctccgccgtccgacaacttatacagcttatcgccaggcttcgcatttttaacttgatttgccgacagcggcgtgatgatttttgccattatggtaaattcccgtttgtccaaaatttaccatatacattacca

SEQ ID NO: 3540 - protein, 512 aa, Neisseria gonorrhoeae
MNITKPGARIDRPTIRELIAYATCRNHPISNSTLLRMEKDGRIPCRLNPPRIPRMGHPRSFGSIRVAAIKKRPIRAFSHNAETAFLSTFPHNAKHTKKSFSVVGKPQNIIPPPFRRILTLLPKLRAVVSRLRPRPQRMGKQLFRHIIIHLQNLAQISTRKRAQTVRRRIQPRPPHRHVRTFLIDMPLKIHTFKHKPPVHIQPPRLIQHPPHRPRQRHIMPPPLLFPFGGDTPNLPVQLRPLHQRRLPNPRHRQQQPIDTKPRYRMDMHPARINRKFIALLQKINQARQFGRTQRRHVFGFHPFKHTRTDLRDRVDFHHSRTDRKRKHHLQTVFRFAQRINDTARLHHTQAADHVRRPDLTDIKIADSRKNPPFKIPHNLSGILFRPPLRPTHKPITRHLLKSKIRPHLLIDDIFPVCPFSAHLLPPFPRLSQREIRIPPQRNCLLPSVLHKRQLPTPPARRIDPQSQPSAVRQLIQLIARLRIFNLICRQRRDDFCHYGKFPFVQNLPYTLP

SEQ ID NO: 3541 - DNA, 267 bp, Neisseria gonorrhoeae
atggagtcttccgacgtacaagggcggatggaaacactggcatttgcaaccgccccgaaaaaaggcggaatccggaaatccggattcggccgcgttattctaatcaaaagcgggcatatagttattcataacgctgatggcgacagctttgccaccggctacggcgtgattgccgccgacatcgtcagtcccgatttgaaaacagactttgacatattcttcccgccggaaagcttgttgcgatataaaaaaatcgggaagaagaaa

SEQ ID NO: 3542 - protein, 89 aa, Neisseria gonorrhoeae
MESSDVQGRMETLAFATAPKKGGIRKSGFGRVILIKSGHIVIHNADGDSFATGYGVIAADIVSPDLKTDFDIFFPPESLLRYKKIGKKK

SEQ ID NO: 3543 - DNA, 246 bp, Neisseria gonorrhoeae
atgccgaatatgaaagacgcaattgccgcatgccaagccgtaaaaaagcggaaacccggacaaatcggaatcaacggaaagaggattgaagacatggaatacgaagtattcaataaacgcccgtcaaaaaagcggtcggcgaagcaatggagtcttccgacgtacaagggcggatggaaacactggcatttgcaaccgccccgaaaaaaggcggaatccggaaatccggattcggccgcgttattc

SEQ ID NO: 3544 - protein, 82 aa, Neisseria gonorrhoeae
MPNMKDAIAACQAVKKRKPGQIGINGKRIEDMEYEVFNKRPSKKRSAKQWSLPTYKGGWKHWHLQPPRKKAESGNPDSAALF

SEQ ID NO: 3545 - DNA, 264 bp, Neisseria gonorrhoeae
ttgtacgtcggaagactccattgcttcgccgaccgcttttttgacgggcgtttattgaatacttcgtattccatgtcttcaatcctctttccgttgattccgatttgtccgggtttccgcttttttacggcttggcatgcggcaattgcgtctttcatattcggcatatcctttccccaatccgccgaagtttccgcatccgccgccgtctcgattcatgtttgccctccgatttgttttacgaagcccgtaccgttcacggca

SEQ ID NO: 3546 - protein, 88 aa, Neisseria gonorrhoeae
LYVGRLHCFADRFFDGRLLNTSYSMSSILFPLIPICPGFRFFTAWHAAIASFIFGISFPQSAEVSASAAVSIHVCPPICFTKPVPFTA

SEQ ID NO: 3547 - DNA, 825 bp, Neisseria gonorrhoeae
ttggacggcaaagccgtcattgccgtttcttccgcacaggcagtccgcgatcccgtcttggtgttccgcatcggtgcaggcgcgcaggtacgcgaatacaccgccatcctcgatcctgtcggctgctcgcccaaaaccaaatctgcactttcagacggcaagacacaccgcaaaaccgctccgaaagcagagtcccaagaaaatcaaaacgccaaagccctccgcaaaaccgataaaaaagacagcgcaaactcagccgtcaaaccggcgcataacggcaaaacccataccgtccgcaaaggcgaaacgctcaaacagattgccgccgccatccgtccgaaacacctgacgctcgaacaggttgccgatgtgctgctgaaggcaaacccaaatgtttccgcacacggcagactgcgtgcgggcagcgtgcttcacattccgaatctgaacaggatcaaagcggcagcacccaaaaaaatcaaagcggaacaacccaaaccgcaaacggcgaaacccaaagccgaaactgcatccatgccgtctgaaccgtccaaacaggcaacggtagagaaaccgatagagaaacctgtcgaaaaaccggttgaaaaacctgaagcaaaagttgccgcgcccgaagcaaaagcggaaaaaccggccgttcgacccgaacccaaacccgcagtgtccgaaactccggcttcggcgacagaacgccaacccggacctgtacccgctgcaaatactgccgcatcggaaaccgctgccgaatccgcccccccaagaagccgccgcttctgccatcgacacgccgaccgacgaaaccgg

SEQ ID NO: 3548 - protein, 275 aa, Neisseria gonorrhoeae
LDGKAVIAVSSAQAVRDPVLVFRIGAGAQVREYTAILDPVGCSPKTKSALSDGKTHRKTAPKAESQENQNAKALRKTDKKDSANSAVKPAHNGKTHTVRKGETLKQIAAAIRPKHLTLEQVADVLLKANPNVSAHGRLRAGSVLHIPNLNRIKAAAPKKIKAEQPKPQTAKPKAETASMPSEPSKQATVEKPIEKPVEKPVEKPEAKVAAPEAKAEKPAVRPEPKPAVSETPASATERQPGPVPAANTAASETAAESAPPRSRRFCHRHADRRNR

SEQ ID NO: 3549 - DNA, 345 bp, Neisseria gonorrhoeae
aaatggaacaagaacttttatctcactgttgttaaaacgccgttcgcactcctttaaatacggctcaaaatgctctttgggaatgccgtcaaacttgcgtaaatgacgttttgcccggttccaaaagttcccaattccattaatatggttttgtcgttcggcaaaatgtgtgctgtgattgatacggaaatggctaaattcgcctgcatccaatacatcatagcgacgataacaatccgtataaacaatgctgtcaggctctgttgctgttcttgcagttacgcctgcgacaaacagttcaatgagtttattttgtttataccggcttagacggctttttctcat

SEQ ID NO: 3550 - protein, 18 aa, Neisseria gonorrhoeae
KWNKNFYLTVVKTPFALL

SEQ ID NO: 3551 - DNA, 681 bp, Neisseria gonorrhoeae; identical to SEQ ID NO: 257

SEQ ID NO: 3552 - protein, 227 aa, Neisseria gonorrhoeae; identical to SEQ ID NO: 258

SEQ ID NO: 3553 - DNA, 282 bp, Neisseria gonorrhoeae
ttgccgccaaagtccgccgatactgcggcgaacacccgggcgtatttgacggcgcggcaggaagcaggcagcttgaacggtatattaagccgtctgaatttcacgccgtggagatacagcccgaagcctgcaaagccttgttgcaaaactaccctgccgcggccggtaatctcggcaggcggaaacaaaaaaagccccgagttcgtaagcgtatcagccctagccgaatggcccgaccgaatcgaaagcaaagcgaaagacgaatgggcaagggtgcgaaat

SEQ ID NO: 3554 - protein, 94 aa, Neisseria gonorrhoeae
LPPKSADTAANTRAYLTARQEAGSLNGILSRLNFTPWRYSPKPAKPCCKTTLPRPVISAGGNKKSPEFVSVSALAEWPDRIESKAKDEWARVRN

SEQ ID NO: 3555 - DNA, 363 bp, Neisseria gonorrhoeae
atgttgtctggcgcaaaggtatcggaagacgaagccctgacgtgcggcatcatgatgcggctggttgccgccaaagtccgccgatactgcggcgaacacccgggcgtatttgacggcgcggcaggaagcaggcagcttgaacggtatattaagccgtctgaatttcacgccgtggagatacagcccgaagcctgcaaagccttgttgcaaaactaccctgccgcggccggtaatctcggcaggcggaaacaaaaaaagccccgagttcgtaagcgtatcagccctagccgaatggcccgaccgaatcgaaagcaaagcgaaagacgaatgggcaagggtgcgaaattaaaataccggacaaat

SEQ ID NO: 3556 - protein, 121 aa, Neisseria gonorrhoeae
MLSGAKVSEDEALTCGIMMRLVAAKVRRYCGEHPGVFDGAAGSRQLERYIKPSEFHAVEIQPEACKALLQNYPAAAGNLGRRKQKKPRVRKRISPSRMARPNRKQSERRMGKGAKLKYRTN

SEQ ID NO: 3557 - DNA, 174 bp, Neisseria gonorrhoeae
ttgacggcgcgttcctgccgcgttgattccttcgccgcgcgtttggcggcaagcatctgttttgccgtcggttttgttgctactgtttgcattttgttttctcgattttttgatgccgttctctcaatgcccaatcataaagctgtatctctcacgaggtcgccgaatttaaat

SEQ ID NO: 3558 - protein, 58 aa, Neisseria gonorrhoeae
LTARSCRVDSFAARLAASICFAVGFVATVCILFSRFFDAVLSMPNHKAVSLTRSPNLN

SEQ ID NO: 3559 - DNA, 213 bp, Neisseria gonorrhoeae
atgagctatttggaagatgtaaaaaacgcattaagggtaatagataacttatgcaaagaagcattaaaagagcctgaatcgttagagggttatatagacgaaattagggataaagcagacgaagcggatacctctttggaatttctaaaggatgtaataaattatggtattagcgatttaaaaaatgtaattgaggtgtttgaagattgcgtt

SEQ ID NO: 3560 - protein, 71 aa, Neisseria gonorrhoeae
MSYLEDVKNALRVIDNLCKEALKEPESLEGYIDEIRDKADEADTSLEFLKDVINYGISDLKNVIEVFEDCV

SEQ ID NO: 3561 - DNA, 489 bp, Neisseria gonorrhoeae
atgaccgccctcgcactctaccggtgcgcggcagacgtacaggcggcgctggattactactttgacagcgaaaccgagcgcgaagacacgctggaagccgttatcgggcagttcgaggtcaaagcgcaatccgttatcgcttatattaaaaaccaagaaatcacggaaaaaatgcttgaagggcacatcaggcggatgaccgggaagctcaaggcggtaaaagcgcaaaatcaaagcctgaaagactacttggcgcgcaatatgcaggcggcgggcattaccgaaatcaaagcggacgacggcacttttaaagcctcgttccgcaaatccgaagccgtcgtgatcttagacgaagcacaaatccccgccgaatttatgcgtgaggccgtcaaaaccgaaccggacaaaaccgccatcagaaaagcgattgaaagcggtcggcaagtagcaggcgcgaagattgaagggcggaagaatttgcagattaga

SEQ ID NO: 3562 - protein, 163 aa, Neisseria gonorrhoeae
MTALALYRCAADVQAALDYYFDSETEREDTLEAVIGQFEVKAQSVIAYIKNQEITEKMLEGHIRRMTGKLKAVKAQNQSLKDYLARNMQAAGITEIKADDGTFKASFRKSEAVVILDEAQIPAEFMREAVKTEPDKTAIRKAIESGRQVAGAKIEGRKNLQIR

SEQ ID NO: 3563 - DNA, 222 bp, Neisseria gonorrhoeae
ttgcaactgcttcggacggcaacagagaaaggaaacaaaaaaatggcaaacatcgacctgacccaatgggacgggaaaaccattggcgccgccgccaatcccgaacagggatacatcaacatcaccatcggcagcgacgacctattcatcaacatcgaacaggcatacgccatacacgccgcgcttggcgaagcggttgccgaatatgagggaggggcacaa

SEQ ID NO: 3564 - protein, 74 aa, Neisseria gonorrhoeae
LQLLRTATEKGNKKMANIDLTQWDGKTIGAAANPEQGYINITIGSDDLFINIEQAYAIHAALGEAVAEYEGGAQ

SEQ ID NO: 3565 - DNA, 147 bp, Neisseria gonorrhoeae
gtgctctccagtttggatatgtgcgatggctttgtagccgtctgccgttttgaccaaggtgctgccgtggaaagggcaggtgtaggatttttgaagaacttagttttcaatatcctgtttcaaatgaaggaaatgccgtctgaaaat

SEQ ID NO: 3566 - protein, 49 aa, Neisseria gonorrhoeae
VLSSLDMCDGFVAVCRFDQGAAVERAGVGFLKNLVFNILFQMKEMPSEN

SEQ ID NO: 3567 - DNA, 198 bp, Neisseria gonorrhoeae
cccgataaatttccgcaccgacagacctagattcccgcctgagcgggaatgacggttcgggtatttctgacgattcatcgagccgtagcaactgtattttccaccccgtcgggcaaaaataccaaaactcaaatcaagccgtccgaataccgttttcggcggtatcgtttgcggcaaaataatcacgcatccgggcat

SEQ ID NO: 3568 - protein, 9 aa, Neisseria gonorrhoeae
PDKFPHRQT

SEQ ID NO: 3569 - DNA, 678 bp, Neisseria gonorrhoeae
ttgattttaagtgtgaaagacgaaagcaatttcaaaccatgcccggcaggcagccatcacgccacctgcatccgcatcatcgatttgggtacgcagctcgtcgagtaccaaaacgaacaaaagcggcagcacaagattttagtgcagtgggaaatcgaccctgaaggcgatccggaaatgctgatgccggacggcaggccctacctcatcagccgacgatacaccgccagcctgcacagcaaaagccaactggcaacagacctcaaaagctggcgcggaagggactttacaccggaagaacgcgacaacttcgatttgcgcaatattttgggcaagccctgcctgttgagtatcgcccaccaagaaagcagcgacggcaaaaccacctatgccaacatttccgccatcagcaacaagatgaagagctacaccccgaaacatccggacaacgccgtttttgccttcgacctgtcagaccccgattgggcgaattacggcctcctgaacgagaaactgagggagcagattgccaaaagcccggaatatgccgaagccgtaaacggccgccaaccgccggcgccgccgcagaaacaggcccaagcggcggaagggcggccggaacacccccaaggcaatgccgcgcctgccgaagacatcgaggacgacatcccttttaat

SEQ ID NO: 3570 - protein, 226 aa, Neisseria gonorrhoeae
LILSVKDESNFKPCPAGSHHATCIRIIDLGTQLVEYQNEQKRQHKILVQWEIDPEGDPEMLMPDGRPYLISRRYTASLHSKSQLATDLKSWRGRDFTPEERDNFDLRNILGKPCLLSIAHQESSDGKTTYANISAISNKMKSYTPKHPDNAVFAFDLSDPDWANYGLLNEKLREQIAKSPEYAEAVNGRQPPAPPQKQAQAAEGRPEHPQGNAAPAEDIEDDIPFN

SEQ ID NO: 3571 - DNA, 192 bp, Neisseria gonorrhoeae
ttgctttcgtctttcacacttaaaatcaatgacattttcggtctcctgttaaaggtcgtttcgtctatcggtctcgcgctgttttatgccttgcgcggcggcggttatctgataatgcttttaatgtggccttctgcctgtttttcggtcatccgccgtgtttcggcggtttccggggctttgccgggtatt

SEQ ID NO: 3572 - protein, 64 aa, Neisseria gonorrhoeae
LLSSFTLKINDIFGLLLKVVSSIGLALFYALRGGGYLIMLLMWPSACFSVIRRVSAVSGALPGI

SEQ ID NO: 3573 - DNA, 117 bp, Neisseria gonorrhoeae
gtggccttctgcctgtttttcggtcatccgccgtgtttcggcggtttccggggctttgccgggtatttgatttcttcggggcttggtccgtacggctctgtttctccgccgccgtta

SEQ ID NO: 3574 - protein, 39 aa, Neisseria gonorrhoeae
VAFCLFFGHPPCFGGFRGFAGYLISSGLGPYGSVSPPPL

SEQ ID NO: 3575 - DNA, 117 bp, Neisseria gonorrhoeae
atgagcttccatcccgaaaccgcttataacggcggcggagaaacagagccgtacggaccaagccccgaagaaatcaaatacccggcaaagccccggaaaccgccgaaacacggcgga

SEQ ID NO: 3576 - protein, 39 aa, Neisseria gonorrhoeae
MSFHPETAYNGGGETEPYGPSPEEIKYPAKPRKPPKHGG

SEQ ID NO: 3577 - DNA, 309 bp, Neisseria gonorrhoeae
ttggtccgtacggctctgtttctccgccgccgttataagcggtttcgggatggaagctcattctttaccctccggcacttccgcatcgccgtgcacccgccggcaaccggcttcttcttccgcattcagatgccgctcttccagccaaatctcggcgctcaattccgcaacctgcgcctgcttttgagccaacgccatacgcattgccgcaatatcggcggggttttccctttgccgtacggcttccgcctcccttggcgaatccgaaggcatagcccgccgccaataccgccgccaataccgcgaact

SEQ ID NO: 3578 - protein, 103 aa, Neisseria gonorrhoeae
LVRTALFLRRRYKRFRDGSSFFTLRHFRIAVHPPATGFFFRIQMPLFQPNLGAQFRNLRLLLSQRHTHCRNIGGVFPLPYGFRLPWRIRRHSPPPIPPPIPRT

SEQ ID NO: 3579 - DNA, 258 bp, Neisseria gonorrhoeae
ttgcgtttaagttcgcggtattggcggcggtattggcggcgggctatgccttcggattcgccaagggaggcggaagccgtacggcaaagggaaaaccccgccgatattgcggcaatgcgtatggcgttggctcaaaagcaggcgcaggttgcggaattgagcgccgagatttggctggaagagcggcatctgaatgcggaagaagaagccggttgccggcgggtgcacggcgatgcggaagtgccggagggtaaagaa

SEQ ID NO: 3580 - protein, 86 aa, Neisseria gonorrhoeae
LRLSSRYWRRYWRRAMPSDSPREAEAVRQRENPADIAAMRMALAQKQAQVAELSAEIWLEERHLNAEEEAGCRRVHGDAEVPEGKE

SEQ ID NO: 3581 - DNA, 267 bp, Neisseria gonorrhoeae
atgaagacaaggaatattgcgtttaagttcgcggtattggcggcggtattggcggcgggctatgccttcggattcgccaagggaggcggaagccgtacggcaaagggaaaaccccgccgatattgcggcaatgcgtatggcgttggctcaaaagcaggcgcaggttgcggaattgagcgccgagatttggctggaagagcggcatctgaatgcggaagaagaagccggttgccggcgggtgcacggcgatgcggaagtgccggaggg

SEQ ID NO: 3582 - protein, 89 aa, Neisseria gonorrhoeae
MKTRNIAFKFAVLAAVLAAGYAFGFAKGGGSRTAKGKPRRYCGNAYGVGSKAGAGCGIERRDLAGRAASECGRRSRLPAGARRCGSAGG

SEQ ID NO: 3583 - DNA, 330 bp, Neisseria gonorrhoeae
gtgaaatattacggcacggcggcttacggcagccccgattgggggatggaaagatattacgcgcgggaggatatgcggcaggctttggacggttgggaggcggaaaaccgaatcctgcacgaatccgcgctaatcggaatcgccaaaaaatcggcgcgggagtttgtccgcgatgcggacggcgaaccttacagccaggaggattgggaaacgtaccttacggaagatgcttcccgtgtcggtaaagataccgaagccgcgatgaactacgccatagacgagcgggaatggttcgcgctggcggagaacatcggcaggctggcaaattca

SEQ ID NO: 3584 - protein, 110 aa, Neisseria gonorrhoeae
VKYYGTAAYGSPDWGMERYYAREDMRQALDGWEAENRILHESALIGIAKKSAREFVRDADGEPYSQEDWETYLTEDASRVGKDTEAAMNYAIDEREWFALAENIGRLANS

SEQ ID NO: 3585 - DNA, 183 bp, Neisseria gonorrhoeae
atgacggttcgggtatttctgacgattcatcgagccgtagcaactgtattttccaccccgtcgggcaaaaataccaaaactcaaatcaagccgtccgaataccgttttcggcggtatcgtttgcggcaaaataatcacgcatccgggcattcaatatcgtcggcagtttgcgcatacatgccg

SEQ ID NO: 3586 - protein, 61 aa, Neisseria gonorrhoeae
MTVRVFLTIHRAVATVFSTPSGKNTKTQIKPSEYRFRRYRLRQNNHASGHSISSAVCAYMP

SEQ ID NO: 3587 - DNA, 1050 bp, Neisseria gonorrhoeae
atgccgttttgcgcggctgccaggctgtcgaaatccaagtcgatgcggttggaaggcgtatcggtttcgacatcgaacgtttgttttgccgataactcttcttcagattccccacctaaggcaagtgtgtcgtttacatcgtttttcggagcgggttcgggcgttgccggagtttcgacttcggcaaaggtgatttttatgccgtcgtctgccgcgtcgtcaaggtcaggctcttcttcagggacggattcttcggtacggcgcgcgcgtttggattgggcaaggcgtaaaagcagcagcagcagggcgatcaatgccgtgcctccgccggcaagcagcaaggtgtacgaaccgccgaacagaccgtcaaacagtccgctttcggtttcttcttcggcagaaacctgttcgacaggttcggcaacgggttcggcggcaacttcactggctgtttccgcaacaggttcggaaacggtgttaccggtttcgtcggtcggcgtgtcgatggcagaagcggcggcttcttgggggggcggattcggcagcggtttccgatgcggcagtatttgcagcgggtacaggtccgggttggcgttctgtcgccgaagccggagtttcggacactgcgggtttgggttcgggtcgaacggccggtttttccgcttttgcttcgggcgcggcaacttttgcttcaggtttttcaaccggtttttcgacaggtttctctatcggtttctctaccgttgcctgtttggacggttcagacggcatggatgcagtttcggctttgggtttcgccgtttgcggtttgggttgttccgctttgatttttttgggtgctgccgctttgatcctgttcagattcggaatgtgaagcacgctgcccgcacgcagtctgccgtgtgcggaaacatttgggtttgccttcagcagcacatcggcaacctgttcgagcgtcaggtgtttcggacggatggcggcggcaatctgtttgagcgtttcgcctttgcggacggtatgggttttgccgttatgcgccggtttgacggc

SEQ ID NO: 3588 - protein, 350 aa, Neisseria gonorrhoeae
MPFCAAARLSKSKSMRLEGVSVSTSNVCFADNSSSDSPPKASVSFTSFFGAGSGVAGVSTSAKVIFMPSSAASSRSGSSSGTDSSVRRARLDWARRKSSSSRAINAVPPPASSKVYEPPNRPSNSPLSVSSSAETCSTGSATGSAATSLAVSATGSETVLPVSSVGVSMAEAAASWGGGFGSGFRCGSICSGYRSGLAFCRRSRSFGHCGFGFGSNGRFFRFCFGRGNFCFRFFNRFFDRFLYRFLYRCLFGRFRRHGCSFGFGFRRLRFGLFRFDFFGCCRFDPVQIRNVKHAARTQSAVCGNIWVCLQQHIGNLFERQVFRTDGGGNLFERFAFADGMGFAVMRRFDG

SEQ ID NO: 3589 - DNA, 273 bp, Neisseria gonorrhoeae
atgagttatctagatcaaccattgaagcacggctacggcaacggcaacggtagcggcaacggtagcggctatggcaacggctacggcaacggctacggcaacggctacggcggcgtcggcggcggcggtagcggcagcggctacggcaacggcaacggctacagcaacggcagcggcaacggcgacggcgacggcaacggcaacggtagcggcaacggtagcggctatggcaacggctacggcaacggctacagcaacggcagcggcaacggc

SEQ ID NO: 3590 - protein, 91 aa, Neisseria gonorrhoeae
MSYLDQPLKHGYGNGNGSGNGSGYGNGYGNGYGNGYGGVGGGGSGSGYGNGNGYSNGSGNGDGDGNGNGSGNGSGYGNGYGNGYSNGSGNG

SEQ ID NO: 3591 - DNA, 474 bp, Neisseria gonorrhoeae; identical to SEQ ID NO: 259

SEQ ID NO: 3592 - protein, 158 aa, Neisseria gonorrhoeae; identical to SEQ ID NO: 260

SEQ ID NO: 3593 - DNA, 198 bp, Neisseria gonorrhoeae
atgaacgaattaatcagcagaataaatcggtttggcgcgagggcaaaggacgagcaaagccttttattgaaagttggtgaaatctgccgcgacgcagcagcgacatggaccactagaaaaagcgaaagcctcaatcacaccgccttcacttttacagtgaaaaaagacggcttaaaagagaaggtaatgattgttttg

SEQ ID NO: 3594 - protein, 66 aa, Neisseria gonorrhoeae
MNELISRINRFGARAKDEQSLLLKVGEICRDAAATWTTRKSESLNHTAFTFTVKKDGLKEKVMIVL

SEQ ID NO: 3595 - DNA, 411 bp, Neisseria gonorrhoeae; identical to SEQ ID NO: 261

SEQ ID NO: 3596 - protein, 137 aa, Neisseria gonorrhoeae; identical to SEQ ID NO: 262

SEQ ID NO: 3597 - DNA, 498 bp, Neisseria gonorrhoeae; identical to SEQ ID NO: 167

SEQ ID NO: 3598 - protein, 166 aa, Neisseria gonorrhoeae; identical to SEQ ID NO: 168

SEQ ID NO: 3599 - DNA, 435 bp, Neisseria gonorrhoeae; identical to SEQ ID NO: 263

SEQ ID NO: 3600 - protein, 145 aa, Neisseria gonorrhoeae; identical to SEQ ID NO: 264

SEQ ID NO: 3601 - DNA, 714 bp, Neisseria gonorrhoeae
atgccttttattatcgattaccaatgcttatgcgcaattaattcggagatcaaaatgttttcaggcgaacagttaggacaagcaatatcagaagcgattaagagaaaaaatgtcagtcaaaaggaggttgccgatcattttggggtgaaacagccaagcgtttcaggttggataaaaaatggacgaatagataaaaaacatctagataaattaattgattatttctcagacgtagtaacgccaagccatttcggcattgaaacattcagagtcttaaaatcgaatgaacaaagtagcatacgtttcccccgcttaaatgccgaagcgacctgcggcgcaggcacgattaacgaccactatatcgaggttgtggattatgtaaccgtcgctgccgcatgggcgcgggagaaactgggcggaaacctcaacaaaatccaagtcattacagcccgtggcgacagcatggagcccaccatcgaaaacggcgacgtaatgttcgttgataccgccgtcgaagccttcgatggcgacggcctctacctgctttggtatatagacggccttaaggccaagcggctgcaatccaccgtcggcggcggcctgatgatcatcagcgacaacagctcataccgaaccgaaaccgtgcgcggcgaagatttaaacgccgtacgcatcatcggacgcatacgcggcgcatggcgtttgagccagttc

SEQ ID NO: 3602 - protein, 238 aa, Neisseria gonorrhoeae
MPFIIDYQCLCAINSEIKMFSGEQLGQAISEAIKRKNVSQKEVADHFGVKQPSVSGWIKNGRIDKKHLDKLIDYFSDVVTPSHFGIETFRVLKSNEQSSIRFPRLNAEATCGAGTINDHYIEVVDYVTVAAAWAREKLGGNLNKIQVITARGDSMEPTIENGDVMFVDTAVEAFDGDGLYLLWYIDGLKAKRLQSTVGGGLMIISDNSSYRTETVRGEDLNAVRIIGRIRGAWRLSQF

SEQ ID NO: 3603 - DNA, 225 bp, Neisseria gonorrhoeae
ttgcgcatacatgccgtaacggcaaccttatacggcttacccttgtatggcggattaacaaaaatcaggacaaggcggcgggccgcagacggtacaaatggtacggaaccgatccgcctggtgcttcatcaccttagggaaccgttccctttgagccggggcggggcaacgccgtaccggtttttgttaatccgctatacagcaggcgttggtggaaatcccgaa

SEQ ID NO: 3604 - protein, 75 aa, Neisseria gonorrhoeae
LRIHAVTATLYGLPLYGGLTKIRTRRRAADGTNGTEPIRLVLHHLREPFPLSRGGATPYRFLLIRYTAGVGGNPE

SEQ ID NO: 3605 - DNA, 759 bp, Neisseria gonorrhoeae
ttgaaaaacctgaagcaaaagttgccgcgcccgaagcaaaagcggaaaaaccggccgttcgacccgaacccaaacccgcagtgtccgaaactccggcttcggcgacagaacgccaacccggacctgtacccgctgcaaatactgccgcatcggaaaccgctgccgaatccgcccccccaagaagccgccgcttctgccatcgacacgccgaccgacgaaaccggtaacaccgtttccgaacctgttgcggaaacagccagtgaagttgccgccgaacccgttgccgaacctgtcgaacaggtttctgccgaagaagaaaccgaaagcggactgtttgacggtctgttcggcggttcgtacaccttgctgcttgccggcggaggcacggcattgatcgccctgctgctgctgcttttacgccttgcccaatccaaacgcgcgcgccgtaccgaagaatccgtccctgaagaagagcctgaccttgacgacgcggcagacgacggcataaaaatcacctttgccgaagtcgaaactccggcaacgcccgaacccgctccgaaaaacgatgtaaacgacacacttgccttaggtggggaatctgaagaagagttatcggcaaaacaaacgttcgatgtcgaaaccgatacgccttccaaccgcatcgacttggatttcgacagcctggcagccgcgcaaaacggcattttgtccggcgcacttacgcaggatgaagaaacccaaaaacgcgcggatgccgat

SEQ ID NO: 3606 - protein, 253 aa, Neisseria gonorrhoeae
LKNLKQKLPRPKQKRKNRPFDPNPNPQCPKLRLRRQNANPDLYPLQILPHRKPLPNPPPQEAAASAIDTPTDETGNTVSEPVAETASEVAAEPVAEPVEQVSAEEETESGLFDGLFGGSYTLLLAGGGTALIALLLLLLRLAQSKRARRTEESVPEEEPDLDDAADDGIKITFAEVETPATPEPAPKNDVNDTLALGGESEEELSAKQTFDVETDTPSNRIDLDFDSLAAAQNGILSGALTQDEETQKRADAD

SEQ ID NO: 3607 - DNA, 228 bp, Neisseria gonorrhoeae
atggaaacattagacgaacgaataaagaatttaggaaaatctcttgaagatagaattgacgctaatctaattgatgccacactagagtacattactttttcagaacgtttgctagcttttgaaacgctatgtgattatattgaagatttcaatatccagcttacggaaaaagaatcccaagaaatctcttttattaataaggaatttggaattgaaagtacatcagat

SEQ ID NO: 3608 - protein, 76 aa, Neisseria gonorrhoeae
METLDERIKNLGKSLEDRIDANLIDATLEYITFSERLLAFETLCDYIEDFNIQLTEKESQEISFINKEFGIESTSD

SEQ ID NO: 3609 - DNA, 228 bp, Neisseria gonorrhoeae
atgagtatccaaaaagcagttgattattttggtaatgaatcccgacttgcacgggcgatcggagttaaacaaccgacggtgtgggcttggaataaaaaaggaacgccgcccccgatcattcggtgcgtgcagattgaaaaattaaccggaggcgcagtgaatcgaaaagacttacgtcctgatgactggcatctaatctggccggaattggcaggcgaccaacccaaa

SEQ ID NO: 3610 - protein, 76 aa, Neisseria gonorrhoeae
MSIQKAVDYFGNESRLARAIGVKQPTVWAWNKKGTPPPIIRCVQIEKLTGGAVNRKDLRPDDWHLIWPELAGDQPK

SEQ ID NO: 3611 - DNA, 153 bp, Neisseria gonorrhoeae
atgaagaagcaggacagaaaccgcctgtcgaagaaagacagacggctgattaaaaaggcgatgctgaaagccgccgccaaaggctgcgatgaggtttacaaaatcgcgccgggtttgaaagacggctttgaattacttggaaagcagcccgat

SEQ ID NO: 3612 - protein, 51 aa, Neisseria gonorrhoeae
MKKQDRNRLSKKDRRLIKKAMLKAAAKGCDEVYKIAPGLKDGFELLGKQPD

SEQ ID NO: 3613 - DNA, 186 bp, Neisseria gonorrhoeae
atgccgtccgacttatccttcatactcgccaaagagcttatccgcagcggttctatccgcttaagcggcagtacggccaaaggacaagccggagaattggcggtattcatccgaacacttcgtcaaaaacccgaagaatcggagccaaataccgatgacgaatatttaatcgggctgctttccaag

SEQ ID NO: 3614 - protein, 62 aa, Neisseria gonorrhoeae
MPSDLSFILAKELIRSGSIRLSGSTAKGQAGELAVFIRTLRQKPEESEPNTDDEYLIGLLSK

SEQ ID NO: 3615 - DNA, 195 bp, Neisseria gonorrhoeae
ttgtttgcattgcgtttgtttttgattcataatcgcctttcgccgttacctgaaccgcttccctgcaattcagggggattacccgccccgtgcgggtttttctttatcggccgcccgtctgtccgggcggtcaaccgtctttccgatttgccgtcaccccgttacaaccgggtttccacacaacggccgacggag

SEQ ID NO: 3616 - protein, 65 aa, Neisseria gonorrhoeae
LFALRLFLIHNRLSPLPEPLPCNSGGLPAPCGFFFIGRPSVRAVNRLSDLPSPRYNRVSTQRPTE

SEQ ID NO: 3617 - DNA, 132 bp, Neisseria gonorrhoeae
gtgacgcagcttgcggcacggataaccgacttggaaggcaggggcttcgtgtttgccaagccgaaatacaaggtcggtaactgtaaaaatcccgttgcccattactcaatcgcaaagtcaggaattgaacca

SEQ ID NO: 3618 - protein, 44 aa, Neisseria gonorrhoeae
VTQLAARITDLEGRGFVFAKPKYKVGNCKNPVAHYSIAKSGIEP

SEQ ID NO: 3619 - DNA, 135 bp, Neisseria gonorrhoeae
atgagccgggaacaaagaatacgcggagcccgcttgccggtgccggctcatatgcaggcggaaggcgcgggcaaggcacgggaagcgttggacgggcgggtcgaagaagtgaaaggggttgatgatgaagccgtc

SEQ ID NO: 3620 - protein, 45 aa, Neisseria gonorrhoeae
MSREQRIRGARLPVPAHMQAEGAGKAREALDGRVEEVKGVDDEAV

SEQ ID NO: 3621 - DNA, 1065 bp, Neisseria gonorrhoeae; identical to SEQ ID NO: 65

SEQ ID NO: 3622 - protein, 355 aa, Neisseria gonorrhoeae; identical to SEQ ID NO: 66

SEQ ID NO: 3623 - DNA, 270 bp, Neisseria gonorrhoeae
atgcaatggaaatttgaagatcctcaaaatactgctgttattaccaccagaagaattttgtctaaaaaaaacggaatcttagaagtatggcatgatgctgatgatggaatgtggcaattcttagatggcaatgaaattcatgaaggagatgctgtgatagttagtttaaaagaaattgtcactattgattcctcagtcaatctcttaagtaatttacctcttggtggttacgcttggagaaatactatatcggaaaaatggaattttgat

SEQ ID NO: 3624 - protein, 90 aa, Neisseria gonorrhoeae
MQWKFEDPQNTAVITTRRILSKKNGILEVWHDADDGMWQFLDGNEIHEGDAVIVSLKEIVTIDSSVNLLSNLPLGGYAWRNTISEKWNFD

SEQ ID NO: 3625 - DNA, 1359 bp, Neisseria gonorrhoeae
atgaaccgaatcgaggaaacggaagcggtccaatcactggccagcgtaggggcggaacagaacattttgggcggcatcttgattgaaccgacggcgattgcgcggtgcgcaatcctgacccctgaaaagttttaccaggcgcaacacaggattattttccgcgctctgctggatatggcggcggcaaacgagcctatcgacatcatcacgctgaacgacaagctggaagcgcgcggcgaggcggaaaacgcgggtggcctggcttacttgatagacctgaaccaaaacaccccaagcgcgaagaatatcagccggtacgttgggattgtgaacgacaggtttgtcgagcgcggcttgctgaaggcttcggcggcgattgaaaaaatcgcggtttccaaagacggcgggacggtcgcagaaaagctgtctaaggcggccgacgaattggcggcagccggcaaagacgcggtaaagcgtgaaaccaagacattcggccagaccgttgaggatttgattggcggtttggacaaaaggcttgacggcgtgcgtttcggattgcctaccggcttgatgaagcttgacgggatgaccggcggtttgccggatggaaacctgattgtgattgcggcgcgtccgtctatgggtaaaacggttttggcggaaaacattgcgcgattcgcgctgaagcagggcaaggcagttcatttccaaagctacgaaatgagcgcggtagagctggcaaggcgcggcatggcggctgagtgcaatatccccatgcagaacctgaaaaccggcaatctgacgcaaagcgattacgccaatatgccgatttacgtcagccaagcgaaagagtggaagtttgacgtgaactgcgacctgctcaacgttgacgagctttgctttttggctaaggagaaaaaactcactaccggcttggatttgttggttgtcgatcaccttcacatcatgccaagggcagggagggacgaggtggcggagttggggaatatatcgcgccgtttgaaaaacttggcggcagagctgaatatccccgtcgtcttggttgcccagttgaacaggggaaacacaaagcaggcagacaaacgcccgaacatggcagacattcgcggcagcggcgcgattgagcaagacgcaaacatcatcatcatgccgcaccgcgaaagctactacgacggaaacgagaatccgagcattgccgagctgattatcgccaagaaccgggacggcgaaacgggaacggtggtttgcggctggaaagggcaatttatgaagttcgaggaagagcctgatttggcatggcaagcccccaaacatgatgaatatgacccttacagtgtc

SEQ ID NO: 3626 - protein, 453 aa, Neisseria gonorrhoeae
MNRIEETEAVQSLASVGAEQNILGGILIEPTAIARCAILTPEKFYQAQHRIIFRALLDMAAANEPIDIITLNDKLEARGEAENAGGLAYLIDLNQNTPSAKNISRYVGIVNDRFVERGLLKASAAIEKIAVSKDGGTVAEKLSKAADELAAAGKDAVKRETKTFGQTVEDLIGGLDKRLDGVRFGLPTGLMKLDGMTGGLPDGNLIVIAARPSMGKTVLAENIARFALKQGKAVHFQSYEMSAVELARRGMAAECNIPMQNLKTGNLTQSDYANMPIYVSQAKEWKFDVNCDLLNVDELCFLAKEKKLTTGLDLLVVDHLHIMPRAGRDEVAELGNISRRLKNLAAELNIPVVLVAQLNRGNTKQADKRPNMADIRGSGAIEQDANIIIMPHRESYYDGNENPSIAELIIAKNRDGETGTVVCGWKGQFMKFEEEPDLAWQAPKHDEYDPYSV

SEQ ID NO: 3627 - DNA, 282 bp, Neisseria gonorrhoeae
atgcgtgaaacctgtttctattgcaaccatgccgacttcaaaaccaacaccggcacgccggtgcgcggttttgcgaaatgcgcgaaggcgcggaatgcggaggaaaaagcgacgtactacccgcgaaccaatccgtgcgccgccggcgcgtttcagacggcatcgggggcggcagtcgcaaaaaggacggcggtgcttggggaatatcccccccgcaatgcgccgaatttgagcgggaaggcgggtaaaacgctttgggaatatcccagcctacccgagatt

SEQ ID NO: 3628 - protein, 94 aa, Neisseria gonorrhoeae
MRETCFYCNHADFKTNTGTPVRGFAKCAKARNAEEKATYYPRTNPCAAGAFQTASGAAVAKRTAVLGEYPPRNAPNLSGKAGKTLWEYPSLPEI

SEQ ID NO: 3629 - DNA, 264 bp, Neisseria gonorrhoeae
ttgcgttttaacgcgttttttaaatctcgggtaggctgggatattcccaaagcgttttacccgccttcccgctcaaattcggcgcattgcgggggggatattccccaagcaccgccgtcctttttgcgactgccgcccccgatgccgtctgaaacgcgccggcggcgcacggattggttcgcgggtagtacgtcgctttttcctccgcattccgcgccttcgcgcatttcgcaaaaccgcgcaccggcgtgccggtgttggttt

SEQ ID NO: 3630 - protein, 88 aa, Neisseria gonorrhoeae
LRFNAFFKSRVGWDIPKAFYPPSRSNSAHCGGDIPQAPPSFLRLPPPMPSETRRRRTDWFAGSTSLFPPHSAPSRISQNRAPACRCWF

SEQ ID NO: 3631 - DNA, 492 bp, Neisseria gonorrhoeae; identical to SEQ ID NO: 169

SEQ ID NO: 3632 - protein, 164 aa, Neisseria gonorrhoeae; identical to SEQ ID NO: 170

SEQ ID NO: 3633 - DNA, 117 bp, Neisseria gonorrhoeae
ttgttttatttcctttcggtcggttttatgggtcggggtcggattcccgccgcctccgtcattcccgcgcaggcgggaatccggaccttggaacaacagcaatattcaaagattatc

SEQ ID NO: 3634 - protein, 39 aa, Neisseria gonorrhoeae
LFYFLSVGFMGRGRIPAASVIPAQAGIRTLEQQQYSKII

SEQ ID NO: 3635 - DNA, 147 bp, Neisseria gonorrhoeae
atggataccctgttaagcatcatcaccgcgctgtcgtttgccggggcggcgacgttggcggtatggcttttggtggaagccgccgacgcggttttgcgccgcaagcgcgaaggcaaaggcgaagacgacttcgacggcttcggatat

SEQ ID NO: 3636 - protein, 49 aa, Neisseria gonorrhoeae
MDTLLSIITALSFAGAATLAVWLLVEAADAVLRRKREGKGEDDFDGFGY

SEQ ID NO: 3637 - DNA, 189 bp, Neisseria gonorrhoeae
ttgcaggtgcgcatttcttccgccattttgatttttccttttgtttttatgtgtttaatatccgaagccgtcgaagtcgtcttcgcctttgccttcgcgcttgcggcgcaaaaccgcgtcggcggcttccaccaaaagccataccgccaacgtcgccgccccggcaaacgacagcgcggtgatgatgct

SEQ ID NO: 3638 - protein, 63 aa, Neisseria gonorrhoeae
LQVRISSAILIFPFVFMCLISEAVEVVFAFAFALAAQNRVGGFHQKPYRQRRRPGKRQRGDDA

SEQ ID NO: 3639 - DNA, 279 bp, Neisseria gonorrhoeae
atggcggaagaaatgcgcacctgcaaggcctgcggcgggaccaagccgttggagaaagggtttaatgccgtcccgcgcaaggaagggggggtctattattacaaatcgtgcaaaacctgccgcaacaaggcagtccggcaaaagcgcgcggaaaaacgcgcggcggcgggagccggcgcgatgacggcggcaaggctgcacggatacatccgcgccgcacacgccgcctgcccgatattgggcgccggcctgtggacgcaaccggcaggggaatgcgcg

SEQ ID NO: 3640 - protein, 93 aa, Neisseria gonorrhoeae
MAEEMRTCKACGGTKPLEKGFNAVPRKEGGVYYYKSCKTCRNKAVRQKRAEKRAAAGAGAMTAARLHGYIRAAHAACPILGAGLWTQPAGECA

SEQ ID NO: 3641 - DNA, 303 bp, Neisseria gonorrhoeae
ttggtggaaatcccgaataagcggttcaaaacgtgtcgctgccgcggcagccatatacagttggcaactgtccggttgtgccgatgggttgccctgccgctccctgagctacgcaacggttgtctgccttgggcgggcgcgggtggcggccgggcggtttgtcgctatgatacggaagttccgatatacaagggcgggcttcagcccgccaaatccaccaactccgccgaatccgccgattcccgccgccgtcattcccgcataagcgggaatccagacctgtcggtgcggaaacttatcgga

SEQ ID NO: 3642 - protein, 101 aa, Neisseria gonorrhoeae
LVEIPNKRFKTCRCRGSHIQLATVRLCRWVALPLPELRNGCLPWAGAGGGRAVCRYDTEVPIYKGGLQPAKSTNSAESADSRRRHSRISGNPDLSVRKLIG

SEQ ID NO: 3643 - DNA, 399 bp, Neisseria gonorrhoeae
gtggacgcaaccggcaggggaatgcgcgtgatacgccttatcctgccttaccccgtatcggcaaaccgatattggcggatttggcgcaacagggcggtcaggagcgcggaggcggcggcgtataaggaaaccgtccgccgtatcgcgcaaggggcgggcgcgatgccgtccgaaggctttgtggcggtgcgcctgcgcctgattcccaaagcgaacaaagacggcggcgcaaacaagacggtgatcgatttggacaacgccctgaaggttgcgctggacgcgcttcaaggcgttgcctatcacaacgacaggcaggtgcggcgcattgccgccgaatatggcggcgagccggtcgcaggcggcggtttggcggtggaggtgggggaattggatgaaaag

SEQ ID NO: 3644 - protein, 133 aa, Neisseria gonorrhoeae
VDATGRGMRVIRLILPYPVSANRYWRIWRNRAVRSAEAAAYKETVRRIAQGAGAMPSEGFVAVRLRLIPKANKDGGANKTVIDLDNALKVALDALQGVAYHNDRQVRRIAAEYGGEPVAGGGLAVEVGELDEK

SEQ ID NO: 3645 - DNA, 615 bp, Neisseria gonorrhoeae
ttgcggcaaacaatacaacctatatccgccactttttgcagatgtgatttttccgcttcggttttacttttcatccaattcccccacctccaccgccaaaccgccgcctgcgaccggctcgccgccatattcggcggcaatgcgccgcacctgcctgtcgttgtgataggcaacgccttgaagcgcgtccagcgcaaccttcagggcgttgtccaaatcgatcaccgtcttgtttgcgccgccgtctttgttcgctttgggaatcaggcgcaggcgcaccgccacaaagccttcggacggcatcgcgcccgccccttgcgcgatacggcggacggtttccttatacgccgccgcctccgcgctcctgaccgccctgttgcgccaaatccgccaatatcggtttgccgatacggggtaaggcaggataaggcgtatcacgcgcattcccctgccggttgcgtccacaggccggcgcccaatatcgggcaggcggcgtgtgcggcgcggatgtatccgtgcagccttgccgccgtcatcgcgccggctcccgccgccgcgcgtttttccgcgcgcttttgccggactgccttgttgcggcaggttttgcacgatttg

SEQ ID NO: 3646 - protein, 205 aa, Neisseria gonorrhoeae
LRQTIQPISATFCRCDFSASVLLFIQFPHLHRQTAACDRLAAIFGGNAPHLPVVVIGNALKRVQRNLQGVVQIDHRLVCAAVFVRFGNQAQAHRHKAFGRHRARPLRDTADGFLIRRRLRAPDRPVAPNPPISVCRYGVRQDKAYHAHSPAGCVHRPAPNIGQAACAARMYPCSLAAVIAPAPAAARFSARFCRTALLRQVLHDL

SEQ ID NO: 3647 - DNA, 231 bp, Neisseria gonorrhoeae
atgaaaagtaaaaccgaagcggaaaaatcacatctgcaaaaagtggcggatataggttgtattgtttgccgcaattgcgggcggttcggcgttcctgccgaggtccgccatatccgaaacggtgcaggcgcgggctgcggtagaatttggaatcatttgggagttttgatgtatagaaccgcttggcggattgtgcggaaggggaaattcagacggccttcgcggaaggtg

SEQ ID NO: 3648 - protein, 77 aa, Neisseria gonorrhoeae
MKSKTEAEKSHLQKVADIGCIVCRNCGRFGVPAEVRHIRNGAGAGCGRIWNHLGVLMYRTAWRIVRKGKFRRPSRKV

SEQ ID NO: 3649 - DNA, 102 bp, Neisseria gonorrhoeae
atgcaacaaaaccaaagtccgcattacaccttccgcgaaggccgtctgaatttccccttccgcacaatccgccaagcggttctatacatcaaaactcccaaa

SEQ ID NO: 3650 - protein, 34 aa, Neisseria gonorrhoeae
MQQNQSPHYTFREGRLNFPFRTIRQAVLYIKTPK

SEQ ID NO: 3651 - DNA, 96 bp, Neisseria gonorrhoeae
ttggcggattgtgcggaaggggaaattcagacggccttcgcggaaggtgtaatgcggactttggttttgttgcatgaaaaagggttaatcaagcta

SEQ ID NO: 3652 - protein, 32 aa, Neisseria gonorrhoeae
LADCAEGEIQTAFAEGVMRTLVLLHEKGLIKL

SEQ ID NO: 3653 - DNA, 405 bp, Neisseria gonorrhoeae; identical to SEQ ID NO: 265

SEQ ID NO: 3654 - protein, 135 aa, Neisseria gonorrhoeae; identical to SEQ ID NO: 266

SEQ ID NO: 3655 - DNA, 156 bp, Neisseria gonorrhoeae
atgctgaagcacatcaaagcccttagatttttgagggtaatatcatttgtgatgagtgcgatttttttttgccctgtcattggctgcaaaaggcggggccgtcacgaatttctttattttgttttttgtgttattgatagcaggctctcttatgag

SEQ ID NO: 3656 - protein, 52 aa, Neisseria gonorrhoeae
MLKHIKALRFLRVISFVMSAIFFCPVIGCKRRGRHEFLYFVFCVIDSRLSYE

SEQ ID NO: 3657 - DNA, 504 bp, Neisseria gonorrhoeae; identical to SEQ ID NO: 267

SEQ ID NO: 3658 - protein, 168 aa, Neisseria gonorrhoeae; identical to SEQ ID NO: 268

SEQ ID NO: 3659 - DNA, 219 bp, Neisseria gonorrhoeae
atgaacaattcagttcaaatctctaatatttctatccatcaaaccgaaatcggcttattcagtctgaatgatttacaccgcgcttcaggcggagaagacagacacgcacgcctcaaagccgccgcaaacgccctcgaagccttaagcgcacacgccgacgcggaacacgcagaaaaaatccgcccgatactgcccgaaatccgcaacctgtcggcggtt

SEQ ID NO: 3660 - protein, 73 aa, Neisseria gonorrhoeae
MNNSVQISNISIHQTEIGLFSLNDLHRASGGEDRHARLKAAANALEALSAHADAEHAEKIRPILPEIRNLSAV

SEQ ID NO: 3661 - DNA, 732 bp, Neisseria gonorrhoeae
gtgtacgagcctgagaccttcaacccgtacaaccctgtcgaaatcgtcatcgacacgcccgaaccggaatctgtcgcccaaactgccgaaaacaaaccggaaaccgtcgataccgatttctacaacaacctgttctcaaacaaccatatcggcacagaagaaacagcttccgcaaaacctgccgcaccctccggactggcaggcttcctgaaggcttcctcgcccgaaaccatcttggaaaaaacagttgccgaagtccaaacaccggaagagttgcacgatttcctgaaagtgtacgaaaccggtgccgtcgcggaaactgcgcctgaaacgcccgatttcaacgccgccgcagacgatttgtccgcattgcttcaacctgccgaagcaccggccgttgaggaaaatgcagcggaaatcactttggaaacgcctgattccaacacctctgaggcagacgctttgcccgacttcctgaaagacagcgaggaggaaacggtagattggagcatctacctctcggaagaaaatatcccaaataatgcagatacctgtttcccttcggaatctgtaggttctgacgcgccttccgaagcgaaatacgaccttgccgaaatgtatctcgaaatcggcgaccgcgatgccgctgccgagacagtgcagaaattgctggaagaagcggaaggcgacgtactcaaacgtgcccaagcattggcgcaggaattgggtatt

SEQ ID NO: 3662 - protein, 244 aa, Neisseria gonorrhoeae
VYEPETFNPYNPVEIVIDTPEPESVAQTAENKPETVDTDFYNNLFSNNHIGTEETASAKPAAPSGLAGFLKASSPETILEKTVAEVQTPEELHDFLKVYETGAVAETAPETPDFNAAADDLSALLQPAEAPAVEENAAEITLETPDSNTSEADALPDFLKDSEEETVDWSIYLSEENIPNNADTCFPSESVGSDAPSEAKYDLAEMYLEIGDRDAAAETVQKLLEEAEGDVLKRAQALAQELGI

SEQ ID NO: 3663 - DNA, 312 bp, Neisseria gonorrhoeae
cgcaacggttgtctgccttgggcgggcgcgggtggcggccgggcggtttgtcgctatgatacggaagttccgatatacaagggcgggcttcagcccgccaaatccaccaactccgccgaatccgccgattcccgccgccgtcattcccgcataagcgggaatccagacctgtcggtgcggaaacttatcggataaaacggtttctttagattttgcgttccggattcccactttcgtgggaatgacggaatgtaggttcgcgggaatgacggcggcggctgcggcaaaattgcccttcccgttttcagacaa

SEQ ID NO: 3664 - protein, 64 aa, Neisseria gonorrhoeae
RNGCLPWAGAGGGRAVCRYDTEVPIYKGGLQPAKSTNSAESADSRRRHSRISGNPDLSVRKLIG

SEQ ID NO: 3665 - DNA, 249 bp, Neisseria gonorrhoeae
ttgttatgtacgggcttaaaaattcatatccttcgggcgtgcgaaaatccccgcaagggtaacgatttgaattatacacctattgccggaaaaaacaacaggccgtctgaagattcagacggcatttgtattccctactgcatcaaaccgccgacaggttgcggatttcgggcagtatcgggcggattttttctgcgtgttccgcgtcggcgtgtgcgcttaaggcttcgagggcgtttgcggcggctt

SEQ ID NO: 3666 - protein, 83 aa, Neisseria gonorrhoeae
LLCTGLKIHILRACENPRKGNDLNYTPIAGKNNRPSEDSDGICIPYCIKPPTGCGFRAVSGGFFLRVPRRRVRLRLRGRLRRL

SEQ ID NO: 3667 - DNA, 447 bp, Neisseria gonorrhoeae; identical to SEQ ID NO: 269

SEQ ID NO: 3668 - protein, 149 aa, Neisseria gonorrhoeae; identical to SEQ ID NO: 270

SEQ ID NO: 3669 - DNA, 1419 bp, Neisseria gonorrhoeae; identical to SEQ ID NO: 67

SEQ ID NO: 3670 - protein, 473 aa, Neisseria gonorrhoeae; identical to SEQ ID NO: 68

SEQ ID NO: 3671 - DNA, 2145 bp, Neisseria gonorrhoeae; identical to SEQ ID NO: 69

SEQ ID NO: 3672 - protein, 715 aa, Neisseria gonorrhoeae; identical to SEQ ID NO: 70

SEQ ID NO: 3673 - DNA, 126 bp, Neisseria gonorrhoeae
ttggtttgctccaaaaaaaagccgccccgcgaaggggcggcaaaacacacccgcctgacccgaaggaatcaagattcaggcatatcccctgccaaaacaggcacaaccgcgcaccggcagttcgga

SEQ ID NO: 3674 - protein, 42 aa, Neisseria gonorrhoeae
LVCSKKKPPREGAAKHTRLTRRNQDSGISPAKTGTTAHRQFG

SEQ ID NO: 3675 - DNA, 1155 bp, Neisseria gonorrhoeae; identical to SEQ ID NO: 311

SEQ ID NO: 3676 - protein, 385 aa, Neisseria gonorrhoeae; identical to SEQ ID NO: 312

SEQ ID NO: 3677 - DNA, 105 bp, Neisseria gonorrhoeae
ttgaaccggcacaggctcaaacagcaggccgtcggcaacaaaatgccgtccgaaacccctaaaggcttcagacggcattggcggcggcggtatcaggtattcgca

SEQ ID NO: 3678 - protein, 35 aa, Neisseria gonorrhoeae
LNRHRLKQQAVGNKMPSETPKGFRRHWRRRYQVFA

SEQ ID NO: 3679 - DNA, 201 bp, Neisseria gonorrhoeae
atgaatagaaacggaggggtagtgaagtctgaccaatctggagaagttttggttcgtcctaaaaagagccaaaaaggtatcacccccccatcaaatgaatggcagattgaccatgtgcaagcaaaaagtaaaggaggttcaaatagttataaaaatgcacaggttttatccagaagagaaaatattaagaaatcaaataaa

SEQ ID NO: 3680 - protein, 67 aa, Neisseria gonorrhoeae
MNRNGGVVKSDQSGEVLVRPKKSQKGITPPSNEWQIDHVQAKSKGGSNSYKNAQVLSRRENIKKSNK

SEQ ID NO: 3681 - DNA, 90 bp, Neisseria gonorrhoeae
ttgtgtgagttggttcacgttcatttatcgctcctgataataaaaaaaccgcctgtaagcggtgttacagacggcctgtttgttttgcct

SEQ ID NO: 3682 - protein, 30 aa, Neisseria gonorrhoeae
LCELVHVHLSLLIIKKPPVSGVTDGLFVLP

SEQ ID NO: 3683 - DNA, 1497 bp, Neisseria gonorrhoeae; identical to SEQ ID NO: 171

SEQ ID NO: 3684 - protein, 499 aa, Neisseria gonorrhoeae; identical to SEQ ID NO: 172

SEQ ID NO: 3685 - DNA, 360 bp, Neisseria gonorrhoeae
atgccgtctgaaaatcagacggctttttcttttggagattttgagatgacagtcaaattaaaagcgcccgaagggtttaccgacgtttccttcggcagccaaagctacgcggcagatgaaaacggtatcgtggaagtgccgtcggaggcggcggaattcctgtatcagttcggttttggcaacgttgcctccgagcctgccgaagggcctgaaaaagccaagcgcgggcgtaaacctaaaaccgggcagccggcaggacaatccgaacctgccgaagctgccgaacctgccgaagccgaagccgaagctgccgaacctgccgaagcagaagccgaacctgccgaagccgaaaaggctgaa

SEQ ID NO: 3686 - protein, 120 aa, Neisseria gonorrhoeae
MPSENQTAFSFGDFEMTVKLKAPEGFTDVSFGSQSYAADENGIVEVPSEAAEFLYQFGFGNVASEPAEGPEKAKRGRKPKTGQPAGQSEPAEAAEPAEAEAEAAEPAEAEAEPAEAEKAE

SEQ ID NO: 3687 - DNA, 528 bp, Neisseria gonorrhoeae; identical to SEQ ID NO: 173

SEQ ID NO: 3688 - protein, 176 aa, Neisseria gonorrhoeae; identical to SEQ ID NO: 174

SEQ ID NO: 3689 - DNA, 330 bp, Neisseria gonorrhoeae
gtgttgggggtaaggacgggggacctgcgacgctccgtacaccagcgcgtgaatgtttccggcaatgtcgtttcgggcgaagtcgatacgaacgtccgttacggcatcgcgcatgagtatggtttcgcgggcagtgtcaacgttaaggcttcgctgcgccaggtcaggcaggcgttcggcaagccgctgaaaccgccgcgatatgtcaacgtccgcgcccatacccgtgatgtgaagttgccggagcggtcgttcctccgttcggcattgcgcgatttgacgccgaagttcgcggacgacctgcaaaaatcgattggaaaggtgttgaaa

SEQ ID NO: 3690 - protein, 110 aa, Neisseria gonorrhoeae
VLGVRTGDLRRSVHQRVNVSGNVVSGEVDTNVRYGIAHEYGFAGSVNVKASLRQVRQAFGKPLKPPRYVNVRAHTRDVKLPERSFLRSALRDLTPKFADDLQKSIGKVLK

SEQ ID NO: 3691 - DNA, 369 bp, Neisseria gonorrhoeae
ttgcaggtcgtccgcgaacttcggcgtcaaatcgcgcaatgccgaacggaggaacgaccgctccggcaacttcacatcacgggtatgggcgcggacgttgacatatcgcggcggtttcagcggcttgccgaacgcctgcctgacctggcgcagcgaagccttaacgttgacactgcccgcgaaaccatactcatgcgcgatgccgtaacggacgttcgtatcgacttcgcccgaaacgacattgccggaaacattcacgcgctggtgtacggagcgtcgcaggtcccccgtccttacccccaacacccgccgataaccggttcagcacaacttcgctttgcaggcgcaatgccgacctgcccaccgatt

SEQ ID NO: 3692 - protein, 123 aa, Neisseria gonorrhoeae
LQVVRELRRQIAQCRTEERPLRQLHITGMGADVDISRRFQRLAERLPDLAQRSLNVDTARETILMRDAVTDVRIDFARNDIAGNIHALVYGASQVPRPYPQHPPITGSAQLRFAGAMPTCPPI

SEQ ID NO: 3693 - DNA, 333 bp, Neisseria gonorrhoeae
ttcccgcataagcgggaatccagacctgtcggtgcggaaacttatcggataaaacggtttctttagattttgcgttccggattcccactttcgtgggaatgacggaatgtaggttcgcgggaatgacggcggcggctgcggcaaaattgcccttcccgttttcagacaactatttgccttgtccttgctacggttttttgccgtaggtcggattctcgaatccgacatttccaacagcggtttttcggaaacgataaacgcgtcaaatgttttttttgtcggatacgaatatccggcctgcatttcaaatttacatcgcttccaatttcgcaa

SEQ ID NO: 3694 - protein, 21 aa, Neisseria gonorrhoeae
FPHKRESRPVGAETYRIKRFL

SEQ ID NO: 3695 - DNA, 426 bp, Neisseria gonorrhoeae
atgaatcgtgaggcggtttattccgcgctgtgggcgaagctggacgcattggacggcttcgtaaccaagagccggaagctggtgcactggaacgatgtgaaacgctacgatcagcctgcgttatttatggcgcagggcgatatgcaggcgttgacattgacggggcgggagaccaagtggattttgcgcgccgatgtttacctgtacgtccagacggcgggccaaccgcccgcgcccgtcatgaatccgctgattgacgcggtgtgcaatgccgtgaacgccgtccaccccgttacgggcaagacggatttaacggcggacggcgcggatatcgagtattgccgcgtcgagggtacggtggaaaccgacgaggggacgcttggcgaacaggcggtttgtattattccgattgtgatttgcgccgcg

SEQ ID NO: 3696 - protein, 142 aa, Neisseria gonorrhoeae
MNREAVYSALWAKLDALDGFVTKSRKLVHWNDVKRYDQPALFMAQGDMQALTLTGRETKWILRADVYLYVQTAGQPPAPVMNPLIDAVCNAVNAVHPVTGKTDLTADGADIEYCRVEGTVETDEGTLGEQAVCIIPIVICAA

SEQ ID NO: 3697 - DNA, 771 bp, Neisseria gonorrhoeae; identical to SEQ ID NO: 175

SEQ ID NO: 3698 - protein, 257 aa, Neisseria gonorrhoeae; identical to SEQ ID NO: 176

SEQ ID NO: 3699 - DNA, 90 bp, Neisseria gonorrhoeae
gtggattcaggagtaatgtttatatgccgtctgaaaaggcggctttttttattcaaccaaagtcaaggaaataaaaatgaccgtacggat

SEQ ID NO: 3700 - protein, 30 aa, Neisseria gonorrhoeae
VDSGVMFICRLKRRLFLFNQSQGNKNDRTD

SEQ ID NO: 3701 - DNA, 327 bp, Neisseria gonorrhoeae
atgaccgtacggattaaaggcgtaaccgtagaactgaacggcgcggattatgtgattccgcctattgcgctgggcgcgttggagcagttgcaggagcgcatcggctcatttgacggcaatgcggcggatgccggacaaatctctaccgttatcgattgcgcccacgccgccctgaagcgcaattacccggatttaacgcgcgaagaagcggccgatttgatcgatatcggcaacatgaacgaagtgtttgccgccgtgatggacgtttcgggcttgaaacgcaaggagcaggaagccgcacaagcgggggaggcccgggcggcggat

SEQ ID NO: 3702 - protein, 109 aa, Neisseria gonorrhoeae
MTVRIKGVTVELNGADYVIPPIALGALEQLQERIGSFDGNAADAGQISTVIDCAHAALKRNYPDLTREEAADLIDIGNMNEVFAAVMDVSGLKRKEQEAAQAGEARAAD

SEQ ID NO: 3703 - DNA, 264 bp, Neisseria gonorrhoeae
gtgattgcccacgtttgcgcctctaccggctggacgtgggactacgtcgccgacaacttggatttgccgcgtatcaaacacctgaacgagtattggcgcgaacatccgcccgtgcatatcttggcagcgtcgtatatgggcgtcaagccgtcgtcgggcagtgtgcaaagcgaagcggacgaagccgaagccgtcggtatgcttggcggcggcgaactgtccgaagacgaatttgacgccctgctcaaagcgaaaggaatcatc

SEQ ID NO: 3704 - protein, 88 aa, Neisseria gonorrhoeae
VIAHVCASTGWTWDYVADNLDLPRIKHLNEYWREHPPVHILAASYMGVKPSSGSVQSEADEAEAVGMLGGGELSEDEFDALLKAKGII

SEQ ID NO: 3705 - DNA, 684 bp, Neisseria gonorrhoeae
ttgcggcgtgttgaaaaccaaaacgcccttgtcggtaacggtgtaatcgcgcccgtacgccaacgccgtgccgccgaccttgacggcgggccgttccttgaccgccgacacaggctcgataaatccgcccatcgaacggacaagctgataacgcgcaacgccctgcaccgtgtttccgacaggctggtcggttacggcgttgtcggccgggtcttcgtaaaggaaactttcaaagctgcctttgcgggcgttgaagaatcccgccagtttttccaactcgtttacggacgcttttgtccgcaatacctcgaacgacagcgaaaaccgccattgcgggtaggtgtagtaggcggttcggaactcacggccgcttgccgatttctgcgtccccgtactccataccgccgttttcttccgcccccacttcaagccggggaactcggggaaaaccgcattgcccatcagatgattcctttcgctttgagcagggcgtcaaattcgtcttcggacagttcgccgccgccaagcataccgacggcttcggcttcgtccgcttcgctttgcacactgcccgacgacggcttgacgcccatatacgacgctgccaagatatgcacgggcggatgttcgcgccaatactcgttcaggtgtttgatacgcggcaaatccaagttgtcggcgacg

SEQ ID NO: 3706 - protein, 228 aa, Neisseria gonorrhoeae
LRRVENQNALVGNGVIAPVRQRRAADLDGGPFLDRRHRLDKSAHRTDKLITRNALHRVSDRLVGYGVVGRVFVKETFKAAFAGVEESRQFFQLVYGRFCPQYLERQRKPPLRVGVVGGSELTAACRFLRPRTPYRRFLPPPLQAGELGENRIAHQMIPFALSRASNSSSDSSPPPSIPTASASSASLCTLPDDGLTPIYDAAKICTGGCSRQYSFRCLIRGKSKLSAT

SEQ ID NO: 3707 - DNA, 597 bp, Neisseria gonorrhoeae; identical to SEQ ID NO: 271

SEQ ID NO: 3708 - protein, 199 aa, Neisseria gonorrhoeae; identical to SEQ ID NO: 272

SEQ ID NO: 3709 - DNA, 135 bp, Neisseria gonorrhoeae
ttgaatatgggcaatggctttgtagccgtctgccgttttgaccaaggtgctgccgtggaaggaacaggtgtaggatttttgaagaacttagttcccaatatcctgtttaaaataaggggaaggtcgcctgaaaat

SEQ ID NO: 3710 - protein, 45 aa, Neisseria gonorrhoeae
LNMGNGFVAVCRFDQGAAVEGTGVGFLKNLVPNILFKIRGRSPEN

SEQ ID NO: 3711 - DNA, 339 bp, Neisseria gonorrhoeae
atgaaactgctccgccgaaaagactatcccgaaggcagatttacccttgccttcgtcggttacggcgacgaaaccgacagcacggttttggaactgacgcacaactgggatacgaaacgatacgacttgggcgacgcctacggacacatcgcggttgaagtggacgatgcctacgaagcctgcgaacgcgtgaagcggcagggcggaaacgtcgtccgcgaagccggcctgatgaaacacggcacaaccgtgatagccttcgtagaagaccccgacggatgcaaaatcgagttcgttcaaaagaaaagcggcgacgattcggttgcctatgcgaatacc

SEQ ID NO: 3712 - protein, 113 aa, Neisseria gonorrhoeae
MKLLRRKDYPEGRFTLAFVGYGDETDSTVLELTHNWDTKRYDLGDAYGHIAVEVDDAYEACERVKRQGGNVVREAGLMKHGTTVIAFVEDPDGCKIEFVQKKSGDDSVAYANT

SEQ ID NO: 3713 - DNA, 159 bp, Neisseria gonorrhoeae
gtggcattgggtacttctgctaatgcatcgaattttggtatttccttagggaaaagcagtgctgccagtggtacgaaaggaattgcagtggggacatcttctcaggcaacaaatttaagtgcggtggcaattggtactgaaagtaaggcacaaaataaa

SEQ ID NO: 3714 - protein, 53 aa, Neisseria gonorrhoeae
VALGTSANASNFGISLGKSSAASGTKGIAVGTSSQATNLSAVAIGTESKAQNK

SEQ ID NO: 3715 - DNA, 90 bp, Neisseria gonorrhoeae
agaactcttttcggatttgttctttaacccattgggaaaaactaattttatttgcaccttatttgcaccttttttataaatataattcaa

SEQ ID NO: 3716 - protein, 8 aa, Neisseria gonorrhoeae
RTLFGFVL

SEQ ID NO: 3717 - DNA, 852 bp, Neisseria gonorrhoeae; identical to SEQ ID NO: 213

SEQ ID NO: 3718 - protein, 284 aa, Neisseria gonorrhoeae; identical to SEQ ID NO: 214

SEQ ID NO: 3719 - DNA, 429 bp, Neisseria gonorrhoeae; identical to SEQ ID NO: 273

SEQ ID NO: 3720 - protein, 143 aa, Neisseria gonorrhoeae; identical to SEQ ID NO: 274

SEQ ID NO: 3721 - DNA, 279 bp, Neisseria gonorrhoeae
atggaaagccgaaccctaatcctccgtcatcttgacgcactgtgcgacacgcctgcccaagccgccaatatgcggttgcgcgccggcctgatgatgcacatcgccgataccgtccgcgaaaacggttggacgcaaaaacaggccgcagaacattgcggcctgacccggccgcgcatcaacgacctgctgaacgggaaaatcgacaaattttcattggatgcgctcgtaaacatcaatgccggactcgggcagtgcatttccttatccttcgcccccgcg

SEQ ID NO: 3722 - protein, 93 aa, Neisseria gonorrhoeae
MESRTLILRHLDALCDTPAQAANMRLRAGLMMHIADTVRENGWTQKQAAEHCGLTRPRINDLLNGKIDKFSLDALVNINAGLGQCISLSFAPA

SEQ ID NO: 3723 - DNA, 105 bp, Neisseria gonorrhoeae
ttggcgttttcggggaattgccgcaggcaatccaatgaaccgcctgaaaaatttaacggtttcatattttatatctgttttgatataagtaaattatatcgattt

SEQ ID NO: 3724 - protein, 35 aa, Neisseria gonorrhoeae
LAFSGNCRRQSNEPPEKFNGFIFYICFDISKLYRF

SEQ ID NO: 3725 - DNA, 4143 bp, Neisseria gonorrhoeae; identical to SEQ ID NO: 177

SEQ ID NO: 3726 - protein, 1381 aa, Neisseria gonorrhoeae; identical to SEQ ID NO: 178

SEQ ID NO: 3727 - DNA, 414 bp, Neisseria gonorrhoeae
ttggcggcggcggtatcaggtattcgcataggcaaccgaatcgtcgccgcttttcttttgaacgaactcgattttgcatccgtcggggtcttctacgaaggctatcacggttgtgccgtgtttcatcaggccggcttcgcggacgacgtttccgccctgccgcttcacgcgttcgcaggcttcgtaggcatcgtccacttcaaccgcgatgtgtccgtaggcgtcgcccaagtcgtatcgtttcgtatcccagttgtgcgtcagttccaaaaccgtgctgtcggtttcgtcgccgtaaccgacgaaggcaagggtaaatctgccttcgggatagtcttttcggcggagcagtttcatacccaaaacgttttggtaggaatcgagggatttttcgagattgcccacgcggagcta

SEQ ID NO: 3728 - protein, 138 aa, Neisseria gonorrhoeae
LAAAVSGIRIGNRIVAAFLLNELDFASVGVFYEGYHGCAVFHQAGFADDVSALPLHAFAGFVGIVHFNRDVSVGVAQVVSFRIPVVRQFQNRAVGFVAVTDEGKGKSAFGIVFSAEQFHTQNVLVGIEGFFEIAHAEL

SEQ ID NO: 3729 - DNA, 2205 bp, Neisseria gonorrhoeae
catcgcttccaatttcgcaaacttggtatccagctctttcacgccctgtttgccgaagttgatggtcagtcgggcggattcgcctttgtctgcggcatcgataatcacgccggtgccgaatttggcgtgacggacgttttgtccgatgcggaagcctgcgtaggtttgcggctgtttgaagtcatcgatgattttgtcccgttgtacggtggtttggcgcgtgttgccgtagctgtcgaaggcgggttttttgacggacaggtagtgcaatacttctggcgggatttcttcgacgaagcgggatgcgatgccgaattgggtttgtccgtgcagcatgcgttgctgtgccatggtgatgtagaggcgtttgcgggcgcgggtgatggcgacgtacatgaggcggcgttcttcttcgaggccgccgcgctcggcaaggctcatttcgctggggaaacgcccctcttccataccggtgaggaagacggcgttgaattccaagcctttggcggcgtggacggtcatcagttggacggctttttcgcctgcccctgcttggttttcgccggattcgagggcggcgttgctcaagaaggcgaggatggggaaggcgggatcgtctgaaatgttttcgggcagggtttcaaagttgctgtcttcgggtttgaactcgatggcggcgttgacgagttcgtcaaggttgtcgaggcggtcttggttgtcgcctttttgggttcggtagtgctcggtcagaccgctgtctttgaggatgccgacgatgatttcggacaggtgcatttgtccgacttggttgcgcagggcttcaatcaggcggacgaaggcgacgactttggcggctttcgcgccggcgttgcaggctgcctgccagagggtgatgccttgttcgtttgaggccgtctgaaggttttcgacggtgcgcgcgccgatgccgcgcggtgggaagttgatgacacgcaagagggcgttgtcgtcgtcgggattgacggcgaggcgcaggtaggcgagggcgtgtttgatttcttggcgttcgtaaaagcgcaggccgccgtagattttgtaggggatgccgctgcggaacaggctttgttcgatgacgcgcgattgggcgttgctgcggtagaggacggcgatttcgtccaaatcccagccttcgcgttcgagggctttggtttcatccacgatgaaccgggcttcttcgaggtcggtaaaggcggagtagtagcggattttgtcgcctgcttcggcgtcggtgcgcaggtttttgccgagacgttcgtcgttgttttcgataacggcgttggcggcggcgaggatgttgccgacggagcggtagttttgttcgagtttgacgggcgcgtcgatgtggaattcttccatcagtgcggtcatgttgccgacgtttgcgccgcggaagcggtaaatgctttggtcgtcgtcgccgacggcaaataccgctgcgttaccgcccgccatgagtttgagccaggcgtattgcagtttgttggtgtcttgaaactcgtcgaccagaatgtggttgaagcggttttggtagtgccggcgcaggatttcgttactttgcagcatttcgtagctgcggagcatgagttcggcgaaatcgaccacgccttcgcgttggcagattttgtcgtattcggcgtagcacccaatcatgcggcttgtgtgcggatcgggcgcgcccaagacggaagcgcgcaaaccggattctttttgcgcgttgataaagccttgcagcgaacgcggcgcgatgatttcttcggcgatgttgaggcttttgagcaggcgtttgatgagggaaagctggtcgccgctgtcgaggatttgaaaggaagacggcaggcctgcgtcgcggtggtgcaggcgcaaaaagcggtggcacaaaccgtggaacgtgccgagccacatagcgcggacgttgatgggaatcattgcgccgagtcgggtttgcatctctttggcggccttgttggtaaacgttaccgccataatgctgtgtacgctggcttgtccgctttgcaaaagccatgcgatacgcgtggtcagcacgcgcgttttgccgctgcctgcgcctgccaaaacgagggcggattgcggcggccaggttacggcggagagttgttcggggttcaagccttgcagcagattgggggcggattggtcgggaaacat

SEQ ID NO: 3730 - protein, 206 aa, Neisseria gonorrhoeae
HRFQFRKLGIQLFHALFAEVDGQSGGFAFVCGIDNHAGAEFGVTDVLSDAEACVGLRLFEVIDDFVPLYGGLARVAVAVEGGFFDGQVVQYFWRDFFDEAGCDAELGLSVQHALLCHGDVEAFAGAGDGDVHEAAFFFEAAALGKAHFAGETPLFHTGEEDGVEFQAFGGVDGHQLDGFFACPCLVFAGFEGGVAQEGEDGEGGIV

SEQ ID NO: 3731 - DNA, 540 bp, Neisseria gonorrhoeae; identical to SEQ ID NO: 1

SEQ ID NO: 3732 - protein, 180 aa, Neisseria gonorrhoeae; identical to SEQ ID NO: 2

SEQ ID NO: 3733 - DNA, 303 bp, Neisseria gonorrhoeae
atgattgaagataaaaagattgttgccttgaattttgcagtcgaggacggtatgaccggcgcgagtgcggcctaccacgtcgtcgaacatatcggcgcggattaccgcaacggttatgttacggcgacgttgaacggctatgtgtcggaaaatgcgtttaaatcgggcaaacgctacctgttggcgcgcacattggattttcaggaaacggacataaccgcgcccgaccccggttgggtgtaccgcaaggcgttggaaggtgcggcgggcatccccaaagacgcgcaaccggtttacgcggaa

SEQ ID NO: 3734 - protein, 101 aa, Neisseria gonorrhoeae
MIEDKKIVALNFAVEDGMTGASAAYHVVEHIGADYRNGYVTATLNGYVSENAFKSGKRYLLARTLDFQETDITAPDPGWVYRKALEGAAGIPKDAQPVYAE

SEQ ID NO: 3735 - DNA, 477 bp, Neisseria gonorrhoeae
gtgacgggtatgttgaggtttttgacggaacggcggtttttgcccgccgggtttcaggcgtggttgttcggcacggcgacgcgggtgctggaggcggtcatcggtttgggcttgtcgggttacgcggcggtgttcgcgcttgcgcccgacgagatttacgcgtggcggatttattacaaattccaggatattccggaggcgtggacggtgggggtgctggcggcggcggggctgcttcagacggcattgctgtttgcgcggggcgtgagggcttgtgtggcttcggcctacctgcttttgttttcgggctttgtgtggtttttggtttcggtggcgttttggggggcgtacccgcctttgaacacgggtatggtcgttccgccgctgttggcgtttttctgcgcgctggcggggaataatgcgttgaggtttttgttttcggcgcaaaagtcgcggggtttggcggatgaggggtcg

SEQ ID NO: 3736 - protein, 159 aa, Neisseria gonorrhoeae
VTGMLRFLTERRFLPAGFQAWLFGTATRVLEAVIGLGLSGYAAVFALAPDEIYAWRIYYKFQDIPEAWTVGVLAAAGLLQTALLFARGVRACVASAYLLLFSGFVWFLVSVAFWGAYPPLNTGMVVPPLLAFFCALAGNNALRFLFSAQKSRGLADEGS

SEQ ID NO: 3737 - DNA, 330 bp, Neisseria gonorrhoeae
atggggtttttgcagttcggactgctgtttgccgcggccggcggcgtgctgggcgcggtgtgggcaagccttcaggaacgcggccgcccggtgcaggctgtgctggaggcttttatttctgcaatcgcggcggcggccgcggcggagcggttcgtgccgctggatcaggcgtggacgtgcgcggcggcgggggtgttcgcggggatgatgacggggcacgcgctcgatacggtgcgcgcgctcgcgcccaaggtgttgcgcggttacttgggcggcttggcggaaaagcttacgggtgtgaaagacggagggtcttcggatggaaaagat

SEQ ID NO: 3738 - protein, 110 aa, Neisseria gonorrhoeae
MGFLQFGLLFAAAGGVLGAVWASLQERGRPVQAVLEAFISAIAAAAAAERFVPLDQAWTCAAAGVFAGMMTGHALDTVRALAPKVLRGYLGGLAEKLTGVKDGGSSDGKD

SEQ ID NO: 3739 - DNA, 933 bp, Neisseria gonorrhoeae
atgtcgtgcgtcagccggacgctgcccggaacacagcgtcttcacgcgccccgataccgctcgaaatcaatcttttccatccgaagaccctccgtctttcacacccgtaagcttttccgccaagccgcccaagtaaccgcgcaacaccttgggcgcgagcgcgcgcaccgtatcgagcgcgtgccccgtcatcatccccgcgaacacccccgccgccgcgcacgtccacgcctgatccagcggcacgaaccgctccgccgcggccgccgccgcgattgcagaaataaaagcctccagcacagcctgcaccgggcggccgcgttcctgaaggcttgcccacaccgcgcccagcacgccgccggccgcggcaaacagcagtccgaactgcaaaaaccccattcacgacccctcatccgccaaaccccgcgacttttgcgccgaaaacaaaaacctcaacgcattattccccgccagcgcgcagaaaaacgccaacagcggcggaacgaccatacccgtgttcaaaggcgggtacgccccccaaaacgccaccgaaaccaaaaaccacacaaagcccgaaaacaaaagcaggtaggccgaagccacacaagccctcacgccccgcgcaaacagcaatgccgtctgaagcagccccgccgccgccagcacccccaccgtccacgcctccggaatatcctggaatttgtaataaatccgccacgcgtaaatctcgtcgggcgcaagcgcgaacaccgccgcgtaacccgacaagcccaaaccgatgaccgcctccagcacccgcgtcgccgtgccgaacaaccacgcctgaaacccggcgggcaaaaaccgccgttccgtcaaaaacctcaacatacccgtcacacaccccccggcaaaacaccgcgaagccgaagccccgcagtgtccgacgccgtc

SEQ ID NO: 3740 - protein, 311 aa, Neisseria gonorrhoeae
MSCVSRTLPGTQRLHAPRYRSKSIFSIRRPSVFHTRKLFRQAAQVTAQHLGRERAHRIERVPRHHPREHPRRRARPRLIQRHEPLRRGRRRDCRNKSLQHSLHRAAAFLKACPHRAQHAAGRGKQQSELQKPHSRPLIRQTPRLLRRKQKPQRIIPRQRAEKRQQRRNDHTRVQRRVRPPKRHRNQKPHKARKQKQVGRSHTSPHAPRKQQCRLKQPRRRQHPHRPRLRNILEFVINPPRVNLVGRKREHRRVTRQAQTDDRLQHPRRRAEQPRLKPGGQKPPFRQKPQHTRHTPPGKTPRSRSPAVSDAV

SEQ ID NO: 3741 - DNA, 720 bp, Neisseria gonorrhoeae
gtgcgccgcgcctttgacggcgttgatttggaagccggcggatattttgaatgctttgaaataggggcgggtatggaaacggatgcttccccctgcggacaggcttcgcactctgaagtcagtcgaacagtactgcgccgatgcgtgccaatacgtcttcaatcacgtaatcggggacggtttcgcggaaggcggcgcggcggattttccaatccaatgccttcatccggtggcagtggacattgccttgtgttgccgttcccgtgccgagcagtgtggaaatcataccgccgcttcttgccgccgccgccctgccttgtgaaatcgggcaggcgtaaaccaagccggttgcgcggttgtaagctctgggcgacagggctatggcgtaatggccgcctttcatttccgtaccggcggcggggtcgaaggcaagatggaaaatgtcgcctcgctcgggaatatacatcaaacgccctcctgtccgacatcgggcatttcttcccagccttccgcgcgcggcggggcggcttccgtttctgccaaaaggtcggacaggcggtagcgtttgacggggcggatgagcagctcgccgttgcggatttctgtttccagcgcgtcgccgattttggcgttgagggcggtcaggaggcgggcgggcagacggactgccgcgctgttgccccatttttgcagtcgcaacatggttttgctttcgtgttg

SEQ ID NO: 3742 - protein, 240 aa, Neisseria gonorrhoeae
VRRAFDGVDLEAGGYFECFEIGAGMETDASPCGQASHSEVSRTVLRRCVPIRLQSRNRGRFRGRRRGGFSNPMPSSGGSGHCLVLPFPCRAVWKSYRRFLPPPPCLVKSGRRKPSRLRGCKLWATGLWRNGRLSFPYRRRGRRQDGKCRLAREYTSNALLSDIGHFFPAFRARRGGFRFCQKVGQAVAFDGADEQLAVADFCFQRVADFGVEGGQEAGGQTDCRAVAPFLQSQHGFAFVL

SEQ ID NO: 3743 - DNA, 348 bp, Neisseria gonorrhoeae
ttgatgtatattcccgagcgaggcgacattttccatcttgccttcgaccccgccgccggtacggaaatgaaaggcggccattacgccatagccctgtcgcccagagcttacaaccgcgcaaccggcttggtttacgcctgcccgatttcacaaggcagggcggcggcggcaagaagcggcggtatgatttccacactgctcggcacgggaacggcaacacaaggcaatgtccactgccaccggatgaaggcattggattggaaaatccgccgcgccgccttccgcgaaaccgtccccgattacgtgattgaagacgtattggcacgcatcggcgcagtactgttcgac

SEQ ID NO: 3744 - protein, 116 aa, Neisseria gonorrhoeae
LMYIPERGDIFHLAFDPAAGTEMKGGHYAIALSPRAYNRATGLVYACPISQGRAAAARSGGMISTLLGTGTATQGNVHCHRMKALDWKIRRAAFRETVPDYVIEDVLARIGAVLFD

SEQ ID NO: 3745 - DNA, 234 bp, Neisseria gonorrhoeae
atgttgcgactgcaaaaatggggcaacagcgcggcagtccgtctgcccgcccgcctcctgaccgccctcaacgccaaaatcggcgacgcgctggaaacagaaatccgcaacggcgagctgctcatccgccccgtcaaacgctaccgcctgtccgaccttttggcagaaacggaagccgccccgccgcgcgcggaaggctgggaagaaatgcccgatgtcggacaggagggcgtt

SEQ ID NO: 3746 - protein, 78 aa, Neisseria gonorrhoeae
MLRLQKWGNSAAVRLPARLLTALNAKIGDALETEIRNGELLIRPVKRYRLSDLLAETEAAPPRAEGWEEMPDVGQEGV

SEQ ID NO: 3747 - DNA, 114 bp, Neisseria gonorrhoeae
ttggataataaagtgggtcggatagtcggcaaacgtagtccgtttgaaacgcttttacttttcagacggactttctaccaatgggaacaaggcgttttgtctcaatccggttta

SEQ ID NO: 3748 - protein, 38 aa, Neisseria gonorrhoeae
LDNKVGRIVGKRSPFETLLLFRRTFYQWEQGVLSQSGL

SEQ ID NO: 3749 - DNA, 1167 bp, Neisseria gonorrhoeae
atggacaacgaattgtggattatcctgctgccgattatccttttgcccgtcttcttcacgatgggctggtttgccgcccgcgtggatatgaaaaccgtattgaagcaggcaaaaagcatcccttcgggattttataaaagcctggacgctttggtcgaccgcaacagcgggcgcgcggcaagggagttggcggaagtcgtcgacggccggccgcaatcgtatgatttgaaccttaccctcggcaaactttaccgtcagcgcggcgaaaacgacaaagccatcaacatacaccggacaatgctcgattctcccgatacggtcggcgaaaagcgcgcgcgcgtcctgtttgaattggcgcaaaactaccaaagcgcgggtttggtcgatcgtgccgaacagatttttttggggctgcaagacggtgaaatggcgcgtgaagccagacagcacctgctcaatatctaccagcaggacagggattgggaaaaagcggttgaaaccgcccaacttcttagtcacgacgaacagacatatcagtttgagattgcacagttttattgcgaacttgcccaagccgcgctgttcaagtccaatttcgatgccgcgcgtttcaatgtcggcaaggcactcgaagccaacaaaaaatgcacccgcgccaacatgattttgggcgacattgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagggcgagaaagaagccgcgcaaaccgccgtcgagcttgtccgccgcaagcccgaccttaacggcgtgtaccgcctgctcggtttgaaactcagcgatttggatccggcttggaaagccgatgccgacatgatgcgttcggttatcggacggcagctccagcgcagcgtgatgtaccgttgccgcaactgccacttcaaatcccaagtctttttctggcactgtcccgcctgcaacaaatggcagacgtttacgccgaataaaatcgaagtt

SEQ ID NO: 3750 - protein, 389 aa, Neisseria gonorrhoeae
MDNELWIILLPIILLPVFFTMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGEMAREARQHLLNIYQQDRDWEKAVETAQLLSHDEQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKGEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 3751 - DNA, 537 bp, Neisseria gonorrhoeae
atgaaagaattgaaatggattgaagaagcccgtaaataccttggcgctcacgaaaaagtgaatggcaagtcaaaccctgtgcttttagcgatgctgcaagaaatgggaaattttaatcaggagcagaaagcgtggtggaaagaaacagatacgccgtggtgcggcctgtttgtcggatactgcctgggcaaaagcggacgcgcggtcatcagggactggtatcgcgccaaagcctggtcaatgtcgggtttgacgaaactcgaagcccccgcatacggctgcatcgcggtcaaaccgcgccggggcggcggacacgtgttcttcgttgtcggcaaagacgcggaaggcagaatcttgggcttgggcggcaatcagggcaatatggtatccatcatcccgtttgaccctgcggacattgacggctacttctggccgtccaagctgattggcggcaaagccgtgccttcgtcccccgccgaagggcgttaccggttgtcggacgttgccgccacggcgaaacagggcgcgggcgaggcg

SEQ ID NO: 3752 - protein, 179 aa, Neisseria gonorrhoeae
MKELKWIEEARKYLGAHEKVNGKSNPVLLAMLQEMGNFNQEQKAWWKETDTPWCGLFVGYCLGKSGRAVIRDWYRAKAWSMSGLTKLEAPAYGCIAVKPRRGGGHVFFVVGKDAEGRILGLGGNQGNMVSIIPFDPADIDGYFWPSKLIGGKAVPSSPAEGRYRLSDVAATAKQGAGEA

SEQ ID NO: 3753 - DNA, 342 bp, Neisseria gonorrhoeae; identical to SEQ ID NO: 123

SEQ ID NO: 3754 - protein, 114 aa, Neisseria gonorrhoeae; identical to SEQ ID NO: 124

SEQ ID NO: 3755 - DNA, 126 bp, Neisseria gonorrhoeae; identical to SEQ ID NO: 3179

SEQ ID NO: 3756 - protein, 42 aa, Neisseria gonorrhoeae; identical to SEQ ID NO: 3180

SEQ ID NO: 3757 - DNA, 969 bp, Neisseria gonorrhoeae
ttggtgcgcctgataattttgtataacgcccccttcgcgcaaacaaaacggcaaaaatttgccgcgtccgcccgatatgtaaaaaatcggggggaatgccgacacttcccccgatgcggccgccaacccggaaccgacggttcggttgcaaacttccggttgacaactcaatccgcgcccaacgcccgtaccagcgcgccgtgccgcgccctgcagtcgttatacataccggccgccttcagggcccacggcagcacgtccgcgcccgtgttcccttcaaggtgcggcagtttcgggcagggccgcaccaaatcggcgggcggcttaaccgccgtcgtcaacggcggcgttgagttcgcgcacgccgtcagcatcaaaacaggcattgcggtacacaggtttttcaatgattttaagcgtttgcacatagcgcaccctttctttttcctcgcgcgccgccttttgcgcctgatacgcggcggacgatttgcgggcgtgttcggcgtgttcgaccgcggcggctttgaggcgttccgaaacctccgacaccgccgcaccgtatccgcgacggtattgcgccgccctgtccagctgccaagaaacggcgaagaacgcgattgcggacaaaataagcagcggcttccaatttttcagcaaagccccaatcatttacgcctcgcccgcgccctgtttcgccgtggcggcaacgtccgacaaccggtaacgcccttcggcgggggacgaaggcacggctttgccgccaatcagcttggacggccagaagtagccgtcaatgtccgcagggtcaaacgggatgatggataccatattgccctgattgccgcccaagcccaagattctgccttccgcgtctttgccgacaacgaagaacacgtgtccgccgccccggcgcggtttgaccgcgatgcagccgtatgcgggggcttcgagtttcgtcaaacccgacat

SEQ ID NO: 3758 - protein, 323 aa, Neisseria gonorrhoeae
LVRLIILYNAPFAQTKRQKFAASARYVKNRGECRHFPRCGRQPGTDGSVANFRLTTQSAPNARTSAPCRALQSLYIPAAFRAHGSTSAPVFPSRCGSFGQGRTKSAGGLTAVVNGGVEFAHAVSIKTGIAVHRFFNDFKRLHIAHPFFFLARRLLRLIRGGRFAGVFGVFDRGGFEAFRNLRHRRTVSATVLRRPVQLPRNGEERDCGQNKQRLPIFQQSPNHLRLARALFRRGGNVRQPVTPFGGGRRHGFAANQLGRPEVAVNVRRVKRDDGYHIALIAAQAQDSAFRVFADNEEHVSAAPARFDRDAAVCGGFEFRQTRH

SEQ ID NO: 3759 - DNA, 120 bp, Neisseria gonorrhoeae
atgccgtccgaaagcctttcagagtgcgaagcctgcccgcagggtgcggcatcggttgttgtccggatcggtacggcattttcatttccgcccattattggtgcgcctgataattttgta

SEQ ID NO: 3760 - protein, 40 aa, Neisseria gonorrhoeae
MPSESLSECEACPQGAASVVVRIGTAFSFPPIIGAPDNFV

SEQ ID NO: 3761 - DNA, 147 bp, Neisseria gonorrhoeae
atgaacgccgaaggattttgtgaaaaacaaaccgcctgccggccggacgggcgccgaaatgcgggcgatcgtgccgatttgaaggcctttgaatttgccgaacaggaattggcgaattatcgggaaatgttgaaacgttatgccgtc

SEQ ID NO: 3762 - protein, 49 aa, Neisseria gonorrhoeae
MNAEGFCEKQTACRPDGRRNAGDRADLKAFEFAEQELANYREMLKRYAV

SEQ ID NO: 3763 - DNA, 3045 bp, Neisseria gonorrhoeae; identical to SEQ ID NO: 179

SEQ ID NO: 3764 - protein, 1015 aa, Neisseria gonorrhoeae; identical to SEQ ID NO: 180

SEQ ID NO: 3765 - DNA, 447 bp, Neisseria gonorrhoeae; identical to SEQ ID NO: 141

SEQ ID NO: 3766 - protein, 149 aa, Neisseria gonorrhoeae; identical to SEQ ID NO: 142

SEQ ID NO: 3767 - DNA, 1329 bp, Neisseria gonorrhoeae
gtgccagaaaaagacttgggatttgaagtggcagttgcggcaacggtacatcacgctgcgctggagctgccgtccgataaccgaacgcatcatgtcggcatcggctttccaagccggatccaaatcgctgagtttcaaaccgagcaggcggtacacgccgttaaggtcgggcttgcggcggacaagctcgacggcggtttgcgcggcttctttctcgcccttaagcagcagggatttctcgtacacgacattgatcaggtcaagttcgggaaacgtctgcatatatcctgtcagacggttcaagccttcttcaggttttccctgcgcggcataggcttcgtaaagcttctcgccgaccatgctcaagtatgcatggttttgctgctcgatggcggcataggcttcgacggcggcagggaaattgccttgtcggtgttcaatgtcgcccaaaatcatgttggcgcgggtgcattttttgttggcttcgagtgccttgccgacattgaaacgcgcggcatcgaaattggacttgaacagcgcggcttgggcaagttcgcaataaaactgtgcaatctcaaactgatatgtctgttcgtcgtgactaagaagttgggcggtttcaaccgctttttcccaatccctgtcctgctggtagatattgagcaggtgctgtctggcttcacgcgccatttcaccgtcttgcagccccaaaaaaatctgttcggcacgatcgaccaaacccgcgctttggtagttttgcgccaattcaaacaggacgcgcgcgcgcttttcgccgaccgtatcgggagaatcgagcattgtccggtgtatgttgatggctttgtcgttttcgccgcgctgacggtaaagtttgccgagggtaaggttcaaatcatacgattgcggccggccgtcgacgacttccgccaactcccttgccgcgcgcccgctgttgcggtcgaccaaagcgtccaggcttttataaaatcccgaagggatgctttttgcctgcttcaatacggttttcatatccacgcgggcggcaaaccagcccatcgtgaagaagacgggcaaaaggataatcggcagcaggataatccacaattcgttgtccatatcggctttcttaaggctgtttggcagattcggcagcattttgtatcggcggtgcagtcaatttctgtccgctcaagcgcgcacttttcttcacttccgcacgcaggcggctgttttcgccgcgcaaggacagcagccgcccgaacagggcaaacattccgaacacgatgccgacgacaaacgcgccgaacaatacgacaatcagcggcagat

SEQ ID NO: 3768 - protein, 443 aa, Neisseria gonorrhoeae
VPEKDLGFEVAVAATVHHAALELPSDNRTHHVGIGFPSRIQIAEFQTEQAVHAVKVGLAADKLDGGLRGFFLALKQQGFLVHDIDQVKFGKRLHISCQTVQAFFRFSLRGIGFVKLLADHAQVCMVLLLDGGIGFDGGREIALSVFNVAQNHVGAGAFFVGFECLADIETRGIEIGLEQRGLGKFAIKLCNLKLICLFVVTKKLGGFNRFFPIPVLLVDIEQVLSGFTRHFTVLQPQKNLFGTIDQTRALVVLRQFKQDARALFADRIGRIEHCPVYVDGFVVFAALTVKFAEGKVQIIRLRPAVDDFRQLPCRAPAVAVDQSVQAFIKSRRDAFCLLQYGFHIHAGGKPAHREEDGQKDNRQQDNPQFVVHIGFLKAVWQIRQHFVSAVQSISVRSSAHFSSLPHAGGCFRRARTAAARTGQTFRTRCRRQTRRTIRQSAAD

SEQ ID NO: 3769 - DNA, 231 bp, Neisseria gonorrhoeae
gtgtctatggacataaaattcaatactttgggggttatcctgaatggggtcaatcctgaagaaaaattcataaaaattattgatggccaggaaaataccggtggatttctgatactgttatcttcaaatgacaaattctcatcatttgacagttacgatgactgggtcgaaaacttagaaatattaaaagaatacctgcaagaatctcattggataataaagtgggtcgga

SEQ ID NO: 3770 - protein, 77 aa, Neisseria gonorrhoeae
VSMDIKFNTLGVILNGVNPEEKFIKIIDGQENTGGFLILLSSNDKFSSFDSYDDWVENLEILKEYLQESHWIIKWVG

SEQ ID NO: 3771 - DNA, 510 bp, Neisseria gonorrhoeae
gtgatttccgcctttcagacggctgggacggcaatgactgacaacctaatacagatagcaacgccgatattgactgttatcggcgtttttgttgccgcttacggcatcatgaggaatacggaaaacgccaaaaagcgcgccaccatcgacatgatcatggccgaacgtaacaatgccgcccttcaagaagccataaccatagtaaacgggctggcaaaaacagacggatgcatactcgccacctatacatcagataccccggacaagaagaaagaccgtgaagccatactgacagttttaaaccagcgcgaatttgtctgtgcgggcgtattgggcggggcgctgcacgagaaaatgtataaagatttcgaatactccatgctgttacgcgactgggacaacctaagcagcttcatttttgaaatacgccgtatcaggagcgcgccgacggcctttcaagaatttgaagccgtagcccggaaatggaagaaaaagcctctgaaaaccaaa

SEQ ID NO: 3772 - protein, 170 aa, Neisseria gonorrhoeae
VISAFQTAGTAMTDNLIQIATPILTVIGVFVAAYGIMRNTENAKKRATIDMIMAERNNAALQEAITIVNGLAKTDGCILATYTSDTPDKKKDREAILTVLNQREFVCAGVLGGALHEKMYKDFEYSMLLRDWDNLSSFIFEIRRIRSAPTAFQEFEAVARKWKKKPLKTK

SEQ ID NO: 3773 - DNA, 1014 bp, Neisseria gonorrhoeae
ttgcacccgaattgcacccgaataaatatggcaaccatcactcaacgtaacggcaaatggcgcgtacaaatccgtatgaaaggcgtttcccgttccgccacatttgagcgggcatcagacgcgaaggcgtgggcggcgcgaatagagtcgcaaattatggacggcatccaaggcaatgccccgcgaaatactatctttgccgaccttatccggcggtatttatccgaggttacaccatcaaagcggggcgcacgggaagaatcataccgcattggacgcgcactaaaaacacctttggcaaaggtgcggcttgccgacctgcgccctcaagacttcgccgattggcgagatcaacggttgcaggaggtatcccccaccagcgtcggacgcgaattaaccactttatccgccgtctgcgaacacgccatgaaagagtggggacttcttcgcgaaaaccctgtacgcaaaatcagcaagccgaaaaaaagccgggcaaggacaagacggccaaccgagcaggaaattgccgatatttgcgccgccctcctataccggcctaatgagaaaccgaaaatggcggtgcaacgggttgccgttgccgtcctatttgccatcgaaaccgccatgcgggcaggcgaaatctgcggcctaaaatgggcagatgtgaatatgcggcgtcgtattgcccacctcccaataactaaaaacggcgacagccgtgacgtgccattatccttgcgagccgccgaactaatagagcaactgcgcggaattgatgacacatgggtgtttagcctggatgccaaaagccttgatgtattattcaggcgagcgcgggataattgcggcatacaaggcctgcattttcacgacacccgccgcgaagccctcacgcgcctatcaaaaaaagtgcctgtggaggtcttggcaaaaatcagcgggcatcgggatttaaggattttactcaatgtttactaccgccccgacatggcggatattgcaaaaatgttggat

SEQ ID NO: 3774 - protein, 338 aa, Neisseria gonorrhoeae
LHPNCTRINMATITQRNGKWRVQIRMKGVSRSATFERASDAKAWAARIESQIMDGIQGNAPRNTIFADLIRRYLSEVTPSKRGAREESYRIGRALKTPLAKVRLADLRPQDFADWRDQRLQEVSPTSVGRELTTLSAVCEHAMKEWGLLRENPVRKISKPKKSRARTRRPTEQEIADICAALLYRPNEKPKMAVQRVAVAVLFAIETAMRAGEICGLKWADVNMRRRIAHLPITKNGDSRDVPLSLRAAELIEQLRGIDDTWVFSLDAKSLDVLFRRARDNCGIQGLHFHDTRREALTRLSKKVPVEVLAKISGHRDLRILLNVYYRPDMADIAKMLD

SEQ ID NO: 3775 - DNA, 93 bp, Neisseria gonorrhoeae
ttgggacaattcggtggcacaaaatataagctgtctgcttttcagcgggcggctttttatctgcctatgtgtttcaacacacaaaacggcaca

SEQ ID NO: 3776 - protein, 31 aa, Neisseria gonorrhoeae
LGQFGGTKYKLSAFQRAAFYLPMCFNTQNGT

SEQ ID NO: 3777 - DNA, 186 bp, Neisseria gonorrhoeae
ttggcagacgggcggaagggtttttttgatgccatcatcaaaatcaatattttcttctttccggttaaaaccccgacattaggggcggcgaatccgattgcgggcggaagcacccgcttccgattcggtgcggaacaaatggcggtgctttatgtgccgttttgtgtgttgaaacacataggcaga

SEQ ID NO: 3778 - protein, 62 aa, Neisseria gonorrhoeae
LADGRKGFFDAIIKINIFFFPVKTPTLGAANPIAGGSTRFRFGAEQMAVLYVPFCVLKHIGR

SEQ ID NO: 3779 - DNA, 156 bp, Neisseria gonorrhoeae
atgcccgcgcgtgtcgggtttggcggggccgtccgcaggattaacgggcagaaacccgcctgcccttcccctcaatttcttatatatcgcgttccatcaaaagacgcattgcttttcttaaccattccttttggcagacgggcggaagggtttttt

SEQ ID NO: 3780 - protein, 52 aa, Neisseria gonorrhoeae
MPARVGFGGAVRRINGQKPACPSPQFLIYRVPSKDALLFLTIPFGRRAEGFF

SEQ ID NO: 3781 - DNA, 108 bp, Neisseria gonorrhoeae
ttgaggggaagggcaggcgggtttctgcccgttaatcctgcggacggccccgccaaacccgacacgcgcgggcatatggcggattgtttacaatattgtctaaaaatc

SEQ ID NO: 3782 - protein, 36 aa, Neisseria gonorrhoeae
LRGRAGGFLPVNPADGPAKPDTRGHMADCLQYCLKI

SEQ ID NO: 3783 - DNA, 162 bp, Neisseria gonorrhoeae
ttgcaggttcagatttttagacaatattgtaaacaatccgccatatgcccgcgcgtgtcgggtttggcggggccgtccgcaggattaacgggcagaaacccgcctgcccttcccctcaatttcttatatatcgcgttccatcaaaagacgcattgcttttct

SEQ ID NO: 3784 - protein, 54 aa, Neisseria gonorrhoeae
LQVQIFRQYCKQSAICPRVSGLAGPSAGLTGRNPPALPLNFLYIAFHQKTHCFS

SEQ ID NO: 3785 - DNA, 1122 bp, Neisseria gonorrhoeae
ttgtctaaaaatctgaacctgcaaacgcgaaataaggtagaatacgccccgttattttaccgtccaatccccatttaccaaggaaaaacgatgagtacttcattgagttaccgcgatgcgggcgtcggtatcgacgcaggcgaccaactggtcgaaaaaatcaaaccgtttgccaaacgcaccatgcgtccggaagtattgggggatttgggcggttttggcgcattggtcgaaatcggcaaaaaatatcaaaaccccgtattggtcagcggtacggacggcgtgggtaccaagctcaaacttgccttcgattgggacaaacacgatacggtgggcatcgaccttgttgcaatgagtgtcaacgatattttggttcaaggagctgaaccattgtttttcttggattattttgcctgcggtaaattggatgttccgcgtgcgaccgatgtcatcaaaggcattgcccaaggttgcgaagaatccggctgcgccctgattggcggggaaactgccgaaatgccgggtatgtatcccgttggtgaatacgatttggcgggttttgccgtcggcgtggtggaaaaagagaatgtcattaccggcctcagcatcggcgcgggcgatgtggtattgggtttggcttccaacggcgcacattcaaacggctattcccttatccgtaaaatcatcgaacgcgacaatcccgatctggatgccgagtttgataatggcaaaactttacgtgaagccgttattgcgccgacacgtctgtatgtgaaaccgattcttgccgctttggaaaaatttaccattaaaggtatggcgcacattaccggcggcggcattaccgaaaacgtgccgcgcgtgttgcctaaaaacacggttgcccaaatcgatgccgaatcgtgggaattgcccaagctcttccaatggcttcaaaaggcgggcaatgtggaaacccaagaaatgtaccggacctttaactgcggcatcggtatggtcgtcatcgttgctgccgaagatgccgatgcggttcggtcattcctgagcgggcagggcgagacagtgtaccgtttgggttgcatccgagagcgtcaagggaacgagcatcaaacccaagttgcc

SEQ ID NO: 3786 - protein, 374 aa, Neisseria gonorrhoeae
LSKNLNLQTRNKVEYAPLFYRPIPIYQGKTMSTSLSYRDAGVGIDAGDQLVEKIKPFAKRTMRPEVLGDLGGFGALVEIGKKYQNPVLVSGTDGVGTKLKLAFDWDKHDTVGIDLVAMSVNDILVQGAEPLFFLDYFACGKLDVPRATDVIKGIAQGCEESGCALIGGETAEMPGMYPVGEYDLAGFAVGVVEKENVITGLSIGAGDVVLGLASNGAHSNGYSLIRKIIERDNPDLDAEFDNGKTLREAVIAPTRLYVKPILAALEKFTIKGMAHITGGGITENVPRVLPKNTVAQIDAESWELPKLFQWLQKAGNVETQEMYRTFNCGIGMVVIVAAEDADAVRSFLSGQGETVYRLGCIRERQGNEHQTQVA

SEQ ID NO: 3787 - DNA, 138 bp, Neisseria gonorrhoeae
atgcggaaatgccgtctgaaacaaattcagacggcatttgatgcttggaagtcaggcaacttgggtttgatgctcgttcccttgacgctctcggatgcaacccaaacggtacactgtctcgccctgcccgctcaggaa

SEQ ID NO: 3788 - protein, 46 aa, Neisseria gonorrhoeae
MRKCRLKQIQTAFDAWKSGNLGLMLVPLTLSDATQTVHCLALPAQE

SEQ ID NO: 3789 - DNA, 96 bp, Neisseria gonorrhoeae
atggttttttcaacccaacctacactttttgttagttcccatacgaaccaaaaccttcataattacaatcatttttttgtgcaataccaaataacg

SEQ ID NO: 3790 - protein, 32 aa, Neisseria gonorrhoeae
MVFSTQPTLFVSSHTNQNLHNYNHFFVQYQIT

SEQ ID NO: 3791 - DNA, 393 bp, Neisseria gonorrhoeae
ttgtccatatcggctttcttaaggctgtttggcagattcggcagcattttgtatcggcggtgcagtcaatttctgtccgctcaagcgcgcacttttcttcacttccgcacgcaggcggctgttttcgccgcgcaaggacagcagccgcccgaacagggcaaacattccgaacacgatgccgacgacaaacgcgccgaacaatacgacaatcagcggcagattgacactctgccccggaagataggaaaaggtaacggcatccatattaatgacggcaagcagcaggaagagcagcaggataatgattttgatgacggtatagataagtttcatgtttgctccgtaaataaaaacgccgcacggacagcttcgcactctgaaccaagattgcgt

SEQ ID NO: 3792 - protein, 131 aa, Neisseria gonorrhoeae
LSISAFLRLFGRFGSILYRRCSQFLSAQARTFLHFRTQAAVFAAQGQQPPEQGKHSEHDADDKRAEQYDNQRQIDTLPRKIGKGNGIHINDGKQQEEQQDNDFDDGIDKFHVCSVNKNAARTASHSEPRLR

SEQ ID NO: 3793 - DNA, 129 bp, Neisseria gonorrhoeae
atgccgtctgaatttgtttcagacggcatttccgcatcttccaaacgcgtatccgcaacacagttctgcaaactgatattttgcccggtatggcggcttaaacttcttcatcatatttcgataatgcta

SEQ ID NO: 3794 - protein, 43 aa, Neisseria gonorrhoeae
MPSEFVSDGISASSKRVSATQFCKLIFCPVWRLKLLHHISIML

SEQ ID NO: 3795 - DNA, 144 bp, Neisseria gonorrhoeae
ttgtttattcctacatcgtattcatcctattttccgaaatgtgagcgttttatgaagcaatccgtccataataaaacaattttaagtgttttgatttcatctatgtctgtaacggctttttccgccccccacccccccccgcga

SEQ ID NO: 3796 - protein, 48 aa, Neisseria gonorrhoeae
LFIPTSYSSYFPKCERFMKQSVHNKTILSVLISSMSVTAFSAPHPPPR

SEQ ID NO: 3797 - DNA, 126 bp, Neisseria gonorrhoeae
ttgcctcgccttgccgtactatttgtactgtctgcggctcgccgccttgtcctgatttttgttaatccgctatattatttaagcgaacttcttggtttttgtttggttcgttacggtcgctccgga

SEQ ID NO: 3798 - protein, 42 aa, Neisseria gonorrhoeae
LPRLAVLFVLSAARRLVLIFVNPLYYLSELLGFCLVRYGRSG

SEQ ID NO: 3799 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagtgccccgccgggccgggcgcaagctgtttcggcgtacggcgtaaaggcagacgcggtcgcggcgcggcaggaaaagcggttgtcttcggcattccgaaacgcaacgggcgggcctataccgttgccgaggacgatgccgagcctgaaacgttgccccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaacctttcccgccgttgttgagggaatgcgaatttcgatttaacttcggcacaccgtcccggcagctaaaaatcctgcgggatcggtgtggaatt

SEQ ID NO: 3800 - protein, 217 aa, Neisseria gonorrhoeae
MKITHCKLKKEVQKEPLRSFVPEVTARSAADILGIHPDSAALFYRKIRTVTNHRLALAADEVFECPAGPGASCFGVRRKGRRGRGAAGKAVVFGIPKRNGRAYTVAEDDAEPETLPPAVKKKIMPDGIVYADSPGSRGKSDAGGFTRCRINRSKEFADRRNHINGIGNFWNQAKRALRKYNGIDRKPFPPLLRECEFRFNFGTPSRQLKILRDRCGI

SEQ ID NO: 3801 - DNA, 2025 bp, Neisseria gonorrhoeae
ttgtccctgtctgaatttatagaacgccgaacgtcatttaatccgatggttattttgacgactttgttttttgtgtgtgttttggtggtattggttttaaccgtgccggatcaggtgcagatgtggctcgaccgggcaaaagaagtcatttttaccgagttcagctggttttatgttttaacgttttccatttttctgggttttctgctgatactctcggtcagcggtttgggaaacatcaggctaggacgggatgaagatgtgccggaattcggcttcctgtcgtggctggcgatgctgtttgcggccgggatgggcgtgggcctgatgtttttcggcgtggcagagccgttgatgcattatttttcggacattacggtcggcgcgccggaacacaggcagcagcaggcattgctgcacacggtgttccattggggcgttcacgcctggtcggtgtacggtacgattgcattggctttggcttatttcggtttccgctacaaactgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcggcgtgcaggtcttgattatcgccgccgtaatgtccctcgccgtcgtttcggcaatatccggcgtggggaagggcgtgaaggtgttgagcgagttgaacctgggccttgcgtttttgctgctgttttttgttttggcggcggaccccactgtttacctgttgtcggcattcggcgacaacatagggaactacctcggaaatctggtgcgcctcagtttgaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaactgacgagcatcgtcagcctgctggtcatttccctgttttttgtaacttctgccgactccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggtcaaccctaccagtgtattttggacgggcggcaagtggaaagaacggctggtgcggataatgagccagacgcaggagcaggatattttaaaattcctcaaacataccgcatcgcccgctatgcacgagttgcaacgggagctttcggaagaatacggcttgagcgtccgggtcgataagatgtttcatcaggacgagcccgcaatcgagttcgtcattcggaaagagacgatgcgcgattttatgtacgggattaagtctgtcgggcaggatgtatccgaccagttgattaacgacggcaagctgccgcatatccggcaccagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagag

SEQ ID NO: 3802 - protein, 675 aa, Neisseria gonorrhoeae
LSLSEFIERRTSFNPMVILTTLFFVCVLVVLVLTVPDQVQMWLDRAKEVIFTEFSWFYVLTFSIFLGFLLILSVSGLGNIRLGRDEDVPEFGFLSWLAMLFAAGMGVGLMFFGVAEPLMHYFSDITVGAPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFGVQVLIIAAVMSLAVVSAISGVGKGVKVLSELNLGLAFLLLFFVLAADPTVYLLSAFGDNIGNYLGNLVRLSLKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVRIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 3803 - DNA, 1590 bp, Neisseria gonorrhoeae
atgagggcgttcgccgtccgcaaccataaaggaagtttcatgaaccggacttatgccaatttctacgaaatgctcgccgccgcctgccgcaaaaacggcaacggcacggcagtgttcgacggcaaggaaaaaaccgcctaccgcgcgctcaagcaggaagccgaagccgtcgcggcgtatctgcaaaatatcggcgtgaagttcggcgacacggtcgcgctggcggtttccaattccacagaatttattaccgcctatttcgccgtctccgccatcggcgcggtcgccgtaccgatgaacacatttttgaaaaacagcgaatacgcgtatatcctgaacgactgcaaggcgcgcttcctgttcgcctcggccggcctgtcaaaagaattggcgggcctgaaggcgcaaacgcccgtcgaaaaaatcatttggacggacaaaagccggccggccggcgaaacggcggaaggcgatgccttttttgaaaacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaaacgcgaccgctttatcgttttcctgccgatgttccacagcttcacgctgacggctatggtgctgctgccgatttatatggcgtgttcgattattttggtcaaatccgttttccccttttccaacgttttgaaacaggccctgctcaaacgcgcaaccgtgtttttgggcgtacccgcgatttacaccgcgatgagcaaggcaaaaatcccttggtatttcagatggttcaaccgcatccgcctgtttatcagcggcggcgcgcctttggcggaacaaaccatcctcgattttaaagccaagttcccccgcgccaaattgctggaaggctacggactgagcgaagcctcgcccgtcgtcgccgtcaatacgcccgaacggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaggacggctttatctttatcgtcgaccgcaaaaaagatttgattatttccaaaggtcaaaacgtctatccgcgcgagatcgaagaagaaatccacaaactcgatgccgtcgaagccgccgccgtcatcggcgtgaaagaccgttatgccgacgaggaaatcgtcgccttcgtccaattgaaggaaggtatggatttgggcgaggacgaaatccgccgccacctgcgtaccgtgctggcaaatttcaaaatccccaaacagatccactttaaagacgggctgccgcgcaacgctacgggcaaagtattgaaacgggtgctgaaggagcagtttgaaggaaacaaa

SEQ ID NO: 3804 - protein, 530 aa, Neisseria gonorrhoeae
MRAFAVRNHKGSFMNRTYANFYEMLAAACRKNGNGTAVFDGKEKTAYRALKQEAEAVAAYLQNIGVKFGDTVALAVSNSTEFITAYFAVSAIGAVAVPMNTFLKNSEYAYILNDCKARFLFASAGLSKELAGLKAQTPVEKIIWTDKSRPAGETAEGDAFFENVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIHKLDAVEAAAVIGVKDRYADEEIVAFVQLKEGMDLGEDEIRRHLRTVLANFKIPKQIHFKDGLPRNATGKVLKRVLKEQFEGNK

SEQ ID NO: 3805 - DNA, 153 bp, Neisseria gonorrhoeae
atggttgcggacggcgaacgccctcatttgaaaacaatatgccgtctgaaaacggaaggcggcagtttatcatctttgccttcagacggcatatcaaacgccgcctttgcgccgcatgccggaggttcgcccccgtccttcctatgtctgacc

SEQ ID NO: 3806 - protein, 51 aa, Neisseria gonorrhoeae
MVADGERPHLKTICRLKTEGGSLSSLPSDGISNAAFAPHAGGSPPSFLCLT

SEQ ID NO: 3807 - DNA, 468 bp, Neisseria gonorrhoeae
ttgcggatactggcgggcatgggcaagtatcagatattggacgataaattcgacgtcgaccacgccgccgcgcgcgtatttgacgttgctgtcggcaggcggatgggtggggaacattttttcgcgcatttcgatgatttcgcctgccaaggcggtttggtcgcgttcggcagtcagcatttcggtgcggatgcggtcgaatgccgtctgaatttcgggtgtgccgcagatgaagcgggcgcgggtgagggactggtgttcccatgtccatgcgttttcacgctggtattttccaaaggcggcgatgctgtgcgcgaggaaaccggcgtcgccattagggcgcaggcgcaggtcggtttcgtagaggctgcccgcgccggtggcggcggaaagccggttggtcaggcggcgggcgaggcggctgtacacgtcgcctgcttcgggatggggatcgtcgtaaagatagac

SEQ ID NO: 3808 - protein, 156 aa, Neisseria gonorrhoeae
LRILAGMGKYQILDDKFDVDHAAARVFDVAVGRRMGGEHFFAHFDDFACQGGLVAFGSQHFGADAVECRLNFGCAADEAGAGEGLVFPCPCVFTLVFSKGGDAVREETGVAIRAQAQVGFVEAARAGGGGKPVGQAAGEAAVHVACFGMGIVVKID

SEQ ID NO: 3809 - DNA, 93 bp, Neisseria gonorrhoeae
ttgaaactacgttatttggtattgcacaaaaaaatgattgtaattatgaaggttttggttcgtatgggaactaacaaaaagtgtaggttgggt

SEQ ID NO: 3810 - protein, 31 aa, Neisseria gonorrhoeae
LKLRYLVLHKKMIVIMKVLVRMGTNKKCRLG

SEQ ID NO: 3811 - DNA, 429 bp, Neisseria gonorrhoeae
atgccgtccgaacacgctgccgcattctatccgaaaccgtgcaaatcgtttaaactaacgcaatcttggttcagagtgcgaagctgtccgtgcggcgtttttatttacggagcaaacatgaaacttatctataccgtcatcaaaatcattatcctgctgctcttcctgctgcttgccgtcattaatatggatgccgttaccttttcctatcttccggggcagagtgtcaatctgccgctgattgtcgtattgttcggcgcgtttgtcgtcggcatcgtgttcggaatgtttgccctgttcgggcggctgctgtccttgcgcggcgaaaacagccgcctgcgtgcggaagtgaagaaaagtgcgcgcttgagcggacagaaattgactgcaccgccgatacaaaatgctgccgaatctgccaaacagcct

SEQ ID NO: 3812 - protein, 143 aa, Neisseria gonorrhoeae
MPSEHAAAFYPKPCKSFKLTQSWFRVRSCPCGVFIYGANMKLIYTVIKIIILLLFLLLAVINMDAVTFSYLPGQSVNLPLIVVLFGAFVVGIVFGMFALFGRLLSLRGENSRLRAEVKKSARLSGQKLTAPPIQNAAESAKQP

SEQ ID NO: 3813 - DNA, 1191 bp, Neisseria gonorrhoeae
atgaaccccaaacacttcatcgcattttccgccctgttcgccgccacgcaggcagaagccctgcccgtcgcctccgtcagccccgacaccgttaccgtttccccgtccgccccctacaccgatacaaacgggctgctgaccgactacggcaacgccgccgcctcgccttggatgaaaaaactccgatccgtcgcacaaggcagcggcgaggccttccgcatcctgcaaatcggcgactcgcataccgccggcgacttctttaccgacgccctgcgcaaacgcctgcaaaaaacatggggcgacggcggcataggctgggtttaccccgccaacgtcaaagggcagcgcatggcggccgtccgtcacagcggcaactggcaaagcttcaccagcaggaacaataccggagatttcccgctcggcggcatcctcgcccaaaccggcagcggcggcggcatgaccctgaccgcgtctgacggcaaaaccggcaaacagcgcgtttccctgtttgccaaaccgctgctcgccgaacaaaccctgaccgtcaacggcaacaccgtctccgccaacggcggcggctggcaggtactggatacgggcgcggcactgcccctggccatacagaccgaaatgccgtgggacatcggcttcatcaacatcgaaaatcccgccggcggcattaccgtttccgcgatgggcatcaacggcgcacaattgacccagtggtcgaaatggcgtgccgaccgtatgaacgaccttgcccaaaccggcgccgatttggttatcctttcctacggcaccaacgaagccttcaacaacaacatcgacattgccgataccgaacaaaaatggctggataccgtccgccaaatccgcgacagcctgcccgccgccggcatcctcatcatcggcgcgcccgaatccctgaaaaacacgctcggcgtatgcggcacgcgccccgtcctcctgaccgaagtccaacagatgcagcggcgcgtcgcccgtcaggggcagacgatgttttggtcttggcaaaacgcaatgggcggcatatgcagcatgaaaaactggctcaaccaaggatgggccgccaaagacggcgtacacttctccgcccaaggctaccggcgcgcggcggaaatgcttgccgacagcctcgaagaactcgtccgcgccgccgcaatcaggcaa

SEQ ID NO: 3814 - protein, 397 aa, Neisseria gonorrhoeae
MNPKHFIAFSALFAATQAEALPVASVSPDTVTVSPSAPYTDTNGLLTDYGNAAASPWMKKLRSVAQGSGEAFRILQIGDSHTAGDFFTDALRKRLQKTWGDGGIGWVYPANVKGQRMAAVRHSGNWQSFTSRNNTGDFPLGGILAQTGSGGGMTLTASDGKTGKQRVSLFAKPLLAEQTLTVNGNTVSANGGGWQVLDTGAALPLAIQTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVLLTEVQQMQRRVARQGQTMFWSWQNAMGGICSMKNWLNQGWAAKDGVHFSAQGYRRAAEMLADSLEELVRAAAIRQ

SEQ ID NO: 3815 - DNA, 1335 bp, Neisseria gonorrhoeae
gtggaaataccgtccgccccccctgtccgattattgcctgattgcggcggcgcggacgagttcttcgaggctgtcggcaagcatttccgccgcgcgccggtagccttgggcggagaagtgtacgccgtctttggcggcccatccttggttgagccagtttttcatgctgcatatgccgcccattgcgttttgccaagaccaaaacatcgtctgcccctgacgggcgacgcgccgctgcatctgttggacttcggtcaggaggacggggcgcgtgccgcatacgccgagcgtgtttttcagggattcgggcgcgccgatgatgaggatgccggcggcgggcaggctgtcgcggatttggcggacggtatccagccatttttgttcggtatcggcaatgtcgatgttgttgttgaaggcttcgttggtgccgtaggaaaggataaccaaatcggcgccggtttgggcaaggtcgttcatacggtcggcacgccatttcgaccactgggtcaattgtgcgccgttgatgcccatcgcggaaacggtaatgccgccggcgggattttcgatgttgatgaagccgatgtcccacggcatttcggtctgtatggccaggggcagtgccgcgcccgtatccagtacctgccagccgccgccgttggcggagacggtgttgccgttgacggtcagggtttgttcggcgagcagcggtttggcaaacagggaaacgcgctgtttgccggttttgccgtcagacgcggtcagggtcatgccgccgccgctgccggtttgggcgaggatgccgccgagcgggaaatctccggtattgttcctgctggtgaagctttgccagttgccgctgtgacggacggccgccatgcgctgccctttgacgttggcggggtaaacccagcctatgccgccgtcgccccatgttttttgcaggcgtttgcgcagggcgtcggtaaagaagtcgccggcggtatgcgagtcgccgatttgcaggatgcggaaggcctcgccgctgccttgtgcgacggatcggagttttttcatccaaggcgaggcggcggcgttgccgtagtcggtcagcagcccgtttgtatcggtgtagggggcggacggggaaacggtaacggtgtcggggctgacggaggcgacgggcagggcttctgcctgcgtggcggcgaacagggcggaaaatgcgatgaagtgtttggggttcatggctgtgtacttgatggttgcgtactcggttcaaaaacgattttttccattattttttccgccagcagtttttgtccttcggcggtaaagtgtatgccgtccttactgcgg

SEQ ID NO: 3816 - protein, 445 aa, Neisseria gonorrhoeae
VEIPSAPPVRLLPDCGGADEFFEAVGKHFRRAPVALGGEVYAVFGGPSLVEPVFHAAYAAHCVLPRPKHRLPLTGDAPLHLLDFGQEDGARAAYAERVFQGFGRADDEDAGGGQAVADLADGIQPFLFGIGNVDVVVEGFVGAVGKDNQIGAGLGKVVHTVGTPFRPLGQLCAVDAHRGNGNAAGGIFDVDEADVPRHFGLYGQGQCRARIQYLPAAAVGGDGVAVDGQGLFGEQRFGKQGNALFAGFAVRRGQGHAAAAAGLGEDAAEREISGIVPAGEALPVAAVTDGRHALPFDVGGVNPAYAAVAPCFLQAFAQGVGKEVAGGMRVADLQDAEGLAAALCDGSEFFHPRRGGGVAVVGQQPVCIGVGGGRGNGNGVGADGGDGQGFCLRGGEQGGKCDEVFGVHGCVLDGCVLGSKTIFSIIFSASSFCPSAVKCMPSLLR

SEQ ID NO: 3817 - DNA, 1005 bp, Neisseria gonorrhoeae
atgccaatttttaagggtttggacatgaaaaactttctttcccttttcgcctccatactgatgtctgccctgattgccgtgtggttcagccaaaaccccatcaacgcctactggcagcagacctaccaccgcaacagcccgctcgaaccgcttgccgcctacggatggtggcggagcggagcggcgttgcaagaaaacgcctacgccctttcagacggcatcaaaaccttcctgtccggcgaaacgccgccgacggctcaagacggcggttcggcagatatgccgcctgaagccgccgcatccgaagccgccccgccggccggcggaacagaatggaaacaaggcaccgaagccgccgccgtccgcagcggcgacaaagtctttttcgccggagattcgctgatgcagggcgttgcgcctttcgtgcaaaaaagcctgaaacagcaatacggcatcgaatccgccaacctcagcaaacaaagcacggggctttcctatccctcattcttcgactggccgaaaacgattgaagaaaccttgaaaaaacatcccgaaatcagcgtactcgccgtcttcctcggcccgaacgacccgtgggatttccccgtcggcaaacgctacctcaaattcgcttccgacgaatgggcgcaagaatacctgaaacgcgtcgaccgcatccttgaagccgcacacacgcaccgcgtccaagtcgtctggctcggcatcccctacatgaaaaaagtcaagctcgacggtcagatgcgctacctcgacaaactgctttcggaacacttgaaaggcaaaatcatcctgattcccaccgcgcaaacactgagcggcgggaaaggccgctacaccgattccgtcaacgtcaacggcaaacccgtccgctaccgcagtaaggacggcatacactttaccgccgaaggacaaaaactgctggcggaaaaaataatggaaaaaatcgtttttgaaccgagtacgcaaccatcaagtacacagcca

SEQ ID NO: 3818 - protein, 335 aa, Neisseria gonorrhoeae
MPIFKGLDMKNFLSLFASILMSALIAVWFSQNPINAYWQQTYHRNSPLEPLAAYGWWRSGAALQENAYALSDGIKTFLSGETPPTAQDGGSADMPPEAAASEAAPPAGGTEWKQGTEAAAVRSGDKVFFAGDSLMQGVAPFVQKSLKQQYGIESANLSKQSTGLSYPSFFDWPKTIEETLKKHPEISVLAVFLGPNDPWDFPVGKRYLKFASDEWAQEYLKRVDRILEAAHTHRVQVVWLGIPYMKKVKLDGQMRYLDKLLSEHLKGKIILIPTAQTLSGGKGRYTDSVNVNGKPVRYRSKDGIHFTAEGQKLLAEKIMEKIVFEPSTQPSSTQP

SEQ ID NO: 3819 - DNA, 1452 bp, Neisseria gonorrhoeae
ttgtcccaaggatggtttatgccgctgctgtctgtcgagttcgcactgttttttatcgtcttcctgccgatttactggggctttgcgaaatacccgtccgtccaaaacctgctgcttttggctgccggtatgggctggctctaccatattagccccgtatttgcggcaatcatcgtcctttattcctcctgcgtgtaccttttgggcgaactgctccgttccgatcgcgaaagtacgcgccgcttttggctggggtgcggcattgccgcctcgattaccgttttgggctttttcaaatatttcgattttttccgtccgctgattgcacaatatgccggaaaaggcggcgcaatcgacatcctgatgccgctgggactttcctattataccttccagtctgtcgcctatctggtttactgcttccgcgccccgcacgccgcgcgttttgggtggcacgagctgctgctgcacctgagttttttccccaccgttacctccggcccgattatccgcgccgccgcattcaaaagcacggacggcgaacaggcgggtgcactggcgcaaatccgcacccgccgaccgcgttcgcccgtccgccccgccctcgccgtttccctgattttactgggcattgccaaaaaatggtggctggcggggatactggcggaaaactgggtgtcgcccgtatttgaaaatcccacccaattcgacggctggggcgtgttggcaggcgtgtacggctataccttccaactctttttagacttttccggatattccgatttggttatcggtatggcgatgctgctgggcttccggctgcccaaaaacttctccgcaccgcttcgtgccgcgaatatccgcgcattttgggacaaatggcacatcagcctttccacctggatacgcgactacatctacatccccttgggcggcagcaaaaaaggctttttgcggacacagctcaacctgatggcggcaatggtactctcaggcatctggcacggctacggctggaacttcctcatttggggcgcgctgcacggcacggcactggcgctgctcaacacgggcgaccggtatttcggacgcgacgcgctatgccgtctgaaataccttgcgccgctctcgtggtttgttaccttccatttcgtctgccttagctttgtcgtcttcaataccgcaaaccccgacgatgcaggcgcagttttcagtgccctctttgccaatgccggcggctggaacgcgccgcaacgggcggatatgctgctgcttgcctcgtttgcatccttgatgctgctctacccttacctgcaacgcgctttcgacggcgcggtcaaaggtttggaaaaaatcccgatgtggctgtggtttatccagatttccatcatcctgctgctgattatcgtcctcgccccttcggggatacccggctttatttatgccaatttt

SEQ ID NO: 3820 - protein, 484 aa, Neisseria gonorrhoeae
LSQGWFMPLLSVEFALFFIVFLPIYWGFAKYPSVQNLLLLAAGMGWLYHISPVFAAIIVLYSSCVYLLGELLRSDRESTRRFWLGCGIAASITVLGFFKYFDFFRPLIAQYAGKGGAIDILMPLGLSYYTFQSVAYLVYCFRAPHAARFGWHELLLHLSFFPTVTSGPIIRAAAFKSTDGEQAGALAQIRTRRPRSPVRPALAVSLILLGIAKKWWLAGILAENWVSPVFENPTQFDGWGVLAGVYGYTFQLFLDFSGYSDLVIGMAMLLGFRLPKNFSAPLRAANIRAFWDKWHISLSTWIRDYIYIPLGGSKKGFLRTQLNLMAAMVLSGIWHGYGWNFLIWGALHGTALALLNTGDRYFGRDALCRLKYLAPLSWFVTFHFVCLSFVVFNTANPDDAGAVFSALFANAGGWNAPQRADMLLLASFASLMLLYPYLQRAFDGAVKGLEKIPMWLWFIQISIILLLIIVLAPSGIPGFIYANF

SEQ ID NO: 3821 - DNA, 150 bp, Neisseria gonorrhoeae
atgccgtctgaagggcgggaggggcttcagacggcatcgctcggtcaggttcggatatggtggttcaaattcaggcagacccgcaaacctgccgccgccgtcagcatacccgcaacgccgatgcaggaaatgcccgagtattgcgtaacc

SEQ ID NO: 3822 - protein, 50 aa, Neisseria gonorrhoeae
MPSEGREGLQTASLGQVRIWWFKFRQTRKPAAAVSIPATPMQEMPEYCVT

SEQ ID NO: 3823 - DNA, 738 bp, Neisseria gonorrhoeae
gtggggattgtgctgacgcacgcggtgttctggtccattacggcttcgctggcggtacgcatcgcccctgtcggaaaagggaatcaggcattggggctgctcagcacggggacggtgatggcgatggtggcggggattccgctcgggcgtatggtcggacaatatttgggctggcaggcgagttttctgctgatcggcctgtgttcggcggcggtaatggcagtgcttgccaaaagcctgccgcgcctgccgagcgtgaataccggttctttaagcagcctgcccctgcttttgaaacggaaaaaactgatgctgctgtatgcggtaacggtgccggtgattacggcgcactttaccgcatacagctacatcgagcccttcgtcatccaaatcggcggtttctccgcgcggcaggttacggtggttccggggctgtacggcctggcgggttttgccgcgtcttacctgttcggcaaatggtttgccaaacatccgcgcgcatttttggcgggcgcggtgtcgcttatcgccctctcttcggggcttttgctgcctttggcgcattttcctgccgccatttacgcgttggtgttcgtatgggggacggcgattgtggtcgtcagcttggggatggttgccaaagttttggatttcgcctccgatgccgcagaccttgccaactcgatttattcggagctttacaacgtcggtataggcggcggcgcactgctgggacat

SEQ ID NO: 3824 - protein, 246 aa, Neisseria gonorrhoeae
VGIVLTHAVFWSITASLAVRIAPVGKGNQALGLLSTGTVMAMVAGIPLGRMVGQYLGWQASFLLIGLCSAAVMAVLAKSLPRLPSVNTGSLSSLPLLLKRKKLMLLYAVTVPVITAHFTAYSYIEPFVIQIGGFSARQVTVVPGLYGLAGFAASYLFGKWFAKHPRAFLAGAVSLIALSSGLLLPLAHFPAAIYALVFVWGTAIVVVSLGMVAKVLDFASDAADLANSIYSELYNVGIGGGALLGH

SEQ ID NO: 3825 - DNA, 294 bp, Neisseria gonorrhoeae
ttggcaatcggcgcatttattttcaacacggccgaatacatccccatcgcgcttttgagcgacatcggacgaagcttcggcatggcggcgaccgaaacgggtgtgatgattacggtttatgcgtggattgtcgcgctgacttcgctggcgctgccgctgatgctgctgacgcgcaattatggaacggcgcggcctgctgctggtcctgtttgcgctgtattactgtcagccacatcctgtcgtttgcctcgtggcgttttgaaatcctactcgcaagccgcgtggggattgtgc

SEQ ID NO: 3826 - protein, 98 aa, Neisseria gonorrhoeae
LAIGAFIFNTAEYIPIALLSDIGRSFGMAATETGVMITVYAWIVALTSLALPLMLLTRNYGTARPAAGPVCAVLLSATSCRLPRGVLKSYSQAAWGLC

SEQ ID NO: 3827 - DNA, 174 bp, Neisseria gonorrhoeae
gtgttcggacggcatacggagtatgcgattgccgacaattttaccaaatacaccgctcctttccatttgaaaaataacggattggacaccgcatcgacagaaaaacccgccgcgcacttgtcaaaaccctgtttgcaggcgtatctttacaaccttcaaattcaaaccgttcat

SEQ ID NO: 3828 - protein, 58 aa, Neisseria gonorrhoeae
VFGRHTEYAIADNFTKYTAPFHLKNNGLDTASTEKPAAHLSKPCLQAYLYNLQIQTVH

SEQ ID NO: 3829 - DNA, 2688 bp, Neisseria gonorrhoeae
ggcggttgccgcttcctccccgaacacttcccgccacaatttcctgacattgccgtaatgggacagcaattcgtcgcttacttcggtttttgccgcgtcgcgcaatttggtgttgtgctgctgccggcggtagaggcggtaggcggtgcggctttgtccggcgagggttttgtcaatcaaaccgcagtcggcggcgatgttcaatagggcgatgttgccgtagttgtccaagagttgcggatactggcgggcatgggcaagtatcagatattggacgataaattcgacgtcgaccacgccgccgcgcgcgtatttgacgttgctgtcggcaggcggatgggtggggaacattttttcgcgcatttcgatgatttcgcctgccaaggcggtttggtcgcgttcggcagtcagcatttcggtgcggatgcggtcgaatgccgtctgaatttcgggtgtgccgcagatgaagcgggcgcgggtgagggactggtgttcccatgtccatgcgttttcacgctggtattttccaaaggcggcgatgctgtgcgcgaggaaaccggcgtcgccattagggcgcaggcgcaggtcggtttcgtagaggctgcccgcgccggtggcggcggaaagccggttggtcaggcggcgggcgaggcggctgtacacgtcgcctgcttcgggatggggatcgtcgtaaagatagactaagtcgaggtcggaggcgtagccgagttctttgccgccgagcttgccgtagccgatgacggcgaattgcggggtgtcgcggtgttttttgggcatatccgcccacgcgcacgaaagggcggcggcaatgacggtgtcggcgagggcggagagttggtcagagagggattctaccgtccacaatccggcgaggtcttggacggcgaggcggaagacttgggcgtgttggaaatggcgcagcgtgtccatttgcgcttcggtatcgccgccgcaggcttcgatgccgtctgaaagggcggcggcgagtgcctgccaatcaaacgcggtatccaaaagctgcgcgctgatgagttcgtccaacaaaatcggatatttgttcagatacgccgccacccacgagctttggctcataatctgcgccagttgtgccaaggtttgcggatgttcgttgaggaaggcgagataggcggagcggaggctgatgttttcgagaaaatccaacagccgcatcagcgtatctgtcgggttgttttgctctgccgccgcctgtacaaacagcggcacaatggtgtcaaagcgcggctgggcgtgtgcggaaaggcggcggtatttatgtccgtggcagatttgttcgagccttgcggtgacggcttcggcatcgaacccgtgttctttcagacggcctagccgttcttcttcgtcgggtttttcctgccatgcccattgccattcgctattgctttgcgcttgttcttcaggttcgctcaagatttcgttgaacaactgattgactttgttccgatgaacattgaggccgtctgaaaaagcggcataactgtcgaaacccatgctttcggcgagcagttgccgctgttcgggcgagatcggcagggtttgggtttgccggtcgtcccagtattgcaggcggtgttcgacatcgcgcaggaagcggtaggcggcaagcagggtttcgacgttttcagacggcataatgcccatctcggcaattttcttcagcgtttcctgcgtgcctttcagttgcagcgcgcgcatttggccgccgcgtatcatctggaaaatctgggcgataaattcaacctcgcggatgccgcccgcgccgagtttgatgttgtccgccatgccttttttgctgacttcgctgcggatttggcggtgcaggttgcgcatcgcctcatacgcgccgtaatccagatatttgcggaacacgaaggggcgcaccagcgatttgatgtcgttcggatacggcgtgactacgcggcctttgcaccacgcatagcgttcccattcgcgcccctgcgtaatcagatattgctccagcacggtttcgctcaataccaacgcgcccgaatcaccgtccggccgcagccgcatatcgacgcggaacacctgcccgtcggcagtaatgccgttcaacaatgcaatcagtttctgcccgactttggtgaaaaactcctgattcccccgttcgcgcctgccgtcggtgtcgcccgattcgggatagacgaaaatcaaatcgatgtcggaagacacgttcaactcatagccgcccgccttgcccatcgccaccacgctcaaatgctgcggcgatttggtataacgcccgatcggcgtgccgtacatgtcccgataataggcgtaggcgaaatccagcgcggtattgacggcaaaatcggcaaacagcgtaatcgtgcgggtaacttcgttcaaatcgctgatgcggtttatatcgcgcacgataatctgcgacaccacataacggcgcaactcgcgcaactgccgcgccaattcttcctcgctttcttccgcgcggattttgtcccagtcggcaaaggcttggaaaccctcatccgtcaacgccttgtccaacatgggcaggaaaatttcgggcttgagtttgccgttgtcgagctggcgggcgaggaacagggaatggcggcgggcggtgtcgaggcggtggtcggacat

SEQ ID NO: 3830 - protein, 68 aa, Neisseria gonorrhoeae
GGCRFLPEHFPPQFPDIAVMGQQFVAYFGFCRVAQFGVVLLPAVEAVGGAALSGEGFVNQTAVGGDVQ

SEQ ID NO: 3831 - DNA, 321 bp, Neisseria gonorrhoeae
atgataattgacgaaaaatctacttcagatgtactgaaacaatatcaagaactagggtttgatttgacaaaacctatgataatagagttttttataggaggttctcaaaaaaatctgcaatcaatagaaagccaactcatttcttatcggcaagattttcaaatcagtattgaacaagatgaattcggagaaatgtggacttgctattgttccgtcaatatcgtcccttcccttgaaaacattttagctattgaaactacgttatttggtattgcacaaaaaaatgattgtaattatgaaggttttggttcgtatgggaac

SEQ ID NO: 3832 - protein, 107 aa, Neisseria gonorrhoeae
MIIDEKSTSDVLKQYQELGFDLTKPMIIEFFIGGSQKNLQSIESQLISYRQDFQISIEQDEFGEMWTCYCSVNIVPSLENILAIETTLFGIAQKNDCNYEGFGSYGN

SEQ ID NO: 3833 - DNA, 120 bp, Neisseria gonorrhoeae
gtgttgaaaataaatgcgccgattgccaaggcaacgatgctcaaccaaggtttgtgcgaagcgttcatctcaattccttatatgtcgcaccccgccaaaagggggcgcattatggtgaat

SEQ ID NO: 3834 - protein, 40 aa, Neisseria gonorrhoeae
VLKINAPIAKATMLNQGLCEAFISIPYMSHPAKRGRIMVN

SEQ ID NO: 3835 - DNA, 99 bp, Neisseria gonorrhoeae
ttgttaattcactatacttttcttgtctgccggacggcaaaatccaaatcagggggaagcagccgcctcccgttcggagaaacactcgggacgctgctt

SEQ ID NO: 3836 - protein, 33 aa, Neisseria gonorrhoeae
LLIHYTFLVCRTAKSKSGGSSRLPFGETLGTLL

SEQ ID NO: 3837 - DNA, 372 bp, Neisseria gonorrhoeae
ttgaaaatcgttccatatgttgaaacattgccgcctcccgattgggcaaggttgccattatgtcgcaagcatccgtgccgcaccgtttccgcgtttgcccaagttcacgctccgacttacaataacgcccgtcagattgcagtaccaacgaaaggaaaaatcgtggaaaccctcctcctcgacatcggcggcatgagctgcggcggctgcgtcaaaagcgttacccggatattagaaagcgtaaaaggcgtggcaagcgtcgaagtcagccttgaaaacaaaagtgcgaccgtcggatacgaccccgcgcaaaccgcagcggaagcactaatcgaagccgtagaagacggcggctatgatgcggcgttgaaa

SEQ ID NO: 3838 - protein, 124 aa, Neisseria gonorrhoeae
LKIVPYVETLPPPDWARLPLCRKHPCRTVSAFAQVHAPTYNNARQIAVPTKGKIVETLLLDIGGMSCGGCVKSVTRILESVKGVASVEVSLENKSATVGYDPAQTAAEALIEAVEDGGYDAALK

SEQ ID NO: 3839 - DNA, 96 bp, Neisseria gonorrhoeae
atgccatctgaaggcgcggagcgtgcttcagacggcatcggggaaacgcaaaggcttcagacggcatttttgccgctttatttcaacgccgcatca

SEQ ID NO: 3840 - protein, 32 aa, Neisseria gonorrhoeae
MPSEGAERASDGIGETQRLQTAFLPLYFNAAS

SEQ ID NO: 3841 - DNA, 135 bp, Neisseria gonorrhoeae
ttggttaaacttgcgggcaatagtgccttcagacaaacaaaatatgccgaacaaaaagaaaaaagccgcctttgcgcgctgcaacggagaacggtgtgccgggcgtgtccgacatcaaaaattcatatgatgatt

SEQ ID NO: 3842 - protein, 45 aa, Neisseria gonorrhoeae
LVKLAGNSAFRQTKYAEQKEKSRLCALQRRTVCRACPTSKIHMMI

SEQ ID NO: 3843 - DNA, 1485 bp, Neisseria gonorrhoeae
ttgatgtacgaatccaaagcattttcccaaaccgccatcaacgccttggaggcatgcgcccgcatgatgggtttgaagcctacggcagccgcaaaagccaaggtcttggagctgggctgttcgatgggcagaaacatcatcacgcaggcactttattacccggatgcggaatttgtcggtatcgacttgtccggcaggcaggttgcgcagggcaacgccatcattgaaaaaatgggcttggaaaatgtgcgtctggaagaaaaagatattttgaccgtcgatgaatcattcgggaagttcgactatatcatcgtccacggcatttggtcgcgggtgcccgacgcagttaaagacaaaatcttttcgatttgccggaacaacctgaccgaatacggcattgcctatatttcatacaatgtttaccccggttggaagcggcaggagcagttgcgcgatattatgcagtttgccggcagggatgcgcttggagaacccttggaagcaaggacgcggaaaggcttggatgcgatcaaggcgctggcggaaattttggaaaacgacaagggcttgggcggcggcaaacttccggcgattcaaaaaatattgaatcacaatacttattatgtcgcacacgaatatatggaaatattcaacgacccgatttacgttaacggtttcattgaatgggcaaaccgccaccggctggcgtatatcggtgataccgatttgcatgtgtcttttgtttcttggatggcggagcatacgcgggagcggattctggcattggcagggggtgattatattgccaaagaattttacagcgatattttatccgaccgccaattccaccgttcgcttttatgccgtgaggaagtcggggatactgtcaggcgtgatgagtcggttgccgtcgaagtgatagaaagtttgaatttccgcccggcaagaggggaaacaatcaactttgatgaaaacgataccctgctttcgggcatacgcgatgtgatgaaaaccggagaggcgtttaaaacggaagatgttgcggaaaatcttgcccgccgatttcccggtctggaatttgaccgcatgaaaatcaattcccagcttttattgcaaaccattctcgggcgtttttctgtttcatcagacaatgcgggcaaaccattttttgaagaccataaaacctatgtgccggcgcgctttacaaactatgccgccgcctttgtggaacacggtgcgggagcgtttgtccggcctgccaaccgttacaacgaaagcacgccctcattcggatacgggcatttgtacattatgcggcaattgtcgcggccgacgagcaaacaggcattgattgaaacggttgccgaaaacttgaacatcgtcagcgccacgcccgacggtttgacattccatccgcctgccgaagtgtatgtggaagaaatattggcagacttggcagacaggcattttctcgtttcggcggat

SEQ ID NO: 3844 - protein, 495 aa, Neisseria gonorrhoeae
LMYESKAFSQTAINALEACARMMGLKPTAAAKAKVLELGCSMGRNIITQALYYPDAEFVGIDLSGRQVAQGNAIIEKMGLENVRLEEKDILTVDESFGKFDYIIVHGIWSRVPDAVKDKIFSICRNNLTEYGIAYISYNVYPGWKRQEQLRDIMQFAGRDALGEPLEARTRKGLDAIKALAEILENDKGLGGGKLPAIQKILNHNTYYVAHEYMEIFNDPIYVNGFIEWANRHRLAYIGDTDLHVSFVSWMAEHTRERILALAGGDYIAKEFYSDILSDRQFHRSLLCREEVGDTVRRDESVAVEVIESLNFRPARGETINFDENDTLLSGIRDVMKTGEAFKTEDVAENLARRFPGLEFDRMKINSQLLLQTILGRFSVSSDNAGKPFFEDHKTYVPARFTNYAAAFVEHGAGAFVRPANRYNESTPSFGYGHLYIMRQLSRPTSKQALIETVAENLNIVSATPDGLTFHPPAEVYVEEILADLADRHFLVSAD

SEQ ID NO: 3845 - DNA, 1095 bp, Neisseria gonorrhoeae
atgaaccagacatttaccttgcccgatacgcgcccgtatccccaaaatccgattaaaaaccacctgctgctcaatgcctaccagttggcgcacaattcgtcacaggcttcgcgcaaactttcgtccgggcagcttcaaaccgaaatcagggggatgcttgagcaaaaccactatatcaacctttccctcgcgctgacgatgtcgcccgatgccggaacttatgccgcgctgctttccagtgtgaacgcggtactcgattgcgagaaagaaggcgaagtgcagtggttcgccctgccggtcgtgctggtgtccggctgcaagaaagaacgggcaatcgagatgaagctgccgacggaggcattgtttgcctgcctgcaaaactatccgcacctgcgcgcgttgacgcaagagacacaatggctgccttatcttgtgcattcttccgatttgagtgcggtcgcgccggatgagtggtggcgtgccaaacaaaataccgaagcggcggcgcaacacttacgccgtttcgccccgcgccctttgctgttgcccgaagggcagtccgtccacgtcgtttacgtgctgggtttcggcagcggcaaagttcaggcggcattggggcagaaccttcttcaggcaggcttgcccttaatgcaggtatggcaggaaaatcttgcatcggaaggcattacgctgtttgccaatccgctttcccccgataccccggcgcgcgcgctttcagacggcagccacacgcgccaacgtatggcgatggatgtttttgcggcaaacgcgatacgcgccgtccggatgcagggtccgcgcgtcggcgtggtcgctgcggcaaaggcgggcggacagattctattcggatttaatgcgaccgacggcgcgtttgaagtcgtgccgcaggtgttttgctggcagctttcctttaccgataacattgccgtcatccagcagaatttcctcgacctgatggcagaatgccgtgtagaacacgtttacctgctgcacaatcccttgggcgaacaggaaaacatcccgagctatgcggaagcgttgaaacgggaagggcgcaatccgtttttcagcgca

SEQ ID NO: 3846 - protein, 365 aa, Neisseria gonorrhoeae
MNQTFTLPDTRPYPQNPIKNHLLLNAYQLAHNSSQASRKLSSGQLQTEIRGMLEQNHYINLSLALTMSPDAGTYAALLSSVNAVLDCEKEGEVQWFALPVVLVSGCKKERAIEMKLPTEALFACLQNYPHLRALTQETQWLPYLVHSSDLSAVAPDEWWRAKQNTEAAAQHLRRFAPRPLLLPEGQSVHVVYVLGFGSGKVQAALGQNLLQAGLPLMQVWQENLASEGITLFANPLSPDTPARALSDGSHTRQRMAMDVFAANAIRAVRMQGPRVGVVAAAKAGGQILFGFNATDGAFEVVPQVFCWQLSFTDNIAVIQQNFLDLMAECRVEHVYLLHNPLGEQENIPSYAEALKREGRNPFFSA

SEQ ID NO: 3847 - DNA, 111 bp, Neisseria gonorrhoeae
tatcatagcaaccttcgatgccgtctgaaaccttgccccgatattcggacggatgcctgccgataaaaaaacagcggcaaatgccgccgtttcccgttcaaacctcgccac

SEQ ID NO: 3848 - protein, 21 aa, Neisseria gonorrhoeae
YHSNLRCRLKPCPDIRTDACR

SEQ ID NO: 3849 - DNA, 351 bp, Neisseria gonorrhoeae
atgggaataaaaaatgaacaaataataatttgtaaaaaatataatacagaaatatatcctgtttccgatgtttcaaaaatcggtgttgctgaaaatgtcaaacagacaggcctgtatccgattaacgggttaaggcaccgtcccaaaggtgatactaacggttggtatatctgggccggtgaaaacttctcctatgataaaaattttttcctgcccttgcatacgttccatttgcaaatatggcgacccgaaatcatcccctttttgacacttccgcccggttaccgttttttaattggggaaaacggttatgaagacgtatggtttgatgaattgctattaaatgataat

SEQ ID NO: 3850 - protein, 117 aa, Neisseria gonorrhoeae
MGIKNEQIIICKKYNTEIYPVSDVSKIGVAENVKQTGLYPINGLRHRPKGDTNGWYIWAGENFSYDKNFFLPLHTFHLQIWRPEIIPFLTLPPGYRFLIGENGYEDVWFDELLLNDN

SEQ ID NO: 3851 - DNA, 1014 bp, Neisseria gonorrhoeae
gtggaatgtctcctctgtcctgtcggtgatgggggagaaggcactgtagatgctatccgacattctcttgacctagaagaaaaatgtctccaagtgacaggaccttttggacaaaaagaagtcatgcgctattttcaaaaagaacaactagccctattcgaagttgctgatttggttggtcttggaaaaatcccgctagagaaacgaaatccattacaaatccaaactcgtggtattggagaattgattcgccacctcattagtcaagaaattaaagaaatctatattggcgttggcggtacggccggtaatgatggaggtattgggattgctgctggtttaggttatcaattttatgatgaggatggaaatgccttacccgcttgcggtcaatccttactaaacccagcttctgtttcaatagaaaatcgctatgaaattcctgaagatgttcacattcgtattttagcagatgttgtgagtcccttatgtggacaccaaggtgcgacctatacgtttggcaagcaaaaagggctggattctactatgtttgaggccgtagatcaggcaatacaagatttttatgaaaaagtcccccctgcaacattaaaacttaaaggagcaggagctggtggaggcatcgctggtggtttgtgtgcctttgctcaggcaagtatcgtatctggaattgacacctgcctggacttgattgactttgataagaaagtgtcagatgttgacttggttatcgttggtgaaggaagactagatcgtcaaagtttagcagggaaagcgcctattggtgtagcaaaaagaacccctgtcggagttcctgttgtcgctatttgcggcagtttcgctgaagatttgccttccctaccatttgaaaatatccaagctgccttttctattttggagaaaagtgaacctttagaagatagtttgaaaaatgccagtctttatttggagcatacggcttctaatattggatatttattaaatatgcctaagatt

SEQ ID NO: 3852 - protein, 338 aa, Neisseria gonorrhoeae
VECLLCPVGDGGEGTVDAIRHSLDLEEKCLQVTGPFGQKEVMRYFQKEQLALFEVADLVGLGKIPLEKRNPLQIQTRGIGELIRHLISQEIKEIYIGVGGTAGNDGGIGIAAGLGYQFYDEDGNALPACGQSLLNPASVSIENRYEIPEDVHIRILADVVSPLCGHQGATYTFGKQKGLDSTMFEAVDQAIQDFYEKVPPATLKLKGAGAGGGIAGGLCAFAQASIVSGIDTCLDLIDFDKKVSDVDLVIVGEGRLDRQSLAGKAPIGVAKRTPVGVPVVAICGSFAEDLPSLPFENIQAAFSILEKSEPLEDSLKNASLYLEHTASNIGYLLNMPKI

SEQ ID NO: 3853 - DNA, 555 bp, Neisseria gonorrhoeae
atgttttggcaggttcttccttatgcggttacgattaaccggccgatgccgtctgaaagggtttccgcttcaggcggcatcgcgttggaacagggatgggatatgaaaaaaccgaaaatcctttttgtctgcctcggcaacatctgccgttcgccgatggcggaatacattttgcgccgccgtgccgccgaagcgggcattcccctcgaaacggacagcgcagggacatcgggctggcacgacggcgaggatatgcaccgtgaaacggcaaagatattgaaaaaatacggcattgacgcttcaggctttaccagccgcaaaatccgccaaagcgatgcgacggcgtttgactacatcatcgctatggacggcaagaatttgtccgaattggaaaaaactttcggcaggcggccggaaaaaatattcaagctgaccgacctgatacccgaaagcggttacgaccatgtccccgatccgtggtacatgggtgattttgaagaaacatacaggcttgcggatgcaggctgtcgggcattattggaaaagatttccaaa

SEQ ID NO: 3854 - protein, 185 aa, Neisseria gonorrhoeae
MFWQVLPYAVTINRPMPSERVSASGGIALEQGWDMKKPKILFVCLGNICRSPMAEYILRRRAAEAGIPLETDSAGTSGWHDGEDMHRETAKILKKYGIDASGFTSRKIRQSDATAFDYIIAMDGKNLSELEKTFGRRPEKIFKLTDLIPESGYDHVPDPWYMGDFEETYRLADAGCRALLEKISK

SEQ ID NO: 3855 - DNA, 597 bp, Neisseria gonorrhoeae
ttgcggatgcaggctgtcgggcattattggaaaagatttccaaataaagcaattgaatacaaacacaaatataaaaccgcctcctgtcgtatcggtcgttcggacggcataaacagggaatttatgaaaacaaatttcaaacagaaaattatcgaacaggcacgcagagaggacttgcaggtaaccgctttgcgcgagcaggtattagatattgtcttgcagcaaagcggcgtgattaaagcctacaatgttttgtcacagatgcagcagcagagcgaaggcgtgcttgcaccgcctaccgcctaccgtgcccttgatttttgggcggatcagggcgttttacacaaagtggcggcggtcaacggctatattttgtgcagccacgcgcagcacgagtgcaacgaccattgccacgaccacgaagaagccgaagcgcaccacagcgcgtttattttggtctgcaccgaatgcggcgcggcggacgagcaaaccctcagccacgagtgggcggcactgcgtgcaggcgttgccgaaagcggttttgcgctgaaagaagaacacgttgttttaactggaatctgtaaaaaatgtcagaag

SEQ ID NO: 3856 - protein, 199 aa, Neisseria gonorrhoeae
LRMQAVGHYWKRFPNKAIEYKHKYKTASCRIGRSDGINREFMKTNFKQKIIEQARREDLQVTALREQVLDIVLQQSGVIKAYNVLSQMQQQSEGVLAPPTAYRALDFWADQGVLHKVAAVNGYILCSHAQHECNDHCHDHEEAEAHHSAFILVCTECGAADEQTLSHEWAALRAGVAESGFALKEEHVVLTGICKKCQK

SEQ ID NO: 3857 - DNA, 924 bp, Neisseria gonorrhoeae
atgtcagaagtgaaaaaaaccaaagtccacctgatttcaggttttctgggaacaggcaaaaccaccgcgctcaaaagcctgatggcgcaaaaagacccgaacgaaaaatgggtcatcatcgtcaacgagttcggcgaaatcggcattgacggcgcggtattgagcgacaacggcatccctgtggcagaaatcgccggcggctgtttatgctgcaccgccggcccgcaaatgggcgtaaccgtgcagaaaatgctgcgcgacgccaaacccgaccgcctgatgattgaggcaagcggactggcgcacgccgccagcgtcatcgacgaattgaaagccaaacctctggacagtcttttggaaatcggcgccgtctttaccgtcgtcgatccgcgccagttcatcaatcccgattacgcgcaacaggcgttgtataaagaccaaatcggcatttgcgacgtattggccgccagcaaaaccgatttatgcacccccgaacagcttgccgaatttcatgacaaagcggcaaaactgttcccacccaaagctaaagtggtcgaagtccaaaacgcacaactcgatatccaatggctcgatattcccgtagttgaaaaatcacgctaccgcctcaaagccctgccggacaacaccatgggcttccagtcgcaaggtttcacattccccgccggacgcgatttcaacggcgaaaaattgaccaacttcttcaatgatttgcccaaaatgaccgaaggactcgtccgcgccaaaggcgtgttccaagtattgggaacgtgggtgtggctcaactgggtggacgggcagtggggcgcgaaccaagtgtcttggcggcgcgattcgcgtttcgagctgattgccaaatcgtttgacgcggatttaatcgaacaaaaacttaaagacgcattggaa

SEQ ID NO: 3858 - protein, 308 aa, Neisseria gonorrhoeae
MSEVKKTKVHLISGFLGTGKTTALKSLMAQKDPNEKWVIIVNEFGEIGIDGAVLSDNGIPVAEIAGGCLCCTAGPQMGVTVQKMLRDAKPDRLMIEASGLAHAASVIDELKAKPLDSLLEIGAVFTVVDPRQFINPDYAQQALYKDQIGICDVLAASKTDLCTPEQLAEFHDKAAKLFPPKAKVVEVQNAQLDIQWLDIPVVEKSRYRLKALPDNTMGFQSQGFTFPAGRDFNGEKLTNFFNDLPKMTEGLVRAKGVFQVLGTWVWLNWVDGQWGANQVSWRRDSRFELIAKSFDADLIEQKLKDALE

SEQ ID NO: 3859 - DNA, 555 bp, Neisseria gonorrhoeae
atgaaacccaaattcaaaaccgttttaaccgcgctgcttttggcggtttccctgccgtctatggcggcaacccgcgtcctgatggaaaccgatatgggcaatatccgtttggttttggacgaatccaaagcctccaaaaccgttgccaatttcgtgcgctatgcccgaaaaggcttttacgacaacacgattttccaccgcgtcatcggcggcttcgtcatccaaggcgacggattgaccgaggacttggtgcaaaaggcaaccgataaggccgttgccaacgaatccggcaacggcttgaaaaacaccgtcggcaccatcgcaatggcgcggacggcagcccccgattccgccgccgcccaattctttatcaatctggcggacaacggttcgctcgactacaaaaacggacaatacggctacaccgttttcggcagggtagaaagcggaatggacaccgtttccaaaatcgcccgcgtcaaaaccgccacgcgcggcttttatcaaaacgtacccgtacagcccgtcaaaatccgtcgcgttgttgtcgggcag

SEQ ID NO: 3860 - protein, 185 aa, Neisseria gonorrhoeae
MKPKFKTVLTALLLAVSLPSMAATRVLMETDMGNIRLVLDESKASKTVANFVRYARKGFYDNTIFHRVIGGFVIQGDGLTEDLVQKATDKAVANESGNGLKNTVGTIAMARTAAPDSAAAQFFINLADNGSLDYKNGQYGYTVFGRVESGMDTVSKIARVKTATRGFYQNVPVQPVKIRRVVVGQ

SEQ ID NO: 3861 - DNA, 534 bp, Neisseria gonorrhoeae
gtgttactgcccgacaacaacgcgacggattttgacgggctgtacgggtacgttttgataaaagccgcgcgtggcggttttgacgcgggcgattttggaaacggtgtccattccgctttctaccctgccgaaaacggtgtagccgtattgtccgtttttgtagtcgagcgaaccgttgtccgccagattgataaagaattgggcggcggcggaatcgggggctgccgtccgcgccattgcgatggtgccgacggtgtttttcaagccgttgccggattcgttggcaacggccttatcggttgccttttgcaccaagtcctcggtcaatccgtcgccttggatgacgaagccgccgatgacgcggtggaaaatcgtgttgtcgtaaaagccttttcgggcatagcgcacgaaattggcaacggttttggaggctttggattcgtccaaaaccaaacggatattgcccatatcggtttccatcaggacgcgggttgccgccatagacggcagggaaaccgccaaaagcagcgcggt

SEQ ID NO: 3862 - protein, 178 aa, Neisseria gonorrhoeae
VLLPDNNATDFDGLYGYVLIKAARGGFDAGDFGNGVHSAFYPAENGVAVLSVFVVERTVVRQIDKELGGGGIGGCRPRHCDGADGVFQAVAGFVGNGLIGCLLHQVLGQSVALDDEAADDAVENRVVVKAFSGIAHEIGNGFGGFGFVQNQTDIAHIGFHQDAGCRHRRQGNRQKQRG

SEQ ID NO: 3863 - DNA, 99 bp, Neisseria gonorrhoeae
ttgttgtcgggcagtaacacgcagacagacgttcagacggcgtcgcccgtttcccaaaaaacgccgtttaaagtaaaaaaatattttaaaacagacagt

SEQ ID NO: 3864 - protein, 33 aa, Neisseria gonorrhoeae
LLSGSNTQTDVQTASPVSQKTPFKVKKYFKTDS

SEQ ID NO: 3865 - DNA, 111 bp, Neisseria gonorrhoeae
atgccgtctgaaaccttgccccgatattcggacggatgcctgccgataaaaaaacagcggcaaatgccgccgtttcccgttcaaacctcgccacgctcttttaaaacagca

SEQ ID NO: 3866 - protein, 37 aa, Neisseria gonorrhoeae
MPSETLPRYSDGCLPIKKQRQMPPFPVQTSPRSFKTA

SEQ ID NO: 3867 - DNA, 996 bp, Neisseria gonorrhoeae
atgagcagacccgtacccgccgtattcggcagcgtttttcacagtcaaatgcccgtcctcgcctaccgcgaaggcaaatggcagccgaccgaatggcaatcttcccaagaccttacccttgcacccggcgcgcatgccctgcattacggcagcgaatgctttgaaggtttgaaggccttccgtcaggcagacggtaaaatcgtgctgttccgtccgaccgccaatatcgcgcgtatgcggcaaagtgcggacattttgcacctgccgcgccccgaaacccaagcttatctcgatgctttggtcgaactggtcaaacgtgccgccgacgaaattcccgatgcgcctgccgcgctgtacctgcgcccgaccttaatcggtaccgatcccgttatcggcaaggccggttctccttccgaaaccgccctgctgtatattttggcttcccccgtcggcgactatttcaaagtcggctcgcccgtgaaaatcttggtggaaaccgaacacatccgctgcgccccgcatatgggccgcgtcaaatgcggcggcaactacgcttccgccatgcactggttgctgaaggcgaaagccgaatacggcgcaaatcaagtcctgttctgcccgaacggcgacgttcaggaaaccggcgcatccaactttatcctgattaacggcgatgaaatcattaccaaaccgttgacagacgaattcctgcacggcgttacccgcgattccgtgctgactgtcgccaaagatttgggctataccgtcagcgaacgtaatttcacggttgacgaactgaaagctgctgtggaaaacggtgcggaagcgattttgaccggtacggccgccgtcatctcgcccgttacttccttcgtcatcggcggcaaagaaatcgaagtgaaaaaccaagaacgcggctatgccatccgtaaggcgattaccgacatccagtacggtttggcggaagacaaatacggctggctggtcgaagtgtgc

SEQ ID NO: 3868 - protein, 332 aa, Neisseria gonorrhoeae
MSRPVPAVFGSVFHSQMPVLAYREGKWQPTEWQSSQDLTLAPGAHALHYGSECFEGLKAFRQADGKIVLFRPTANIARMRQSADILHLPRPETQAYLDALVELVKRAADEIPDAPAALYLRPTLIGTDPVIGKAGSPSETALLYILASPVGDYFKVGSPVKILVETEHIRCAPHMGRVKCGGNYASAMHWLLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKNQERGYAIRKAITDIQYGLAEDKYGWLVEVC

SEQ ID NO: 3869 - DNA, 1617 bp, Neisseria gonorrhoeae
atgctgccaacccaacccaacccaacccaacccaacccaacccaacccaacccaacccaacccaacccaagccctgatctaagcgacacagccggggcgaacactgaggcaatctacacttcagacggcattaccgccaactctacccaactcgaacagctcaaaaaactgtttcccgcctgttttgacgcagacggaaatttccttatcgacagattacaagccgaaattgcgccacagaccgacatcggacgcgaattttacgaaatgaactggctgggcaaatcatatgcccgcctgcttcgcaacctgccgcccgaaaccctgataagtgaagacaaaacgcacaacgccaagcccgaaaatgcaggcagccaaaatctgctgattcgcggcgataatctggaagtgttgaaacacttaaaaaacgcctacgcaaacagcgtgaagatgatttacatcgacccgccctacaacaccggatcggacggctttgtctatcaggacgaccgcaaattcacacccgccgaacttgccctcctggcgaatattgacgaagacgaagccgcgcggattttagatttcaccgacaaaggctcaaactcgcacagcgcgtggctgacctttatgtatccgcgcctgtatatcgcccgcgaactgttaaaggacgacggcgtgatttttatctcgattgacgataacgaagcggcgcagttgaaattgttgtgtgatgaagtgtttggggaagggaattttgttgcacaattgccttggcgaaaaagaacagctaaatcagatgtgccttttggtatttcgcaggattatgaatggatatttgtattcgcaaaatcttgccaatttattgcagcaactaaaggcaaggaacgacgctattatgagactgatgatttccccgatcgtccttggcgtacccacgacttaacgaaacaaacaactgcggcggaaaggccaaatagttttttcacaatggttgatcccaagacaggaaaaaaatatccagcaaatccaaatgcaacttggcgtgtaaccaaagatacatttcaagattattataataaaggaaaaatcgttttccctgatgattatgatttcttaaatatcagcaatccagttatgcgttactttaaagatgacgacatgaaaaaagctggcgaggattttggcaaagtagctgtaagcagtagattacctgaaaatgttggtacattagccgatgcagtagccgaatatttggctatttttagtaggacgctacctgaaaatatcggaatgactaaagaaggcacaaaagaaatcacagatttatttggtagcaaaatatttaccttccccaagcctagtcaattgattaaatttttagtttcaataagttcaaagagtaatgacctaatcctagacttcttcgcaggcagcggcacaaccgcccacgccgtgatgcagcttaacgccgaaggacaaaacggtaaccgccgctatatctgtgtacagcttcccgaaaaaaccgctgaaaaatccgaagcccgtaaagcaggctacccgaccatcttcgacatcaccaaagcccgcatagaaaaagccgccgccaaaatccgcgtc

SEQ ID NO: 3870 - protein, 539 aa, Neisseria gonorrhoeae
MLPTQPNPTQPNPTQPNPTQPNPSPDLSDTAGANTEAIYTSDGITANSTQLEQLKKLFPACFDADGNFLIDRLQAEIAPQTDIGREFYEMNWLGKSYARLLRNLPPETLISEDKTHNAKPENAGSQNLLIRGDNLEVLKHLKNAYANSVKMIYIDPPYNTGSDGFVYQDDRKFTPAELALLANIDEDEAARILDFTDKGSNSHSAWLTFMYPRLYIARELLKDDGVIFISIDDNEAAQLKLLCDEVFGEGNFVAQLPWRKRTAKSDVPFGISQDYEWIFVFAKSCQFIAATKGKERRYYETDDFPDRPWRTHDLTKQTTAAERPNSFFTMVDPKTGKKYPANPNATWRVTKDTFQDYYNKGKIVFPDDYDFLNISNPVMRYFKDDDMKKAGEDFGKVAVSSRLPENVGTLADAVAEYLAIFSRTLPENIGMTKEGTKEITDLFGSKIFTFPKPSQLIKFLVSISSKSNDLILDFFAGSGTTAHAVMQLNAEGQNGNRRYICVQLPEKTAEKSEARKAGYPTIFDITKARIEKAAAKIRV

SEQ ID NO: 3871 - DNA, 342 bp, Neisseria gonorrhoeae
ttgccgcttaacgatgaattaagcgaagaacagctgcaaacgcttctgaccacctggacgctgtatgacggggcggcactgaccacgccggttgagcctgtgcggttgggcagttatacggcgtatctgtgcgaaaaacggctgtatctgcttaacaagggttttacttccgccgatttgctggcgtttatcaagaagctggacgacgatgcggatttcaatcccaaccgtgtgattgtattcggcagcaatatggcaagcgccatgcagcacgaactcgaccaggcggttcgcggttataccaataaaaaagagattgagttgaatgtgattatcagggtg

SEQ ID NO: 3872 - protein, 114 aa, Neisseria gonorrhoeae
LPLNDELSEEQLQTLLTTWTLYDGAALTTPVEPVRLGSYTAYLCEKRLYLLNKGFTSADLLAFIKKLDDDADFNPNRVIVFGSNMASAMQHELDQAVRGYTNKKEIELNVIIRV

SEQ ID NO: 3873 - DNA, 351 bp, Neisseria gonorrhoeae
atgcgggcggtttcggcggttttgggcgtgtttgacggggcaacgcccaaatatcggacggcagacgaaaatcccgaacttttgtttgctgcaaaacaatacgcaaacaatatcctgaaagtgcaaagccaaaacggtatagacggccgattccccgaccgttcggacgaccaaaatatccttgatatttccatggaaacgggcacgggcaaaacctatacctacacacaaaccatgttcgagctgcaccgttggctgggcgtgttcaaatttatcgtggtcgtgccgactttgtccattaaggcgggaacacagcagtttttgcaaagcaaggctttggccagagcattt

SEQ ID NO: 3874 - protein, 117 aa, Neisseria gonorrhoeae
MRAVSAVLGVFDGATPKYRTADENPELLFAAKQYANNILKVQSQNGIDGRFPDRSDDQNILDISMETGTGKTYTYTQTMFELHRWLGVFKFIVVVPTLSIKAGTQQFLQSKALARAF

SEQ ID NO: 3875 - DNA, 2499 bp, Neisseria gonorrhoeae
gtggtggaaagcgcgaaaaagaataagggcaaaaagtccaatgcgcccataacgattgagcaatttgtcaaagcggaaaacaaaaaggaaattcatgtgctgctgattaacgcgggcatggttaattcgtcgtccatgaacgatacgggcgacaaggcattgaaggatttgtttgacaatcccgttgatgcattggctgccgtgcgcccgtttatgattgtggacgaaccgcataaattcccgacccgagatagcgcgaaaacgtggggcaatatcaaacgcttaaaaccgcaatatattttgcgctacggtgcaacatttaacgatgaatattacaacttgctttaccgtttgacggcagtagacgcgtttaacgacgggctggtcaaaggcgtgcgcgtgtttcaggaagaaatgcagggcggcatggatgcggcggtaaaactggtgtcgtcggacggcaaagaagcgaaatttgaattaaacgaaaaggacaaaaagcagacgttcaaactggcaaaaggcgaagatttggcgcaaatccatccggctatttcggatttgaaaatcgacaaaatgaataaaaccgtggtggtgttaagcaacggcttggagttgaaaacgggtgccgtcatcaacccttattcctattcgcaaacggtgcaggatgcgatgatgcagcgggcggttgccgaacatttcaagctggaacgcgcgcttttggcagaacgcgcgccacagcccaaaatcaagccgctgacgctgttttttattgacgatatcgcgggctaccgcagcggcaacgagctttcaggcagcctgaaagataaatttgaaagctggattcgcgcggaagcggcacgccgtctgaaaacggaaagcgacccgttttaccgcgattacctgcaaaagacgttggacgatgtatccgcctgccacggcggctatttttccaaagacaatacagacagcgacgatagaatcgagcaggaaatcaatgaaatcctgcacgataaggaaaaactgctgtctttggacaacccgcgccgctttattttttccaaatggacgctgcgcgaaggctgggacaatcccaacgttttccagatttgcaaactgcgttccagcggcagcacgacttccaagctgcaagaagtcggacgcggcctgcgcctgccggtaaacgagctgatggcgcgggtgcgcgatgtaccgtacaaactgaattattttgtcgatagcagcgaaaaagactttgtgaagcagcttgtcggcgaaatcaacgacaattcttttcaggaagaaatctccaaaaagtttaccgaagagctgaaacaaaaaatattgcaaaaataccccgatatcaaaccgctggtattggtaaaccaactgttttcagacggcatcattgacgacaatgaaaactttgccgaagacggctatgacaaattaaaagccgcctatcccgaagccttccccaaaggtttggacaaaggcaaagtcagcaacgccaaagacgagggcaaagacaccatcatcatgcgcgaaggcaaatatgaagaactcaaagccttgtgggagctgattcaccataaagccgttttgcagtacaaaatcaaagatgaagccgaatttgtcgatttatttaccgcctatttgcgtgaaaacgccgccaaattcccgcaggcaggcatatgcacggcggtaaacgaagcttatatcaacaacgggcttatgctttcccgccgcatagacagtattgaagatgaagattttatccgtttcaacacaatgacttaccgtgagtttctggaaaaactggcacaaacggcaaaaatccagatgcagactttgcatcaggcgttttaccgcgtccgcgacgaactgaacattggcgattttttgaatatgcagaccatcgcccaaatcaaaaacggcttcaaccggtttttgcttcatcattccttccataaattcgaactggattaccggcttgtcggcagcaaaatccatccgaccaaatttaccaataaagacggcaaaccgcgcgcggtgaaaaaagcagatttgggcagatttgaagatacggagcaccggcctgccgccggctatctcttcggcgagattttctacgattcggatatagaacatgaaaatgtcgccaacaaccaaattgaaggcgtaatcgtatttaccaaaataccgagaaactccatcaaaatccctgttgccggcggcggcacgtattcgcccgactttgcctatatcgtgaaaaccaaaagcggcgagattctgaactttgtgattgaagccaaagggactgacggggcggaagatttgcgaaaaagcgaagagcggaaaatcaaacatgccgaaaagctgtttgccgagatttccaaagaaatcaaggtggtgttcaaaacgcagtttgacggcgagaggatagccgaactgatcgggcaaaatatgccagcaggcgggcattctgaaaacggacac

SEQ ID NO: 3876 - protein, 833 aa, Neisseria gonorrhoeae
VVESAKKNKGKKSNAPITIEQFVKAENKKEIHVLLINAGMVNSSSMNDTGDKALKDLFDNPVDALAAVRPFMIVDEPHKFPTRDSAKTWGNIKRLKPQYILRYGATFNDEYYNLLYRLTAVDAFNDGLVKGVRVFQEEMQGGMDAAVKLVSSDGKEAKFELNEKDKKQTFKLAKGEDLAQIHPAISDLKIDKMNKTVVVLSNGLELKTGAVINPYSYSQTVQDAMMQRAVAEHFKLERALLAERAPQPKIKPLTLFFIDDIAGYRSGNELSGSLKDKFESWIRAEAARRLKTESDPFYRDYLQKTLDDVSACHGGYFSKDNTDSDDRIEQEINEILHDKEKLLSLDNPRRFIFSKWTLREGWDNPNVFQICKLRSSGSTTSKLQEVGRGLRLPVNELMARVRDVPYKLNYFVDSSEKDFVKQLVGEINDNSFQEEISKKFTEELKQKILQKYPDIKPLVLVNQLFSDGIIDDNENFAEDGYDKLKAAYPEAFPKGLDKGKVSNAKDEGKDTIIMREGKYEELKALWELIHHKAVLQYKIKDEAEFVDLFTAYLRENAAKFPQAGICTAVNEAYINNGLMLSRRIDSIEDEDFIRFNTMTYREFLEKLAQTAKIQMQTLHQAFYRVRDELNIGDFLNMQTIAQIKNGFNRFLLHHSFHKFELDYRLVGSKIHPTKFTNKDGKPRAVKKADLGRFEDTEHRPAAGYLFGEIFYDSDIEHENVANNQIEGVIVFTKIPRNSIKIPVAGGGTYSPDFAYIVKTKSGEILNFVIEAKGTDGAEDLRKSEERKIKHAEKLFAEISKEIKVVFKTQFDGERIAELIGQNMPAGGHSENGH

SEQ ID NO: 3877 - DNA, 867 bp, Neisseria gonorrhoeae
atgatcgagccgggcgacaaaatcatggtctgcctctccggcggcaaagacagctacgccctgttagacatcctgcgccggctccaagccagcgcgccgattgattttgaactggtcgccgtcaatctcgaccaaaaacagccgggcttccccgaagaagtattgccgacctatctcgaaagcatcggcgttccctacaaaatcgttgaagaagacacttactccaccgtcaaacgcgtgttggacgaaggcaaaacgacttgttcgctgtgcagccgcctgcggcgcggcatcctctaccgcaccgcaaaagaattgggctgcaccaaaatcgccttgggacaccaccgcgacgacatcctcgccaccatgtttttaaatatgttttacggcggcaaactcaaagccatgccgcccaagctggtgagcgacaacggcgaacacatcgtcatccgcccgctggcgtatgtgaaagaaaaagacttaatcaaatacgccgaattgaaacagttccccatcatcccgtgcaacctctgcggctcgcagcccaacctacaacgccaagtcatcggcgatatgctgcgcgattgggacaaacgcttccccggccgtatcgaatcgatgttctccgccctgcaaaacgtcgtcccttcccaccttgccgataccgaactctttgactttgccggattggaacgcggtcaaaatctgaaacacggcggcgatttggcttttgacagcgaaaaaatgcccgaacgcttttcagacggcagcgaagaagatgagagcgaaatcaaaatcgagccgcaaaaagccgaacgcaaagtcatcaacattctggcgaacaagccgaaaacctgcggccca

SEQ ID NO: 3878 - protein, 289 aa, Neisseria gonorrhoeae
MIEPGDKIMVCLSGGKDSYALLDILRRLQASAPIDFELVAVNLDQKQPGFPEEVLPTYLESIGVPYKIVEEDTYSTVKRVLDEGKTTCSLCSRLRRGILYRTAKELGCTKIALGHHRDDILATMFLNMFYGGKLKAMPPKLVSDNGEHIVIRPLAYVKEKDLIKYAELKQFPIIPCNLCGSQPNLQRQVIGDMLRDWDKRFPGRIESMFSALQNVVPSHLADTELFDFAGLERGQNLKHGGDLAFDSEKMPERFSDGSEEDESEIKIEPQKAERKVINILANKPKTCGP

SEQ ID NO: 3879 - DNA, 333 bp, Neisseria gonorrhoeae
aacctcgccacgctcttttaaaacagcataagccgcacctttctcccgtgtggaatttttaaaaaaaccatcactctttacgatttcatgcagctcctcacttgatttctccgcatattccattttcaacgccttatgctgattgccggcttcaatcaatccctcgcctactgcttttgctgcttttcccacactaccccaaaaacccataatcatgtcctccaatcgtttcaaataaataaggtcgttgtttctgtcaagaaacaacgacagtttataaactgtcggaaaacaaaatgccgtctgaacgccggataacgcttcagacggcat

SEQ ID NO: 3880 - protein, 6 aa, Neisseria gonorrhoeae
NLATLF

SEQ ID NO: 3881 - DNA, 864 bp, Neisseria gonorrhoeae
atgatgaaaaccttactgccctttttcggcgtggcgcgcgtcagcggcgaagaccgccaaaccttcctgcacggacagctttccaacgacatcaataatcttcagaccgggcaggcgtgttacgcgacttacaacacgcccaaaggccgcgtcatcgccaatatgattgtcgtcaaccgtggagacgatttgctgctgattatggcgcaagatttgcttgaagcaacggtcaaacgcctgcagatgtttgtgttgcgcgccaaagccgtttttgaaatccttgaagattacgccgtcggcgcggaattggcagcatccgccgaaccgcttgccgcgcaagaacccagtctcgcctttacctccgaatgcgtctcagacggcatctgttccgtcatcctgcaccatcggggcattttgcacatcgcccccgaaaccgccctacccccttatgacgctgccgccgaaaacgcgtggcggctgcacgaaatccgcagcggttatccgtggatatgcgcggctaccaaagaaaccgccgtcgcccaaatgctcaaccagcacatcatcggcggcgtacacttcaaaaaaggctgctacccgggacaggaaatcatcgcgcgcgcccagtatcgggggcaggtcaaacgcggcttggcggtattgtcgggaaattcggcagccgaagcgggcatcctgctgacggcggacggcgaagaagccggcatcgtactcgacagcgttcaagattcggaaaactttaccgcccttgccgtgattaaattctccgccgcgcaaaaagaactcaccgtcccaaacggcggtatcttcaaagcggttcatctcttctttaaaaccaaaaatgcagaa

SEQ ID NO: 3882 - protein, 288 aa, Neisseria gonorrhoeae
MMKTLLPFFGVARVSGEDRQTFLHGQLSNDINNLQTGQACYATYNTPKGRVIANMIVVNRGDDLLLIMAQDLLEATVKRLQMFVLRAKAVFEILEDYAVGAELAASAEPLAAQEPSLAFTSECVSDGICSVILHHRGILHIAPETALPPYDAAAENAWRLHEIRSGYPWICAATKETAVAQMLNQHIIGGVHFKKGCYPGQEIIARAQYRGQVKRGLAVLSGNSAAEAGILLTADGEEAGIVLDSVQDSENFTALAVIKFSAAQKELTVPNGGIFKAVHLFFKTKNAE

SEQ ID NO: 3883 - DNA, 462 bp, Neisseria gonorrhoeae
gtgttatcggataagtgtgtttactcatttttcgtcatgcaaaacatggaaatcggtcaagcgcaatgttaccatatatcccctttatcgaaggaaaccgatatggatatccggtatttcggcacaacgccccgctattccgaagcggtttgcgcgggcggcttgattttcctctccggcatggttcccgaaaacggtgaaacggctgccgaacagactgccgacgtgcttgcccaaaccgaccgctggctggcggaatgcggctcggacaaggcacacgttttggatgcggtcatctacctgcgtgatatgggcgactatgcggaaatgaacggcgtgtgggacgcttgggttgccgccggcagaacgcccgcccgcgcctgcgtggaagcgcggctcgcccgtccggagtggcgcgtcgaaatcaaaataaccgccgtgaagagagacgcggcaactgca

SEQ ID NO: 3884 - protein, 154 aa, Neisseria gonorrhoeae
VLSDKCVYSFFVMQNMEIGQAQCYHISPLSKETDMDIRYFGTTPRYSEAVCAGGLIFLSGMVPENGETAAEQTADVLAQTDRWLAECGSDKAHVLDAVIYLRDMGDYAEMNGVWDAWVAAGRTPARACVEARLARPEWRVEIKITAVKRDAATA

SEQ ID NO: 3885 - DNA, 477 bp, Neisseria gonorrhoeae
atgagtaaacacacttatccgataacacctgccgtacgcgttttgcgtgaaaacggcatcgaatttgaaccttttacctatgcctatgaggaacacggcggcacggcgcagtttgcccgactgttcggcaaagacgaacacttggtcattaaaaccattgttttgcaagatgaaaacggtaaggggccgattgtcttgatgcacggcgacaaacagatttcaacccgcaatctggcgcggcatttgggtgcgaaacacatcgaacccgccgcgcctgcgcaggcaaacaagtggacgggctatctggtcggcggcacaacgccgttcggcatccggacaaaattggatatttacgtcgaacagtcggtgatggatttggaaaccatctatatcaatggcggaaaacgcgggttcattatcggtatccgccccgatgatttaaatattttgaacccgaaaacaatacaggcagcggtt

SEQ ID NO: 3886 - protein, 159 aa, Neisseria gonorrhoeae
MSKHTYPITPAVRVLRENGIEFEPFTYAYEEHGGTAQFARLFGKDEHLVIKTIVLQDENGKGPIVLMHGDKQISTRNLARHLGAKHIEPAAPAQANKWTGYLVGGTTPFGIRTKLDIYVEQSVMDLETIYINGGKRGFIIGIRPDDLNILNPKTIQAAV

SEQ ID NO: 3887 - DNA, 690 bp, Neisseria gonorrhoeae
atggacaaagatttgtatgccgtattgggcgtgtcgccgcaggcgggggcggacgaaatcaaacgcgcctaccgcaagctggcgatgaaataccatcccgaccgcaatccgggcaatctgcaggcggaagaaaagttcaaagaaatccaacgggcttacgatacgctttccgacctgtcaaaacggacgcaatacgacgcgtccttcagacggcatgaggaacgcgggcggcaggaagaggcattccgccgcgaacaggcgcgcagggagcagttttacggcgaacagatgcgccgcgaacaggcgttcagacgggagtttgaacggcaggcttcacgttcgcgccatgcttacgaaccgtccggcagcggaagcgggcgcaactatatcctcgccgcctacatcctgttcggtttgggtgcaatcatacagttcatgcccatagtcggcgtgattctcgcctatatgaaacggaacagtttggacagcattgtctatgccgcacataccgaatacctgattaaaaccttttggcgcacattttggctttatcttttgggcgcgctgactgcccgtttcggcatcggcgtgctggttattattgcaacgaccgtctggtatttctaccgcatcatcgccggctttatccgcttcaacgacggcagggcggttgcgcccgagaaatggata

SEQ ID NO: 3888 - protein, 230 aa, Neisseria gonorrhoeae
MDKDLYAVLGVSPQAGADEIKRAYRKLAMKYHPDRNPGNLQAEEKFKEIQRAYDTLSDLSKRTQYDASFRRHEERGRQEEAFRREQARREQFYGEQMRREQAFRREFERQASRSRHAYEPSGSGSGRNYILAAYILFGLGAIIQFMPIVGVILAYMKRNSLDSIVYAAHTEYLIKTFWRTFWLYLLGALTARFGIGVLVIIATTVWYFYRIIAGFIRFNDGRAVAPEKWI

SEQ ID NO: 3889 - DNA, 873 bp, Neisseria gonorrhoeae
atggcctacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgtcggtattgaagccggatgtcggcaatatcggtgcatttttgccgacgtggccgctgtttgccgctttgggcgtgctgctgccgtccgtatttgtcattatgggcaaatccgtagaatccgccggtatcgtcaaatccgacgcggcgcagcgtttgtcgctgtttttaccgattgttgccgctttgacgctgtttggcgaaaaactcagtgaaggcaaactgatcggactgtgcctcgcctttgccgcactgttctgcctgctttggaaaagcgacagcggcaaaaaatcaggcagcgcgtggcggcaggcgttattgctgctcggtgtgtgggcgggttacggcattatcgacatcctgttcaaacagattgccaaaagcggcacggcatttgcgggcaacctgctggttgcatttgcgctggcgggtgtgctgatgtttgcctgcctgtttgccaaatcggtcagatggcgcgttgagagcgtggtcggcggcatactcttgggcggtttgaattttatgaacatcgtaacctacatcactgcgcaccaaatgatgaaggacagtcccacgctggtttttgccggtatgaatatcggtgtgattgttttagggacgctttcgggcgcattgttctttaaggaaaaaatcaacacaatcaatacggcaggcattgtactgtcattatgctccattgcctgcctgttctattggacagaagttaaggcattgttcggcata

SEQ ID NO: 3890 - protein, 291 aa, Neisseria gonorrhoeae
MAYLLISIVFSVSVSILLKMARKKKIDIAQAVAVNYVVAVILTLSVLKPDVGNIGAFLPTWPLFAALGVLLPSVFVIMGKSVESAGIVKSDAAQRLSLFLPIVAALTLFGEKLSEGKLIGLCLAFAALFCLLWKSDSGKKSGSAWRQALLLLGVWAGYGIIDILFKQIAKSGTAFAGNLLVAFALAGVLMFACLFAKSVRWRVESVVGGILLGGLNFMNIVTYITAHQMMKDSPTLVFAGMNIGVIVLGTLSGALFFKEKINTINTAGIVLSLCSIACLFYWTEVKALFGI

SEQ ID NO: 3891 - DNA, 3618 bp, Neisseria gonorrhoeae; identical to SEQ ID NO: 71

SEQ ID NO: 3892 - protein, 1206 aa, Neisseria gonorrhoeae; identical to SEQ ID NO: 72

SEQ ID NO: 3893 - DNA, 876 bp, Neisseria gonorrhoeae
atgccatccgtaaggcgattaccgacatccagtacggtttggcggaagacaaatacggctggctggtcgaagtgtgctgatgctttaaataaaaaaatgccgtctgaaacccgtttggcgtttcggacggcattttcgcgttcggaccgtttccgccgcacctgcagcaagtcggtacaaaggcaatcggttaaaacaagcgtccgcatttcccatcccgcctgccgcaagtcgggcatttccctggaaatacgcttcaaacggcaaaccgccgcccgaaaccgatactcggcacggacggcgcacggatttgaaaacggcggattatccctcggtgctcaaggcattaatgctgtaaccgccgtcaacataagtgatttcgccggtaatgccggacgacaggtcggacagcaggaaggcggcagtattcccgacttcttcgatggtaacgttgcggcgcagcgggttgtgggcggcgacgtgtcccaagagtttgccgaaatcggcgatgccggaggcggcgagcgttttgatcgggccggcggaaatgccgttgcagcggatgccctctttacccagacaggcggcggtaaagcggatgcctgcctcaaggctggcttttgccatacccatcacgttgtaattcggaatcgcgcgtaccgcgcccaagtagctaagggcgacgatggcggagttcctgccgcgcatcatcggacgggcggcttttgccaatgcgggcaggctgtatgcggaaatttcgtgtgcggtgttgaacgcttcgcggctgatgctgtcgaggaagtcgccgctcaaggcttctttcggcgcgaagccgatggaatgcaccaaaccgtccaagccatcccaatgtttgcc

SEQ ID NO: 3894 - protein, 292 aa, Neisseria gonorrhoeae
MPSVRRLPTSSTVWRKTNTAGWSKCADALNKKMPSETRLAFRTAFSRSDRFRRTCSKSVQRQSVKTSVRISHPACRKSGISLEIRFKRQTAARNRYSARTAHGFENGGLSLGAQGINAVTAVNISDFAGNAGRQVGQQEGGSIPDFFDGNVAAQRVVGGDVSQEFAEIGDAGGGERFDRAGGNAVAADALFTQTGGGKADACLKAGFCHTHHVVIRNRAYRAQVAKGDDGGVPAAHHRTGGFCQCGQAVCGNFVCGVERFAADAVEEVAAQGFFRREADGMHQTVQAIPMFA

SEQ ID NO: 3895 - DNA, 471 bp, Neisseria gonorrhoeae
accctgcccgccgccgttgttcaaatagtgttcccagtgagaatataaccgggcaatattttcttcataagtgtgggcagaaggaatataaccgtctttgggcggcatatacctgacaaatgattctatttcttccggataatcgaaatccgcataaattttttcaacttcccccaaagggccgtaaaattcttcctttctatggaatacgtcatttaggaggatgtacagccaatttttaggggaataacccctcgtttccgaagccaaatcttctagaacaggctttaattcaagaatattggatttattggttaaagatagcttgaacacgcgttcatcatgatctgaaagcgtcatttttcgggcataagctgccacatcagcccaacccaagtatttattctcatacccccacagaatatccttccaagaaaggcggactttttgagcggttaaatcaaggttcat

SEQ ID NO: 3896 - protein, 15 aa, Neisseria gonorrhoeae
TLPAAVVQIVFPVRI

SEQ ID NO: 3897 - DNA, 546 bp, Neisseria gonorrhoeae; identical to SEQ ID NO: 3

SEQ ID NO: 3898 - protein, 182 aa, Neisseria gonorrhoeae; identical to SEQ ID NO: 4

SEQ ID NO: 3899 - DNA, 1326 bp, Neisseria gonorrhoeae
atgttgaataatgtcttgcaaaccacggcggcggaaagcgcgcgcctgattacgccgggctatgtgctgtggattgtatgtttgggcgtattgcccgcgctggcatatatcgccgtcaaggtcaaataccgcgtttggtataaggagcttttgacgcgccttgtgcttgccgccgtttcctttttgtgcgcgttgggtatcgcgatgttgcaatatcaggattacgcctcgtttttccgcaacaataaatcagtaacccatctgattgtgccgtctaatttcatcggcgcgggcgtgtcgaaatacaaagattggaagcgttccaatattccttatacgcaattggatatggcggtcgtgcaaaaccggccggccggcagcctgcgccgtttcgtggtgctggtcgtgggcgagactacgcgtgccgccaactggggtttgaacggttacagtcgccaaactacgccgctgcttgccgcgcgcggcgatgaaattgtcaatttcccgcaggtcagaagctgcggcacatcgaccgcgcactccctgccgtgtatgttctcaaccttcgaccgcacggattatgacgaaatcaaagccgaacaccaagacaacctgctggacatcgtgcagcgcgccggcgtggaagttacttggttggaaaacgattccggctgcaagggcgtgtgcggcaaagtgccgaataccgacgttacctcgctcaacctgcccgaatactgccgcaacggcgagtgcctcgacaatatcctgttgaccaagttcgacgaagccctcaacaaaaacgataaagacgcggttttaatcctgcataccatcggcagccacgggccgacgtattacgaacgctataccgaagccgagcgcaaattcacgccgacatgcgataccaacgaaatcgacaaatgcgcccgcgccacgttggtcaacacttacgacaatacggttttgtatgtggatcagtttatcgacaaggttatccgcaaacttgaaaaccgcgacgatttggaaagcgcggtgtattatgtttccgaccacggcgaaagtttgggcgaaaacgggatgtacctgcacgccgcgccttacgccatcgcgccttccggacagacgcatatcccgatggttatgtggttttccaaagccttccgccaacacgggggcatagatttccaatgcctcaaacaaaaagcggcggaaaacgaatattcgcacgaccactatttcagcacggtattggggctgatggacatttccaacagccaaacctatcggaaggaaatggatatattggcagcctgccgccgtccgcgc

SEQ ID NO: 3900 - protein, 442 aa, Neisseria gonorrhoeae
MLNNVLQTTAAESARLITPGYVLWIVCLGVLPALAYIAVKVKYRVWYKELLTRLVLAAVSFLCALGIAMLQYQDYASFFRNNKSVTHLIVPSNFIGAGVSKYKDWKRSNIPYTQLDMAVVQNRPAGSLRRFVVLVVGETTRAANWGLNGYSRQTTPLLAARGDEIVNFPQVRSCGTSTAHSLPCMFSTFDRTDYDEIKAEHQDNLLDIVQRAGVEVTWLENDSGCKGVCGKVPNTDVTSLNLPEYCRNGECLDNILLTKFDEALNKNDKDAVLILHTIGSHGPTYYERYTEAERKFTPTCDTNEIDKCARATLVNTYDNTVLYVDQFIDKVIRKLENRDDLESAVYYVSDHGESLGENGMYLHAAPYAIAPSGQTHIPMVMWFSKAFRQHGGIDFQCLKQKAAENEYSHDHYFSTVLGLMDISNSQTYRKEMDILAACRRPR

SEQ ID NO: 3901 - DNA, 282 bp, Neisseria gonorrhoeae
atgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcgaaaatacaacggaatcgaccgcaaacctttcccgccgttcttgaaaggatgggaatttcgacttaactccggcacaccgtcccggcagctaaaaatcctgcgggatcggtgtggaatt

SEQ ID NO: 3902 - protein, 94 aa, Neisseria gonorrhoeae
MPDGIVYADSPGSRGKSDAGGFTRCRINRSKEFADRRNHINGIGNFWNQAKRALRKYNGIDRKPFPPFLKGWEFRLNSGTPSRQLKILRDRCGI

SEQ ID NO: 3903 - DNA, 90 bp, Neisseria gonorrhoeae
ggcttgatggctgttacctatgcgggtgtagatagattggcagcccattttcaacaggcgataacccatagcataacgggcgcgcctcaa

SEQ ID NO: 3904 - protein, 30 aa, Neisseria gonorrhoeae
GLMAVTYAGVDRLAAHFQQAITHSITGAPQ

SEQ ID NO: 3905 - DNA, 96 bp, Neisseria gonorrhoeae
atgaagttatggtgtcaaaatcaggctttcaaaacaacctttgaaaggcagaaccatgaacaagccgtttatcacgcaggcgcagttggcacttta

SEQ ID NO: 3906 - protein, 32 aa, Neisseria gonorrhoeae
MKLWCQNQAFKTTFERQNHEQAVYHAGAVGTL

SEQ ID NO: 3907 - DNA, 420 bp, Neisseria gonorrhoeae; identical to SEQ ID NO: 95

SEQ ID NO: 3908 - protein, 140 aa, Neisseria gonorrhoeae; identical to SEQ ID NO: 96

SEQ ID NO: 3909 - DNA, 192 bp, Neisseria gonorrhoeae
ttgttttgtcttcagcggcaagatgtatcggctgttgccgacagggtgcatattagtacgaatgcaaataataatctaattaaaactcattatcaaatattggttgtagattgcatttgtcaatattttatttttaatatcattgcattatcatctaataaatacaaatatcatagtaacggcaacaggctg

SEQ ID NO: 3910 - protein, 64 aa, Neisseria gonorrhoeae
LFCLQRQDVSAVADRVHISTNANNNLIKTHYQILVVDCICQYFIFNIIALSSNKYKYHSNGNRL

SEQ ID NO: 3911 - DNA, 948 bp, Neisseria gonorrhoeae; identical to SEQ ID NO: 73

SEQ ID NO: 3912 - protein, 316 aa, Neisseria gonorrhoeae; identical to SEQ ID NO: 74

SEQ ID NO: 3913 - DNA, 1569 bp, Neisseria gonorrhoeae
gtgcaaacctgcattgccttgagggatttctgtttttacttctttcagacggcctccctgcccaaaggaccccatcccatgacccaccgcctctgcctgcttttcctgccgctctgtacggtctgccttgccgctccgtccaacgatgccgccgacgaacgccgccgcctgctggacgagggcagccgccaaacgcagcaataccgcgaaagcggttggctggacacggaacaggcacgcggggaagtagaggaaaacgacggctatatttcgataggcggcgaaatctaccaagtcggcgatacggcggaagaactggaaagcgcaatttaccacgccctcaatgcgcggcagtggcacaaggtgcggcagttcgccgcccgctacgccaaactgccccggcacaagcccgcgctgattcatttggccgatgcgctgcaaaaacgggacgaaggggatttccgcgcggcggggaacagttttcagacggccttggaagccgaacccgacaacccgcgcctgctgctcgaagcggggcggttttatgccgaagacaaccaaaacaaagagtctgccgccgcgtttgagaaagttctgaaaacggacattcccgcagaaacccgccccatcgtggaaaactacctgtccgaactgggcaaacgccgccgctggcacggccaaatcagcctcggctacggctataacagcaatgtaaaccaaggcaacggcatcaaccaatgcgtgtgggaaattgcgggcatgtgcctgatggagcgcaccctgcccgcgccaacggattcgaccttctcatcctatagcgcgaccgccgaaaaaaccgtcccgctcaaagggaatcacggcgtacaggtgcgcggtgtactgtacggcaaccgctacacggaaaaagacaaagattcggcggctatgccggattacggctatcgcaacggttcgctgtacgcgggatacgcctatgccgacgcacgctcctccttttccctgctgccttatttcgaatacgatttccgcaaccgccacacccactaccgagcatggggtgcggatgccgactggtcgcgcacactctccccgcactggcgcattaactcacatgccggagcaaaaaagaccggatacggcggacaaagcaaaacttattttgccgatttcaaacaatacgaactcggcgcgggggcggaattttccatcacgctgaaaagcggcctgcttgtaaatttcgatgccgcacgcaaagcctatcccgaaaaatcctcttccagcaaagaatatacggctcggctgggcgcgtataggcttttttcgggcggtacttatttaaacgccgtcctgctctaccgccgcagcctgtatgacgcggcaagtttcgtcagcgataacaaacggcggcgcgacaagcaatacatcatgatggctgcggcgggttttccgcaatggaatatcaaaggcgtatatcccgaactgcgtttcaggcgaacaatcgcacacagcaacgcggtgtattaccgctaccgccaaaacgaatggctgttgggttttaaatatcggttt

SEQ ID NO: 3914 - protein, 523 aa, Neisseria gonorrhoeae
VQTCIALRDFCFYFFQTASLPKGPHPMTHRLCLLFLPLCTVCLAAPSNDAADERRRLLDEGSRQTQQYRESGWLDTEQARGEVEENDGYISIGGEIYQVGDTAEELESAIYHALNARQWHKVRQFAARYAKLPRHKPALIHLADALQKRDEGDFRAAGNSFQTALEAEPDNPRLLLEAGRFYAEDNQNKESAAAFEKVLKTDIPAETRPIVENYLSELGKRRRWHGQISLGYGYNSNVNQGNGINQCVWEIAGMCLMERTLPAPTDSTFSSYSATAEKTVPLKGNHGVQVRGVLYGNRYTEKDKDSAAMPDYGYRNGSLYAGYAYADARSSFSLLPYFEYDFRNRHTHYRAWGADADWSRTLSPHWRINSHAGAKKTGYGGQSKTYFADFKQYELGAGAEFSITLKSGLLVNFDAARKAYPEKSSSSKEYTARLGAYRLFSGGTYLNAVLLYRRSLYDAASFVSDNKRRRDKQYIMMAAAGFPQWNIKGVYPELRFRRTIAHSNAVYYRYRQNEWLLGFKYRF

SEQ ID NO: 3915 - DNA, 1443 bp, Neisseria gonorrhoeae
atggcgcattttttcaatattaattatccgacttacaaaggtaaaaacatgactgtccgtatcgaacacgatttattgggcgaccgcgagattcccgccgaagtgtattggggcatccacaccctgcgcgccattgaaaactttaaaatctccacacaaaaaatttccgacgtgccgcagtttgtccgcagtatagtgatggtgaaaaaagcaaccgcgcaggcaaacggcgaattgggtgcagtaaaacccgaaatcgccgccgccattgaaaaggcttgcgacgaagttctgctgaacaaccgctgcctcgaccaattcccgtccgacgtgtatcagggcggggcgggaacttcggtcaatatgaacaccaacgaagtcatcgccaaccttgcattggaagccttgggctatgagaaaggccgctacgacatcgtcaatccgatggatcacgtcaacgccagccaatccaccaacgatgcctatcccacgggcttccgccttgccgtgtattacagcatcggcgaattgctcgacaaactgaccgtattgaaaaacgcctttgccgccaaagccgaagcgtttaaagacgttttgaaaatgggtcgcacccagcttcaagatgccgtaccgatgacggcaggccaggaattccaatctttccaagtattgttggaagaggaaatcctcaaccttgaccgcacccgccaactgctcttggaagtcaatttgggcgcaacggcaatcggcacgggcgtgaacacgcccaaaggctacgccgaactggtggtcaaaaaactctccgaagtcagcggcttgccttgcaaactgactgaaaacctgatcgaagcgacctccgactgcggtgcatatgtgatggtacacggcgcattgaaacgcacggccgtcaaactctctaaaatctgcaacgatttgcgccttctctcttccggtccgcgcgccggtttgaaagaaatcaacctgcccgaattgcaggccggttcttccatcatgcctgccaaagtcaatcccgtgattcccgaagtcgtcaaccaagtctgcttcaaagtcatcggcaacgatacgacgattaccttcgccgccgaatccgggcaactgcaattaaacgttatggagccggtcatcgcccaatgtatgtttgaaaccatttccctcttgggcaatgccgcagtcaacctatccgacaaatgcgtcaaaggcattacggtcaaccgcgaaatctgcgagcggtatgtcttcaactccatcggtttggtcacttatctgaatccgtacatcggccaccgcaacggcgacttggtcggcaaaatctgcgcccaaaccggcaaaggcgtgcgcgaagtcgtactggagcgcggcctgttaagcgaagaagaaatcaaccgcatcctctcccccgagaacctgatgaatcctcatctg

SEQ ID NO: 3916 - protein, 481 aa, Neisseria gonorrhoeae
MAHFFNINYPTYKGKNMTVRIEHDLLGDREIPAEVYWGIHTLRAIENFKISTQKISDVPQFVRSIVMVKKATAQANGELGAVKPEIAAAIEKACDEVLLNNRCLDQFPSDVYQGGAGTSVNMNTNEVIANLALEALGYEKGRYDIVNPMDHVNASQSTNDAYPTGFRLAVYYSIGELLDKLTVLKNAFAAKAEAFKDVLKMGRTQLQDAVPMTAGQEFQSFQVLLEEEILNLDRTRQLLLEVNLGATAIGTGVNTPKGYAELVVKKLSEVSGLPCKLTENLIEATSDCGAYVMVHGALKRTAVKLSKICNDLRLLSSGPRAGLKEINLPELQAGSSIMPAKVNPVIPEVVNQVCFKVIGNDTTITFAAESGQLQLNVMEPVIAQCMFETISLLGNAAVNLSDKCVKGITVNREICERYVFNSIGLVTYLNPYIGHRNGDLVGKICAQTGKGVREVVLERGLLSEEEINRILSPENLMNPHL

SEQ ID NO: 3917 - DNA, 558 bp, Neisseria gonorrhoeae
atgaaaaaaatcatcttcgccgcgctcgcagcggcagccgtcggcactgcctccgccacctacaaagtggacgaatatcacgccaacgtccgtttcgccatcgaccacttcaacaccagcaccaacgtcggcggtttttacggtctgaccggttccgtcgagttcgatcaagcaaaacgcgacggcaaaatcgacatcaccattcccgtcgccaacctgcaaagcggttcgcaacccttcaccggccacctgaaatccgccgacatcttcgatgccgctcaatatccggacatccgcttcgtttccaccaaattcaacttcaacggcaaaaaacttgtttccgttgacggcaacctgaccatgcgcggcaaaaccgcccccgtcaaactcaaagccgaaaaattcaactgctaccaaagcccgatggcggaaaccgaagtttgcggcggcgacttcagcaccaccatcgaccgcaccaaatggggcgtggactacctcgttaacgccggtatgaccaaaaacgtccgcatcgacatccaaatcgaagctgcaaaacaa

SEQ ID NO: 3918 - protein, 186 aa, Neisseria gonorrhoeae
MKKIIFAALAAAAVGTASATYKVDEYHANVRFAIDHFNTSTNVGGFYGLTGSVEFDQAKRDGKIDITIPVANLQSGSQPFTGHLKSADIFDAAQYPDIRFVSTKFNFNGKKLVSVDGNLTMRGKTAPVKLKAEKFNCYQSPMAETEVCGGDFSTTIDRTKWGVDYLVNAGMTKNVRIDIQIEAAKQ

SEQ ID NO: 3919 - DNA, 852 bp, Neisseria gonorrhoeae
ttgaaaaaatgcgccatcggaaagatgccgcagcaggacgaacactataccggcccggatgaaattgtccatatcgtatgccgtctgaaaacgggaaacgttgttttcggtcgttactttccggactttccggcaagccccgcctgccgccaaaatatctttcggcgggttgtgctccgccatatcggcttacggttggcagggcggtttgatgaagacggcatttgtgctgattcgcatcaaggcttattgttttgcagcttcgatttggatgtcgatgcggacgtttttggtcataccggcgttaacgaggtagtccacgccccatttggtgcggtcgatggtggtgctgaagtcgccgccgcaaacttcggtttccgccatcgggctttggtagcagttgaatttttcggctttgagtttgacgggggcggttttgccgcgcatggtcaggttgccgtcaacggaaacaagttttttgccgttgaagttgaatttggtggaaacgaagcggatgtccggatattgagcggcatcgaagatgtcggcggatttcaggtggccggtgaagggttgcgaaccgctttgcaggttggcgacgggaatggtgatgtcgattttgccgtcgcgttttgcttgatcgaactcgacggaaccggtcagaccgtaaaaaccgccgacgttggtgctggtgttgaagtggtcgatggcgaaacggacgttggcgtgatattcgtccactttgtaggtggcggaggcagtgccgacggctgccgctgcgagcgcggcgaagatgatttttttcatgatgataatcctttgtgtgggccggtaaaggcgtttatcctaaca

SEQ ID NO: 3920 - protein, 284 aa, Neisseria gonorrhoeae
LKKCAIGKMPQQDEHYTGPDEIVHIVCRLKTGNVVFGRYFPDFPASPACRQNIFRRVVLRHIGLRLAGRFDEDGICADSHQGLLFCSFDLDVDADVFGHTGVNEVVHAPFGAVDGGAEVAAANFGFRHRALVAVEFFGFEFDGGGFAAHGQVAVNGNKFFAVEVEFGGNEADVRILSGIEDVGGFQVAGEGLRTALQVGDGNGDVDFAVAFCLIELDGTGQTVKTADVGAGVEVVDGETDVGVIFVHFVGGGGSADGCRCERGEDDFFHDDNPLCGPVKAFILT

SEQ ID NO: 3921 - DNA, 228 bp, Neisseria gonorrhoeae
atgggggttcatgttgcggacttggtgcggttttcgtaccaaatatctgaattctaccacaagttggacaaggtttaccttctcctgcctgtcttgctgcctgagcccttgctccatctgtttgagaacctccataatgcgtttgacgattataacgttctgtcggttttagtttggttggacaatcattatgaacccaaaccccttccgtttccgccttatcgcctt

SEQ ID NO: 3922 - protein, 76 aa, Neisseria gonorrhoeae
MGVHVADLVRFSYQISEFYHKLDKVYLLLPVLLPEPLLHLFENLHNAFDDYNVLSVLVWLDNHYEPKPLPFPPYRL

SEQ ID NO: 3923 - DNA, 99 bp, Neisseria gonorrhoeae
cgaaaagtcttccaaatgacggctgattgcctcttcaacagtcggataccaatctatgaaaatgccgtctgaacggcaaaacgtgcgttcagacggcat

SEQ ID NO: 3924 - protein, 23 aa, Neisseria gonorrhoeae
RKVFQMTADCLFNSRIPIYENAV

SEQ ID NO: 3925 - DNA, 783 bp, Neisseria gonorrhoeae
atgggttttctgcaaggcaaaaaaattctgattaccggcatgatttccgagcgttccatcgcttacggcatcgccaaagcctgccgcgaacagggcgcggaactggcgtttacctacgttgtggacaaactggaagagcgcgtccgcaaaatggcggcggaattagattccgaactcgtattccgctgcgatgtcgccagcgacgacgaaatcaaccaagtgttcgccgacttaggcaaacattgggatggcttggacggtttggtgcattccatcggcttcgcgccgaaagaagccttgagcggcgacttcctcgacagcatcagccgcgaagcgttcaacaccgcacacgaaatttccgcatacagcctgcccgcattggcaaaagccgcccgtccgatgatgcgcggcaggaactccgccatcgtcgcccttagctacttgggcgcggtacgcgcgattccgaattacaacgtgatgggtatggcaaaagccagccttgaggcaggcatccgctttaccgccgcctgtctgggtaaagagggcatccgctgcaacggcatttccgccggcccgatcaaaacgctcgccgcctccggcatcgccgatttcggcaaactcttgggacacgtcgccgcccacaacccgctgcgccgcaacgttaccatcgaagaagtcgggaatactgccgccttcctgctgtccgacctgtcgtccggcattaccggcgaaatcacttatgttgacggcggttacagcattaatgccttgagcaccgaggga

SEQ ID NO: 3926 - protein, 261 aa, Neisseria gonorrhoeae
MGFLQGKKILITGMISERSIAYGIAKACREQGAELAFTYVVDKLEERVRKMAAELDSELVFRCDVASDDEINQVFADLGKHWDGLDGLVHSIGFAPKEALSGDFLDSISREAFNTAHEISAYSLPALAKAARPMMRGRNSAIVALSYLGAVRAIPNYNVMGMAKASLEAGIRFTAACLGKEGIRCNGISAGPIKTLAASGIADFGKLLGHVAAHNPLRRNVTIEEVGNTAAFLLSDLSSGITGEITYVDGGYSINALSTEG

SEQ ID NO: 3927 - DNA, 171 bp, Neisseria gonorrhoeae
gtgttatcttcatatttcgagggtaacatatctgctaatctggtacagacccaaaaacaaagcacggataacaccgcgctttttcatccgccctgttccgcccgcccgttcgtcaaccgcctgcaaacccaccgtttaccggcaggaaatgccataaatccccgcctatgt

SEQ ID NO: 3928 - protein, 57 aa, Neisseria gonorrhoeae
VLSSYFEGNISANLVQTQKQSTDNTALFHPPCSARPFVNRLQTHRLPAGNAINPRLC

SEQ ID NO: 3929 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttgccaaccatcgtttggccttggctgccgatgaggttttcgagggccccgccgggccgggcggaagctgtttcggcgggcggcgtaaaggcagacgcggtcgcggcgcggcaggaaaagcggttgtcttcggcattccgaaacgcaacgggcgggcctataccgttgccgcagacgatgccgagcctgaaacgttgctccctgccgtcaaaaaaaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaacctttcccgccgttgttgagggaatgcgaatttcgacttaacttcggcacaccgtcccggcagctaaaaatcctgcgggatcggtgtggaatt

SEQ ID NO: 3930 - protein, 217 aa, Neisseria gonorrhoeae
MKITHCKLKKEVQKEPLRSFVPEVTARSAADILGIHPDSAALFYRKIRTVANHRLALAADEVFEGPAGPGGSCFGGRRKGRRGRGAAGKAVVFGIPKRNGRAYTVAADDAEPETLLPAVKKKIMPDGIVYADSPGSRGKSDAGGFTRCRINRSKEFADRRNHINGIGNFWNQAKRALRKYNGIDRKPFPPLLRECEFRLNFGTPSRQLKILRDRCGI

SEQ ID NO: 3931 - DNA, 147 bp, Neisseria gonorrhoeae
ttgtcggcggcagatgaaaacgcgctcaaaatcaacagcggcattaaggcaagttttttgttcatgaaaacgctctcttttttaagtattggggaattaaagataaaacaaacaaacttatcggatatttcgggcggcaattatatt

SEQ ID NO: 3932 - protein, 49 aa, Neisseria gonorrhoeae
LSAADENALKINSGIKASFLFMKTLSFLSIGELKIKQTNLSDISGGNYI

SEQ ID NO: 3933 - DNA, 273 bp, Neisseria gonorrhoeae
ttgagcgcgttttcatctgccgccgacaatactccgcagcatggcgaactcggacaggttcatgtccgcgccgatgccaagcgcgtcaaagccgcgcattcttactccatcgccagcgatggcgacttgcgcgaccgcgtaaatttgggcgtattgggtaaagccaacgcgtttaccgcgccgattaccgtcgtcaactacgacgaacaagccttcaacaataccgaggcgcgtactttagtggatgccgtagccaaaaaagacgcttccgtt

SEQ ID NO: 3934 - protein, 91 aa, Neisseria gonorrhoeae
LSAFSSAADNTPQHGELGQVHVRADAKRVKAAHSYSIASDGDLRDRVNLGVLGKANAFTAPITVVNYDEQAFNNTEARTLVDAVAKKDASV

SEQ ID NO: 3935 - DNA, 96 bp, Neisseria gonorrhoeae
ttggcaggaatgtatggcacgcaaggcacggcgagcgtgcaagtcggcttcgcacaactgattaaaggcgcgtccaccgccgtaaacggcataccc

SEQ ID NO: 3936 - protein, 32 aa, Neisseria gonorrhoeae
LAGMYGTQGTASVQVGFAQLIKGASTAVNGIP

SEQ ID NO: 3937 - DNA, 309 bp, Neisseria gonorrhoeae
ttgttgccgaaccgggccaaaccgattttgcggttgccttcgtcggcggcttttttggtttcgatgttgacggaaccggataccgcgccttcagggtatgccgtttacggcggtggacgcgcctttaatcagttgtgcgaagccgacttgcacgctcgccgtgccttgcgtgccatacattcctgccaagccgtttacgctgaattggcgcgcatcaagctgataaccacggaaatacagaccggtcagcgtgttgctttcgccgccaaactctcaaacggaagcgtcttttttggctacggcatccac

SEQ ID NO: 3938 - protein, 103 aa, Neisseria gonorrhoeae
LLPNRAKPILRLPSSAAFLVSMLTEPDTAPSGYAVYGGGRAFNQLCEADLHARRALRAIHSCQAVYAELARIKLITTEIQTGQRVAFAAKLSNGSVFFGYGIH

SEQ ID NO: 3939 - DNA, 381 bp, Neisseria gonorrhoeae
ttggcccggttcggcaacaaccgcgcccaaggtacgttcgacttagggcaacgcttcggcgaaaacaaagcattcggcgtgcgtgccaacggcaaactgcgccacggcgacaccccgcgccacggttacagagaagacaacaaagaatttgccttaaatgccgattatcgcggcgaaaaactgcgcgtgacgttcgactccatctacgcgaaacgcaaaatcaacggcggccgcgcgcgtatgcaggatatccaaaacgccggcggacgcttgttcgacgcgcccgacggcaaaatcaacctgctgccttcttggaactggcaaaataccgtcggcgaaaccaatatgctgacgtttgaatgggatgcgtttgacaatacc

SEQ ID NO: 3940 - protein, 127 aa, Neisseria gonorrhoeae
LARFGNNRAQGTFDLGQRFGENKAFGVRANGKLRHGDTPRHGYREDNKEFALNADYRGEKLRVTFDSIYAKRKINGGRARMQDIQNAGGRLFDAPDGKINLLPSWNWQNTVGETNMLTFEWDAFDNT

SEQ ID NO: 3941 - DNA, 351 bp, Neisseria gonorrhoeae
gtggtattggttggcagccatgcaggttttggtttggctgctcgcaccgcttgtaccgcaaacggttggggaaatcagcgtaccgtaataacgcgctttgttgtagccgataccgccggtaatttaggtattgtcaaacgcatcccattcaaacgtcagcatattggtttcgccgacggtattttgccagttccaagaaggcagcaggttgattttgccgtcgggcgcgtcgaacaagcgtccgccggcgttttggatatcctgcatacgcgcgcggccgccgttgattttgcgtttcgcgtagatggagtcgaacgtcacgcgcagtttttcgccgcgataatcggcatt

SEQ ID NO: 3942 - protein, 117 aa, Neisseria gonorrhoeae
VVLVGSHAGFGLAARTACTANGWGNQRTVITRFVVADTAGNLGIVKRIPFKRQHIGFADGILPVPRRQQVDFAVGRVEQASAGVLDILHTRAAAVDFAFRVDGVERHAQFFAAIIGI

SEQ ID NO: 3943 - DNA, 1191 bp, Neisseria gonorrhoeae
atggctgccaaccaataccacaccggcacggcgcgcctgaccgaccaatatttccgtactttgagtatgaacctgaccgcacgcggcgaatttgaaaccggcccggtcacgcataactggagtacggctttcgaccgcgttatccgccagcggaaaaccataaacggcagcgggaacggcaacagcaagatagaagtgaaggcaaacgaaaatattgcgaatcaattggcatcgttcaaagccgactatcccaattcttgggcgaactcggccaacttggatgccaatatcaaagtcaacagcttggctttgtccgatactttgggcttcgttgataacaaataccccctgactttgggcggacgtttccaagcggttgaatacactgataagaagaaatcacagagcggcgatgccaaacgtttcagcccgatgctgatggcggcgtgggtgccgcaacctgatttggtcgtgtgcggcaactatatggaagacttggagcgtgccgatatcaaaaccgatgattccggcgaaacgacaatggcgaagccgcgcgtcagccgccagtttgaaatcggcgtgcgtaaaaactggggcgattttgtaaccacgttgaacgcgttccaaatcaaacgcccgggctactggcgcggcaataccaaaaaaggtactgattttgcagcatataaagcagcaggaggcgcagccggcgacgagcaaggtatggaacgcaatcgcggtattgagttcaatgcctatgccaacctgttgaacaaaaccctgcgcccgactttcggcgtgatgtatctgcaatcgtccgtgaagaattatccgaatgcgcgcgatatgctggttaacggcgtacaagtcgccaacccgcgcgtgattgtcaaaacaggcgttgaacgggatacaccgtttgccaaaggtttgagcttgaacggcaatgtttcgtatttcggcaagtcttatcaagacacgcaaaaacaatacgccttcccgtcctataccttggttgacgtaggcgcgcgctacaaaaccaagctgggcaaaaacaccctgaccgtcagcagctcggtagaaaacctgttcaacaaaaactactggcaggtacagcgcggacaatttgaccgtagtttcgccgtcgtcggtctgccgcgtacttactggctgaaggcggaattggatttc

SEQ ID NO: 3944 - protein, 397 aa, Neisseria gonorrhoeae
MAANQYHTGTARLTDQYFRTLSMNLTARGEFETGPVTHNWSTAFDRVIRQRKTINGSGNGNSKIEVKANENIANQLASFKADYPNSWANSANLDANIKVNSLALSDTLGFVDNKYPLTLGGRFQAVEYTDKKKSQSGDAKRFSPMLMAAWVPQPDLVVCGNYMEDLERADIKTDDSGETTMAKPRVSRQFEIGVRKNWGDFVTTLNAFQIKRPGYWRGNTKKGTDFAAYKAAGGAAGDEQGMERNRGIEFNAYANLLNKTLRPTFGVMYLQSSVKNYPNARDMLVNGVQVANPRVIVKTGVERDTPFAKGLSLNGNVSYFGKSYQDTQKQYAFPSYTLVDVGARYKTKLGKNTLTVSSSVENLFNKNYWQVQRGQFDRSFAVVGLPRTYWLKAELDF

SEQ ID NO: 3945 - DNA, 1815 bp, Neisseria gonorrhoeae
gtgaaaccgctgcgcagactgacaaacctccttgccgcctgcgccgtagcggcggtcgcactcatacagcccgccctcgcggcggacttggcgcaagacccgttcattaccgataacacccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcggcaatccaaggcaatcttggttacaccgtccgcttttccggacacggacacgaagaacacgcccccttcgacaaccacgccgccgacagcgcaagcgaagaaaaaggcaacgttgacgacggctttaccgtgtaccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatattcgacaactacaacaacctcggcagcaatttctccgaccgcgccgatgaagccaacagaaaaatgttcgagcacaatgccaagctcgaccgctggggcaacagcatggagtttgtcaacggcgtcgccgccggcgcgctcaacccctttatcagcgcgggcgaagccttgggcataggcgacatactgtacggaacgcgctatgccatagacaaagccgcgatgcgcaacatcgcccccttacccgccgagggcaaattcgccgccatcggcggcttgggcagcgcggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagtggggatttttctaaatcctacacctgctccttccacggcagcaccttggtcaaaacggcagacggctacaaagccattgcccatattcaagccggagaccgcgtcctttccaaggacgaggcaagcggagaaacgggatacaaacccgttaccgcccgatacggcaatccgtatcaagaaaccgtttacattgaagtttcagacggcatcggcaacagccaaaccctgatttccaaccgcatccacccgttttattcggacggcaaatggattaaggcggaagatttaaaagcgggaagccggctgttatccgaaagcggcaaaacccaaaccgtccgcaacatcgttgtcaaaccaaaaccgctcaaagcctacaatctgaccgttgccgattggcatacctactttgtcaaaggcgataaggcggaaacggaaggggtttgggttcataatgattgtccaaccaaactaaaaccgacagaacgttataatcgtcaaacgcattatggaggttctcaaacagatggagcaagggctcaggcagcaagacaggcaggagaaggtaaaccttgtccaacttgtggtagaattcagatatttggtacgaaaaccgcaccaagtccgcaacatgaacccccattagtaaaacattactatgaacatggtggtcactctatgagcaatgctgatcgagcgaaacatgccagggaaagcataaaaggaactcaatgtttaacatgtcaaaggaaagagggtgcgatgatgtcaagatattcgagagaacaggctaaaaagcatggacta

SEQ ID NO: 3946 - protein, 605 aa, Neisseria gonorrhoeae
VKPLRRLTNLLAACAVAAVALIQPALAADLAQDPFITDNTQRQHYEPGGKYHLFGDPRGSVSDRTGKINVIQDYTHQMGNLLIQQAAIQGNLGYTVRFSGHGHEEHAPFDNHAADSASEEKGNVDDGFTVYRLNWEGHEHHPADAYDGPKGGNYPKPTGARDEYTYHVNGTARSIKLNPTDTRSIRQRIFDNYNNLGSNFSDRADEANRKMFEHNAKLDRWGNSMEFVNGVAAGALNPFISAGEALGIGDILYGTRYAIDKAAMRNIAPLPAEGKFAAIGGLGSAAGFEKNTREAVDRWIQENPNAAETVEALVNVLPFAKVKNLTKAAKPGKAAVSGDFSKSYTCSFHGSTLVKTADGYKAIAHIQAGDRVLSKDEASGETGYKPVTARYGNPYQETVYIEVSDGIGNSQTLISNRIHPFYSDGKWIKAEDLKAGSRLLSESGKTQTVRNIVVKPKPLKAYNLTVADWHTYFVKGDKAETEGVWVHNDCPTKLKPTERYNRQTHYGGSQTDGARAQAARQAGEGKPCPTCGRIQIFGTKTAPSPQHEPPLVKHYYEHGGHSMSNADRAKHARESIKGTQCLTCQRKEGAMMSRYSREQAKKHGL

SEQ ID NO: 3947 - DNA, 1560 bp, Neisseria gonorrhoeae
ttgtttgaagtgatgaaaaaacctttgatttcagttgcggcagtattgctcggcgttgctttgggtacaccttattatttgggtgtcaaagcagaagaaagtctgacgcagcagcaaaaaatattgcagaaaacgggctttttgaccgtcgaatcgcaccagtatgatcgaggctggtttacctctacggaaacgacggtcatccgtctgaaacccgagttgctgcataatgcgcagaaatacctgccggataacttgaaaatagtgttggaacagccggttacgctggtaaaccatatcacgcacggccctttcgccggcggattcggcacgcaggcgcacattgaaaccgagttcaaatacgcgcctgaaacggaaaaagttttggaacgcttttttgggaaacaagttccggtttcccttgccaataccgtttatttcaacggcagcggtaaaatggaagtcagtgttcccgctttcgattatgaagaactgtcgggcatcaggctgcactgggaaggcctgacgggggaaacggtttatcaaaaaggtttcaaaagctaccgcaacagctatgatgcgcccttgttcaaaatcaagctggcagacaaaggcgatgccgcgtttgaaaaagcgcatttcgattcggaaacttcagacggcatcaatccgcttgctttgggcagcagcaatctgactttggaaaaattttcgctcgaatggaaagagggtgtcgattacaacgtcaaattgaacgaactggtcaacctcgttaccgatttgcagatcggcgcgtttatcaatcccaacggcagcatcgcaccttccaaaatcgaagtcggcaagctggctttttcaaccaagaccggggaatcgggcgcgtttatcgacagcgaagggcggttccgtttcgatacgttggtgtacggcgatgaaaaatacggcccgctggacatccatatcgctgccgaacacctcgatgcttctgccttaaccgtattgaaacgcaagtttgcacaaatttctgccaaaaaaatgactgaggaacaaatccgcaatgatttgattgcggcagtcaaaggcgatgcttccggattatttacccatgacccggtactaaatatcaaaattttccgtttcaccctgcctcagggaaaaattgatgtgggcggaaaaatcatgtttaaaggcatgaagaaggaagatttgaaccaattgggactgatgttaaagaaaaccgaggcaaacatcagaatgagtattcctcaaaaaatgttggaagatttggcggtaagtcaggctggaaatattttcagtgtaaatgccgaagatgaggcggaagccagagcaagcattgccgatattaatgaaacattgcgcctgatggtggacagtacggtccaaagtatggcaagggaaaaatatcttactttagacggtaatcagattgatacggtcatttcccttaaaaacaacgccctgaagttaaacgggaaaacgctgcaaaatgaacccgatcctgattttgacgagggagatatggtttccggccagccgcat

SEQ ID NO: 3948 - protein, 520 aa, Neisseria gonorrhoeae
LFEVMKKPLISVAAVLLGVALGTPYYLGVKAEESLTQQQKILQKTGFLTVESHQYDRGWFTSTETTVIRLKPELLHNAQKYLPDNLKIVLEQPVTLVNHITHGPFAGGFGTQAHIETEFKYAPETEKVLERFFGKQVPVSLANTVYFNGSGKMEVSVPAFDYEELSGIRLHWEGLTGETVYQKGFKSYRNSYDAPLFKIKLADKGDAAFEKAHFDSETSDGINPLALGSSNLTLEKFSLEWKEGVDYNVKLNELVNLVTDLQIGAFINPNGSIAPSKIEVGKLAFSTKTGESGAFIDSEGRFRFDTLVYGDEKYGPLDIHIAAEHLDASALTVLKRKFAQISAKKMTEEQIRNDLIAAVKGDASGLFTHDPVLNIKIFRFTLPQGKIDVGGKIMFKGMKKEDLNQLGLMLKKTEANIRMSIPQKMLEDLAVSQAGNIFSVNAEDEAEARASIADINETLRLMVDSTVQSMAREKYLTLDGNQIDTVISLKNNALKLNGKTLQNEPDPDFDEGDMVSGQPH

SEQ ID NO: 3949 - DNA, 93 bp, Neisseria gonorrhoeae
atggaattcggacgggataggggaactattgaaatccagttgaaatctgttattggaaagcatggaggaaaaataaaaggctgtattttaata

SEQ ID NO: 3950 - protein, 31 aa, Neisseria gonorrhoeae
MEFGRDRGTIEIQLKSVIGKHGGKIKGCILI

SEQ ID NO: 3951 - DNA, 1782 bp, Neisseria gonorrhoeae
atggctttagttgaattgaaagtgcccgacattggcggacacgaaaatgtagatattatcgcggttgaagtgaacgttggcgacaccatcgccgttgacgacaccctgattaccttggaaaccgacaaagcgacgatggacgtgcctgccgaagttgcgggcgtgatcaaagaagtgaaagtcaaagtcggcgacaaaatctccgaaggcggtttgattgtcgtcgtcgaagccgaaggtgcggctgccgcccctaaagccgaagcggctgccgccccggcgcaagaagcacccaaagctgccgctcctgctccgcaagccgcgcaattcggcggtgctgccgatgccgagtacgacgtggtcgtattgggcggcggtcccggcggttactccgctgcatttgccgctgccgatgaaggcttgaaagtcgccatcgtcgagcgttacaaaactttgggcggcgtttgcctgaacgtcggctgtatcccttccaaagccttgttgcacaatgccgccgttatcgacgaagtgcgccacttggctgccaacggtatcaaataccccaagccggaactcgacatcgatatgcttcgcgcctacaaagacggcgtggtttcccgcctcacgggtggtttggcaggtatggcgaaaagccgtaaagtggacgttatccaaggcgacgggcaattcttggatcctcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcactggcactgaaagaagtaccgggcaaactgctgattatcggcggcggcattatcggcctcgagatgggtacggtttacagcacgctgggttctcgcctggatgtggttgaaatgatggacggcctgatgcaaggcgcagaccgcgacttggttaaagtatggcaaaaacaaaacgaataccgttttgacaacattatggtcaacaccaaaaccgttgcagtcgagccgaaagaagacggcgtttacgttacctttgaaggtgcaaatgcacctaaagagccgcaacgttacgatgccgtactggtcgcggcaggccgtgcgcctaacggcaaactcatcagcgcagaaaaagccggtgttgccgttaccgatcgtggcttcatcgaagttgacaaacaaatgcgcaccaacgtaccgcacatctacgctatcggcgatatcgtcggtcaaccgatgttggcacacaaagccgttcacgaaggccacgttgccgctgaaaactgtgccggccacaaagcctacttcgacgcacgcgttattcccggcgttgcctacacttcccccgaagtggcatgggtcggtgaaaccgaattgtctgccaaagcatcaggccgcaaaattaccaaagccaacttcccatgggcggcttccggtcgtgcgattgccaacggttgcgacaacggctttaccaagctgattttcgatgccgaaaccggccgcatcatcggcggcggcattgtcggtccgaacggtggcgacatgatcggcgaagtctgccttgccatcgaaatgggctgcgacgcggcagacatcggcaaaaccatccacccgcacccgaccttgggcgaatccatcggtatggctgcggaagtggctttgggtgtatgtaccgacctgcctcctcaaaagaaaaaa

SEQ ID NO: 3952 - protein, 594 aa, Neisseria gonorrhoeae
MALVELKVPDIGGHENVDIIAVEVNVGDTIAVDDTLITLETDKATMDVPAEVAGVIKEVKVKVGDKISEGGLIVVVEAEGAAAAPKAEAAAAPAQEAPKAAAPAPQAAQFGGAADAEYDVVVLGGGPGGYSAAFAAADEGLKVAIVERYKTLGGVCLNVGCIPSKALLHNAAVIDEVRHLAANGIKYPKPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGVCTDLPPQKKK

SEQ ID NO: 3953 - DNA, 288 bp, Neisseria gonorrhoeae
gtgaagaatgcagtttacgcccatcaaattgaaacagatctatatgacggatgttatatatctacgacaacagacaaggaaattgccaagaaatttgcaacaagctccggcatcgaaaatggctatatatatgttttaaatagagatttgtttggtcaatattctatttttgaatatgaggttgaacatccagaaaacccagatgagaaggaagtaacaatcagagctgaagattgtggctgtattcctgaagaagtgattattgctaaagagttgatagaaattaac

SEQ ID NO: 3954 - protein, 96 aa, Neisseria gonorrhoeae
VKNAVYAHQIETDLYDGCYISTTTDKEIAKKFATSSGIENGYIYVLNRDLFGQYSIFEYEVEHPENPDEKEVTIRAEDCGCIPEEVIIAKELIEIN

SEQ ID NO: 3955 - DNA, 102 bp, Neisseria gonorrhoeae
gtgatggtgttaaattcaaactttaaattaataacttatgggaaatttcttatttatatagaggcattagttgccaacaagatgagcaaaataatggacagt

SEQ ID NO: 3956 - protein, 34 aa, Neisseria gonorrhoeae
VMVLNSNFKLITYGKFLIYIEALVANKMSKIMDS

SEQ ID NO: 3957 - DNA, 1587 bp, Neisseria gonorrhoeae
atgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattttgaccgttgaaaccggtgccgccgctgccgaagccgccccggctgctgccgccgaagcacaacctgcacccgctgccgcaggcggtgcaaccgttcaagtagccgttcccgatatcggcggccataccgatgtagatgtaatcgccgttgaaatcaaagttggcgacaccgttgccgaagacgacacgctgattactttggaaaccgataaagcgacaatggacgtaccttgtaccgctgccggtgtcgttaaagccgtattcttaaaagtcggcgacaaagtgtccgaaggctctgccattatcgaagtggaaaccgccggctctgccgcagcagctcctgcgcctgccgctcaagctgccgcacccgccgccgtgcctacatctgccgcacccgccgccgtgcctacatctgcctcgcctgccgctgccaaaatcgatgaagccgctttcgccaaagcacacgccggtccttccgcacgcaaactggcgcgcgaattgggcgtggatttgggccaagtcaaaggtagcggcttgaaaggccgtatcatgggagacgacatcaaagcctttgtgaaatccgtaatgcagggcggcgcggcaaaacctgccgcagccggcgcatctttgggcggcggtctggacttgctgccgtggcctaaagtggacttctccaaattcggcaatgtcgaagttaaagaattgtcccgcattaagaaaatctccggtcaaaacctgtcccgcaactgggtggtgattcctcacgttaccgtacacgaagaagcggatatgaccgaactggaagaattccgcaaacagctgaacaaagaatgggaacgcgaaggcgtgaaactgtccccgttggcgttcatcatcaaagcctccgtttccgcgctgaaagccttccccgaattcaacgcttctttggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgcgaaggcaagctcaaaccgcaagaaatgcaaggcgcgtgctttaccatttccagcttgggcggcatcggcggcacaggtttcacgccgattgtgaacgctcccgaagtcgctatcttgggcgtgtgcaaatcccaaatcaaaccggtttggaacggcaaagagtttgccccgcgcctgatgtgcccgttgagcctgtccttcgaccaccgcgtcatcgacggtgccgccggtatgcgcttcaccgtattcctggcgaacctgttgaaagacttccgccgcattacctta

SEQ ID NO: 3958 - protein, 529 aa, Neisseria gonorrhoeae
MSIVEIKVPDIGGHENVDIIAVEVKAGDTIAVDDTLITLETDKATMDVPADAAGVVKEVKVKVGDKISEGGVILTVETGAAAAEAAPAAAAEAQPAPAAAGGATVQVAVPDIGGHTDVDVIAVEIKVGDTVAEDDTLITLETDKATMDVPCTAAGVVKAVFLKVGDKVSEGSAIIEVETAGSAAAAPAPAAQAAAPAAVPTSAAPAAVPTSASPAAAKIDEAAFAKAHAGPSARKLARELGVDLGQVKGSGLKGRIMGDDIKAFVKSVMQGGAAKPAAAGASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLANLLKDFRRITL

SEQ ID NO: 3959 - DNA, 2661 bp, Neisseria gonorrhoeae
atgtccacccaattacacgatgttgaccctatcgaaacccaagagtggctggacgcgttaagctccgtcctcgaatatgaaggcggcgaacgcgcgcaatacctcttggaaaacctgctcaaatactgccgcgacaaaggcgtacgtatgccccacggcacgaccaccccgtatttgaataccgtttcggttgaaaacgaaaaaggcattccgggcgaccaaaacatcgaacaccgcattcgcgcattcgtgcgctggaacgccgccgccatcgtattgcgcgccggcaagaaagatttggaactgggtgggcacatcgcatctttccaatctgccgccaccatgtacgaagtcggtttcaaccacttctggaaagccaaaggtgaaggtgaagaaggcgatttggtcttcttccaaggtcacgttgccccgggcatctatgcacgcgcattcgtcgaaggccgtctgaccgaagaccagctgaacaacttccgccaagaagtggacggacacggtctgccttcctatccacacccccacctcttgcccgacttctggcagttcccgaccgtatccatgggcttgggccccatcatggcgatttatcaggcgcgtttcctgaaatacttggaatcacgcggcttggcaaaaaccaaaggccgtaaagtatggtgtttctgcggcgacggcgaaatggacgaacccgaatcccaaggtgcaatcgcgctggctgcacgcgaaggcttggacaacctgattttcgtcatcaactgcaacctgcaacgcttggacggtccggtgcgcggcaacggcaaaatcatccaagaattggaaggcaactttgccggtgccggctggaatgtcgtcaaagtcatttggggccgccgttgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgatcctcaaaaagtgtacaacgcctacgaccgcgcagcgaaccatgccgacggcaaacctaccgttatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcggcattcgacgcacaactcaaatccagcggtgaacgcgagttctcgaccacgatggcattcgtccgcatcctgtccactttgctgaaagacaaaaaaatcggcaaacgcgtcgtacctatcgttcccgacgaaagccgtactttcggcatggaaggtatgttccgccaatacggtatttggaatcccaaaggccaacaatacacgcctcaagacaaagaccaactgatgttctataaagaatccgttgacggtcaaatcttgcaagaaggtattaacgaaccgggcgcgatggccgactggattgcggctgcgaccagctacgccaacagcgacttcgcgatgattccgttctacatctactactccatgttcggtttccaacgtatcggcgacttggcttgggcggcgggcgatatgcacgcgcgcggcttcctgctgggcggtactgccggccgtacgacgctgaacggcgaaggtctgcaacacgaagacggccacagccacatccaggccgacctgattccgaactgcgtatcttatgacccgaccttccaatacgaagtggccgtcatcgtacaagacggtctgcgccgtatgtatgccaataatgaagacgtgttctactacatcaccctgatgaacgagaactacacccatcccgatatgccggaaggtgcggaacaagacatcctcaaaggtatgtacctgctgaaagccggcggcaaaggcgacaagaaagtccaattgatgggttccggtacgattctgcaagaagtgattgccggtgccgagctgctgaaagccgacttcggcgtggaagcggacatctggtcttgcccgtccttcaacctgctgcaccgcgacgccatcgaaaccgaacgcttcaaccgcctgcatccgctggaagctgaaaaagtgcctttcgttacttcccaactgcaaggtcatgacggtccggttatcgccgctaccgactatatccgcagctatgccgaccgtatccgcgcgtacatcccgaacgactaccatgtcttgggcactgacggtttcggccgttccgacagccgcgccaacctgcgccgcttctttgaagtggaccgctacaacgttgccgtggcagcattggccgcattggcggaacaaggcaaagtcagcaaagaaaccgttcaacaagccattgagaaatacggcatcaaagccgattcagcccctagctggaaacgc

SEQ ID NO: 3960 - protein, 887 aa, Neisseria gonorrhoeae
MSTQLHDVDPIETQEWLDALSSVLEYEGGERAQYLLENLLKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRQEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKALVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSDFAMIPFYIYYSMFGFQRIGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAIETERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYGIKADSAPSWKR

SEQ ID NO: 3961 - DNA, 1074 bp, Neisseria gonorrhoeae
tcgcgccaatgccttcaaacattctttgaccaacgccgggcctttgtatatcaatccgctgtacacttggacggcggtcgtgcccaagcggattttctctgccgcgtccccgccttccataatgccgcctacgccgataatcggcaatgcgccgtctatgtgttccgccagttttttcagcacccggttgcttttttcgcgcacgggaaaaccgctcaaaccgccctgctcgcctgcgagcggatggctgccgaggcttgatttgtcgatggtggtgttggtagcgatgatgccgtccatttcgacggatttgacgacgcgggcgatgtcttcgatttgtgcttcatccaaatcgggggcgattttgacggctagcgggatatatttgccgtgggcggcggcaagctgcgcctgtttgtttttcagggcttcgagcaatgcgcccaattcgccgccgccttgcagcgcgcggaggtttttggtgttgggcgaggaaatgttgacggtaatgtagcttgcgtgcgcgtaggctttttcgaggcagattaaataatcatcggcggcgttttggatgggcgtaaccgcgtttttgccgatgttgatgcccaatacgccttgatatttgcttttttcaatattgcgtatcatcgcgtcgatgccgtggttgttaaaacccattcggttgatgatgccttggtgttcgggaacgcggaagaggcgcggctgcgggttgccgggctgcgggttgcgcgtaaccgtgccgatttcgaggaagccgaaaccgagcgcgcccaaagcgtcgatgtattcaccgtttttgtcgagacctgcggcaagcccgacagggttgggcaaatccatacccatcagttttataggtttggtacggttgtcggttacgggaatcaggcccaatttataaaccgtgttgagcgcgtcgagcgtgaagtggtgggctttttcggcatcgagtgcaaacaggatgcggcgggcaagtggatacatgacagggctttctgcttcagatggaaatgccgccattttaaccgaaatcccgccaaacatacggcacac

SEQ ID NO: 3962 - protein, 86 aa, Neisseria gonorrhoeae
SRQCLQTFFDQRRAFVYQSAVHLDGGRAQADFLCRVPAFHNAAYADNRQCAVYVFRQFFQHPVAFFAHGKTAQTALLACERMAAEA

SEQ ID NO: 3963 - DNA, 1059 bp, Neisseria gonorrhoeae
atgccgtctgaaaggcggcggtgcggcataaaagtaccgccgcctttctgtattgattcgggcgcggaaaaagacatatgcctgccgcccgcccgattccgaaacgccggcatccggcaagcctgcggcgcggctgacgggcgggcgtttgtatggcacaatagcacgtttgttccaaccgccatgccgtctgaacaataccggcaagcgtcccgaaatatctcgaaccaaggaaacattatgtctttgcaaaacattatcgaaaccgcctttgaaaaccgcgcggacatcactccgaccaccgttgcccccgaagtcaaagaagccgtgttggaaaccatccgccaactcgattcaggcaaactgcgcgtcgccgaacgcttgggcgtgggcgagtggaaagtcaacgaatgggcgaaaaaagccgtgttgctgtccttccgcatccaagacaacgaagtcctcaacgacggcgtgaacaaatacttcgacaaagtgccgaccaaatttgccgactggtctgaagacgagttcaaaaacgcaggcttccgcgcagttccgggtgcggttgcccgacgcggcagctttgttgccaaaaacgccgtgctgatgccgtcttacgtcaacatcggcgcatacgtcgacgaaggcgcgatggtcgatacttgggcgaccgtcggctcttgcgcgcaaatcggcaaaaacgtccacttgagcggcggtgtcggcatcggcggcgtactcgaacccctgcaggccgcacccaccatcattgaagacaactgcttcatcggcgcgcgttccgaaatcgtcgaaggcgcgattgtcgaagaaggcagcgtgatttcgatgggcgtgttcatcggtcaatccaccaaaatcttcgaccgtaccacaggcgaaatctaccaaggccgcgtaccggcaggttcggtcgtcgtgtccggcagcctgccttccaaagacggcagccacagcctttactgtgccgtcatcgtcaaacgcgtggacgcgcaaacccgcgccaaaaccagcgtgaacgaactcttgcgcggcatc

SEQ ID NO: 3964 - protein, 353 aa, Neisseria gonorrhoeae
MPSERRRCGIKVPPPFCIDSGAEKDICLPPARFRNAGIRQACGAADGRAFVWHNSTFVPTAMPSEQYRQASRNISNQGNIMSLQNIIETAFENRADITPTTVAPEVKEAVLETIRQLDSGKLRVAERLGVGEWKVNEWAKKAVLLSFRIQDNEVLNDGVNKYFDKVPTKFADWSEDEFKNAGFRAVPGAVARRGSFVAKNAVLMPSYVNIGAYVDEGAMVDTWATVGSCAQIGKNVHLSGGVGIGGVLEPLQAAPTIIEDNCFIGARSEIVEGAIVEEGSVISMGVFIGQSTKIFDRTTGEIYQGRVPAGSVVVSGSLPSKDGSHSLYCAVIVKRVDAQTRAKTSVNELLRGI

SEQ ID NO: 3965 - DNA, 102 bp, Neisseria gonorrhoeae
ttgtttcggtttgatttagaaattttcgtttttgcttattatttttcacaaacgaaaataaaggggttggctacaccctcccttccgattaaacactcaaca

SEQ ID NO: 3966 - protein, 34 aa, Neisseria gonorrhoeae
LFRFDLEIFVFAYYFSQTKIKGLATPSLPIKHST

SEQ ID NO: 3967 - DNA, 168 bp, Neisseria gonorrhoeae
atgttttcaaaaaattataaaagtcttggaagcaagggaaaacttgaaaaaaaatgttcggtctgctccgcacgaaatcctatcagcaatcgggtctgctggcaaataaccatgcttttaaaagcaggttttatactgaagttggcgtttggtaaggacaggtctttt

SEQ ID NO: 3968 - protein, 56 aa, Neisseria gonorrhoeae
MFSKNYKSLGSKGKLEKKCSVCSARNPISNRVCWQITMLLKAGFILKLAFGKDRSF

SEQ ID NO: 3969 - DNA, 102 bp, Neisseria gonorrhoeae
gtgggatatcgaatcgttatgtctctgtcggcaattttcctattgcagaaaatctatacacaagctttgtggacaaccgtgttgataagccacggcttgtgt

SEQ ID NO: 3970 - protein, 34 aa, Neisseria gonorrhoeae
VGYRIVMSLSAIFLLQKIYTQALWTTVLISHGLC

SEQ ID NO: 3971 - DNA, 1797 bp, Neisseria gonorrhoeae
ttggaggttggtgcaaaacctgcttttttcgcgttacaatctgcacccgatttacttttgaatctgcctgtttggaaaaatacttttatgaaagccagccaattctttatctctactttaaaagaagcccctgccgaagccgcgtttgccagccacaagctgatgattcgcgccggtctgattaaagccaacgcgtccggtctttatacttggatgccgatggggctgcgcgtgttacgcaaagtcgaaaacgtcgtgcgcgaggaaatggcgcgcgcgggcagcgtggagctgctgatgccggtggtgcagcctgccgaactgtggcaggaatccggccgctgggagttttacggtaaagaactgctgcgcctgaaagaccgccacgaacgcgatttctgcatgggcccgacctgcgaggaagtcatcgccgacatcgtgcgcaaagaaatcaacagctacaaacaactgccgaaaaatttttaccacatccaaaccaaattccgcgacgaagtgcgcccgcgtttcggcgtgatgcgcgcgcgcgaatttgtgatgaaagatgcttattccttccacgccgactacgcctcgcttcaggcgacctatgatgccatgtatgacgctcactgccgcatctttacccgtctgggtttggcgttccgccccgtcgccgcagacaccggcagcatcggcggtacgggttcgcacgagtttcaagtgttggcggaaagcggcgaagatgtgattgcatacagcgacacttccgattacgccgccaatatcgagttggcaccgaccttgccgcttaaaggtgaacgtgccgccgctcaggctgtgttgaccaaagtacatacaccaaacgtcaaaaccattgagtctttggttgaattcctgaatattccggttgaacaaaccctcaaatccatcgtggttgaaggcgaaaacgaaggcgaactcgtcctactgctgttgcgtggcgaccatgagtttaacgacatcaaggcagaaaaactggcgggcgtaaaatcgccactgactatggcaagccctgccgcgattgttgaacaattcggcgcaaacggcggttcgctcggccccgtcggcttcacaggcaaagtctatgccgatttcgctaccgaaaaaggcgcggactgggttatcggcgcaaacgaagacgactaccactataccggcttcaacttcggccgcgatgccgccgagcctgaattcgtcgatttgcgtaatgtggtcgaaggcgacgaaagccccgacgggcaaggccgtctgaaactggcgcgcggcatcgaagtcggacatgtcttccagttgcgcggcaaatatacccaagctatgaacgtcagcttcctcgacaataacggcaaatcgcaaatcatggaaatgggctgctacggcatcggcatcacccgcgtcgttgccgccgccatcgagcagaataacgacgaaaaaggcatcatttggaccaaagcgatggcgccgtttgaagtcgtcatcgtgccgatgaactacaaaaaatccgacactgtgcgtgaagccgccgacagaatctatgccgaattgctggcggcaggcgcggatgtgctgctggacgaccgcgacgaacgcgcaggcgtattgctgaacgattccgagcttctcggtatcccgcaccgcatcgtcatcggcgaccgcgccttgaaagaaggcaatgtcgaatacgccgaacgccgcggcaacgaagcgcaggcagttgcaatcggagaaattgttgcgcgtgtaacagcttcattaaatgcg

SEQ ID NO: 3972 - protein, 599 aa, Neisseria gonorrhoeae
LEVGAKPAFFALQSAPDLLLNLPVWKNTFMKASQFFISTLKEAPAEAAFASHKLMIRAGLIKANASGLYTWMPMGLRVLRKVENVVREEMARAGSVELLMPVVQPAELWQESGRWEFYGKELLRLKDRHERDFCMGPTCEEVIADIVRKEINSYKQLPKNFYHIQTKFRDEVRPRFGVMRAREFVMKDAYSFHADYASLQATYDAMYDAHCRIFTRLGLAFRPVAADTGSIGGTGSHEFQVLAESGEDVIAYSDTSDYAANIELAPTLPLKGERAAAQAVLTKVHTPNVKTIESLVEFLNIPVEQTLKSIVVEGENEGELVLLLLRGDHEFNDIKAEKLAGVKSPLTMASPAAIVEQFGANGGSLGPVGFTGKVYADFATEKGADWVIGANEDDYHYTGFNFGRDAAEPEFVDLRNVVEGDESPDGQGRLKLARGIEVGHVFQLRGKYTQAMNVSFLDNNGKSQIMEMGCYGIGITRVVAAAIEQNNDEKGIIWTKAMAPFEVVIVPMNYKKSDTVREAADRIYAELLAAGADVLLDDRDERAGVLLNDSELLGIPHRIVIGDRALKEGNVEYAERRGNEAQAVAIGEIVARVTASLNA

SEQ ID NO: 3973 - DNA, 669 bp, Neisseria gonorrhoeae
ttgggggaaagtgaagtggcttcagtatttttagaaggagaagcagtcgaggtcggcaatattttctgtatcggcaggaactatgccgcacatgtcgaagagttaaaaaacgaaataccttcagaacctgtggtgtttatgaagccgtcaggcagcattttgaacagcggcggtacaatcttgctgcccgagttcagtagggatgtgcagtttgagtgcgaactagtgttgctgattggccgggattcagacggcacgggcgagggtgaagatattttgggatgcgtggcggggtacggcgtgggtttggatttgaccgcgcgggacatccaatgccgtctgaaggcgcaggggctgccctggctgaaggcaaaagggttcaggcattctgcgtgcgtgtcggattttgcggcggcagacagaatcggcaatcaagataaggtgttgttttcattaaaacaaaacggcgtattgaaacagcgcggggagactggtttgatgatttacccgattcgggaaattttacacaaactggcggcggattacggtttggggaaaggggatttggtgtttaccggaacgccttccggcgtgggcgcaatcggtgcgggggacaatttggcattggagctggacggcttggtgtgcgcctctttcacgatagggtgt

SEQ ID NO: 3974 - protein, 223 aa, Neisseria gonorrhoeae
LGESEVASVFLEGEAVEVGNIFCIGRNYAAHVEELKNEIPSEPVVFMKPSGSILNSGGTILLPEFSRDVQFECELVLLIGRDSDGTGEGEDILGCVAGYGVGLDLTARDIQCRLKAQGLPWLKAKGFRHSACVSDFAAADRIGNQDKVLFSLKQNGVLKQRGETGLMIYPIREILHKLAADYGLGKGDLVFTGTPSGVGAIGAGDNLALELDGLVCASFTIGC

SEQ ID NO: 3975 - DNA, 453 bp, Neisseria gonorrhoeae
atgcataaaattccaaaaggaacggcactggcattcgacttcggcgaagcgcgcatcggcgtggcgcagggcgatgcggaattggggctgtcccatccgctggccaccgttaccggcggcagcaacgatgaaaaattcgcggcaatcgccaagctggttcaagaatggcagccgcgttattttgtcgtcggactgcccgtgcatgccgacggcacggaacatgaaatgacgcacctgtcgcgcaagtttggacgcaggctgaacggcaggttcaatctccccgtctattgggttgacgaacggctgtcgtccgtctgtgccgaaagcctgctttcggaagcacaggtcttgggcaaaaaacgcaaatcggtgctcgaccaagtggcggcgcaagccatcctgcacggttttctcgagggcggcccggcggaatgtttcaacgggcgtgaaggt

SEQ ID NO: 3976 - protein, 151 aa, Neisseria gonorrhoeae
MHKIPKGTALAFDFGEARIGVAQGDAELGLSHPLATVTGGSNDEKFAAIAKLVQEWQPRYFVVGLPVHADGTEHEMTHLSRKFGRRLNGRFNLPVYWVDERLSSVCAESLLSEAQVLGKKRKSVLDQVAAQAILHGFLEGGPAECFNGREG

SEQ ID NO: 3977 - DNA, 582 bp, Neisseria gonorrhoeae
gtgcaggatggcttgcgccgccacttggtcgagcaccgatttgcgttttttgcccaagacctgtgcttccgaaagcaggctttcggcacagacggacgacagccgttcgtcaacccaatagacggggagattgaacctgccgttcagcctgcgtccaaacttgcgcgacaggtgcgtcatttcatgttccgtgccgtcggcatgcacgggcagtccgacgacaaaataacgcggctgccattcttgaaccagcttggcgattgccgcgaatttttcatcgttgctgccgccggtaacggtggccagcggatgggacagccccaattccgcatcgccctgcgccacgccgatgcgcgcttcgccgaagtcgaatgccagtgccgttccttttggaattttatgcatggccggctcccgaaaacagggcgagcgggtcgatgccgagtttggcgaatgcggcggcgtaacggtgttcgtaggggatgtcgaacaggatgtgttcgtcggcgggaacggtcagccacgcattgtcggcaagttcgcgttcgagctgccctttgctccagctcgaatagcctatgc

SEQ ID NO: 3978 - protein, 194 aa, Neisseria gonorrhoeae
VQDGLRRHLVEHRFAFFAQDLCFRKQAFGTDGRQPFVNPIDGEIEPAVQPASKLARQVRHFMFRAVGMHGQSDDKITRLPFLNQLGDCREFFIVAAAGNGGQRMGQPQFRIALRHADARFAEVECQCRSFWNFMHGRLPKTGRAGRCRVWRMRRRNGVRRGCRTGCVRRRERSATHCRQVRVRAALCSSSNSLC

SEQ ID NO: 3979 - DNA, 546 bp, Neisseria gonorrhoeae
atgaacctgtccaaccactttctcgtcgccatgcccgatatggaagacgcgtttttttcacaatcggtcgtctatatctgcaaacacgatgaagacggcgcactcggtatcgccatcaacaaaccctctccgattacgatggacatgattttttccgccaccggcaaaaacatccccatgcggatgcagcacgacagcgtgatgatgggcgggccggtgcaggtcgagcgcggttacgtcgtccacactccgatcggcaactggcaaagcagcatcggcgtttcagacggcatcgcgctgacctcttcccgcgatgtgcttgaaaacatttcacgcgaaggcgcggttgacaaagccttgatcagcataggctattcgagctggagcaaagggcagctcgaacgcgaacttgccgacaatgcgtggctgaccgttcccgccgacgaacacatcctgttcgacatcccctacgaacaccgttacgccgccgcattcgccaaactcggcatcgacccgctcgccctgttttcgggagccggccatgca

SEQ ID NO: 3980 - protein, 182 aa, Neisseria gonorrhoeae
MNLSNHFLVAMPDMEDAFFSQSVVYICKHDEDGALGIAINKPSPITMDMIFSATGKNIPMRMQHDSVMMGGPVQVERGYVVHTPIGNWQSSIGVSDGIALTSSRDVLENISREGAVDKALISIGYSSWSKGQLERELADNAWLTVPADEHILFDIPYEHRYAAAFAKLGIDPLALFSGAGHA

SEQ ID NO: 3981 - DNA, 939 bp, Neisseria gonorrhoeae
atgaaaaccctgctcctcctcatccccctcgtactcaccgcctgcggcacactgaccggcatacccgcccacggcggcggcaaacgctttgccgtcgaacaggaactcgtcgccgcatcgtcccgcgccgccgtcaaagaaatggacttgtccgccctgaaaggacgcaaagccgccctttacgtctccgttatgggcgaccaaggttcgggcaacataagcggcggacgctactccatcgacgcactgatacgcggcggctaccacaacaaccccgacagcgccacccgatacagctaccccgcctatgacactaccgccaccaccaaatccgacgcgctctccggcgtaaccacttccacatcgcttttgaacgcccccgccgccgccctgacgaaaaacaacggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgtcgaccgcgacagccggaaactgctgattgcccctaaaaccgccgcctacgaatcccaataccaagaacaatacgccctctggatgggaccttacagcgtcggcaaaaccgtcaaagcctcagaccgcctgatggtcgatttctccgacatcaccccctacggcgacacaaccgcccaaaaccgtcccgacttcaaacaaaacaacggtaaaaaccccgatgtcggcaacgaagtcatccgccgccgcaaaggagga

SEQ ID NO: 3982 - protein, 313 aa, Neisseria gonorrhoeae
MKTLLLLIPLVLTACGTLTGIPAHGGGKRFAVEQELVAASSRAAVKEMDLSALKGRKAALYVSVMGDQGSGNISGGRYSIDALIRGGYHNNPDSATRYSYPAYDTTATTKSDALSGVTTSTSLLNAPAAALTKNNGRKGERSAGLSVNGTGDYRNETLLANPRDVSFLTNLIQTVFYLRGIEVVPPEYADTDVFVTVDVFGTVRSRTELHLYNAETLKAQTKLEYFAVDRDSRKLLIAPKTAAYESQYQEQYALWMGPYSVGKTVKASDRLMVDFSDITPYGDTTAQNRPDFKQNNGKNPDVGNEVIRRRKGG

SEQ ID NO: 3983 - DNA, 630 bp, Neisseria gonorrhoeae
gtgcgcccctccaaacaaagcaaaccctgccgccttccggaaaacggggattcaaccgataaggaaattttgatgaacagactgctactgctgtctgccgccgtcctgccgactgcctgcggcagcggcgaaaccgataaaatcggacgggcaagtaccgttttcaacatgttgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaagcgcggtacgggcttcgcgttcaagagccggcagattgtccgttattacgaccccaaacgcaaagccttcgcctatttggtttacagcgataaaatcgtccaaggatcgccgaaaaattccttaagcgcggtttcctgtttcggcagcggcataccgcaaaccgacggggtgcaagccgatacttccggcaaactgcttgccggcgcctgcattatttccaacccgataaaaaatcccgacaaacgc

SEQ ID NO: 3984 - protein, 210 aa, Neisseria gonorrhoeae
VRPSKQSKPCRLPENGDSTDKEILMNRLLLLSAAVLPTACGSGETDKIGRASTVFNMLGKNDRIEVEGFDDPDVQGVACYISYAKKGGLKEMVNLEEDASDASVSCVQTASSISFDETAVRKPKEVFKRGTGFAFKSRQIVRYYDPKRKAFAYLVYSDKIVQGSPKNSLSAVSCFGSGIPQTDGVQADTSGKLLAGACIISNPIKNPDKR

SEQ ID NO: 3985 - DNA, 129 bp, Neisseria gonorrhoeae
gtgtcggaacacaatatccgttgcagcattgaaaatatgccgcacaatataaggctgtttgagccgattgcaagtatccgcgcaaagaaggtgcaagattgggcaaacggcattttcagacggcataac

SEQ ID NO: 3986 - protein, 43 aa, Neisseria gonorrhoeae
VSEHNIRCSIENMPHNIRLFEPIASIRAKKVQDWANGIFRRHN

SEQ ID NO: 3987 - DNA, 1836 bp, Neisseria gonorrhoeae
gtgcagccttcagtattatccaacttttccgaaggtcgaaccatgcgctacaaaccccttctgcttgccctgatgctcgttttttccacgcccgccgttgccgcccacgacgcggcacacaaccgttccgccgaagtgaaaaaacaggcgaagaacaaaaaagaacagcccgaagcggcggaaggcaaaaaagaaaaaggcaaaaatgccgcagtgaaagataaaaaaacaggcggcaaagaggcggcaaaagagttcaaaaaaaccgccaaaaaccgcaaagaagcagagaaggaggcgacatccaggcagtctgcgcgcaaaggacgcgaaggggataaggaatcgaaggcggaacacaaaaaggcacatggcaagcccgtgtccggatccaaagaaaaaaacgcaaaaacacagcctgaaaacaaacaaggcaaaaaaggggcaaaaggacagggcaatccgcgcaagggcggcaaggcggaaaaagacactgtttctgcaaataaaaaagcccgttccgacaagaacggcaaagcagtgaaacaggacaaaaaacacacggaagagaaaaatgccaaaaccgattccgacgaattgaaagccgccgttgccgctgccaccaatgatgtcgaaaacaaaaaagccctgctcaaacaaagcgaaggaatgctgcttcatgtcagcaattccctcaaacagcttcaggaagagcgtatccgccaagaacgtatccgccaagagcgtatccgtcaggcgcgcggcaaccttgcttccgtcaaccgcaaacagcgcgaggcttgggacaaattccaaaaactcaataccgagctgaaccgtttgaaaacggaagtcgccgctacgaaagcgcagatttcccgtttcgtatcggggaactataaaaacagccggccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatccctgctgaaaaaacagggtgtaaccgatgcggcggaacagacggaaagccgcagacagaatgccaaaatctccaaagatgcccgaaaactgctggaacagaaagggaacgagcagcagctgaacaagctcttgagcaatttggagaaaaaaaaagccgaacaccgcattcaggatgcggaagcaaaaagaaaattggctgaagccaaactggcggcagccgaaaaagccagaaaagaagcggcgcagcagaaggctgaagcgcgacgtgcggaaatgtccaacctgaccgccgaagacaggaacatccaagcgccttcggttatgggtatcggcagtgccgacggtttcagccgcatgcagggacgtttgaaaaaaccggttgacggtgtgccgaccgggcttttcgggcagaaccggagcggcggcgatgtttggaaaggcgtgttctattccactgcgcctgcaacggttgaaagcattgcgccgggaacggtaagctatgcggacgagttggacggctacggcaaagtggtcgtgatcgatcacggcgagaactacatcagcatctatgccggtttgagcgaaatttccgccggcaagggttatacggtcgcggcaggaagcaaaatcggcacgagcgggtcgctgccggacggggaagaggggctttacctgcaaatacgttatcgaggtcaggtgttgaacccttcgggctggatacgt

SEQ ID NO: 3988 - protein, 612 aa, Neisseria gonorrhoeae
VQPSVLSNFSEGRTMRYKPLLLALMLVFSTPAVAAHDAAHNRSAEVKKQAKNKKEQPEAAEGKKEKGKNAAVKDKKTGGKEAAKEFKKTAKNRKEAEKEATSRQSARKGREGDKESKAEHKKAHGKPVSGSKEKNAKTQPENKQGKKGAKGQGNPRKGGKAEKDTVSANKKARSDKNGKAVKQDKKHTEEKNAKTDSDELKAAVAAATNDVENKKALLKQSEGMLLHVSNSLKQLQEERIRQERIRQERIRQARGNLASVNRKQREAWDKFQKLNTELNRLKTEVAATKAQISRFVSGNYKNSRPNAVALFLKNAEPGQKNRFLRYTRYVNASNREVVKDLEKQQKALAVQEQKINNELARLKKIQANVQSLLKKQGVTDAAEQTESRRQNAKISKDARKLLEQKGNEQQLNKLLSNLEKKKAEHRIQDAEAKRKLAEAKLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVIDHGENYISIYAGLSEISAGKGYTVAAGSKIGTSGSLPDGEEGLYLQIRYRGQVLNPSGWIR

SEQ ID NO: 3989 - DNA, 126 bp, Neisseria gonorrhoeae
ttgccgtttgccgtacctgtgttttccggtttttggaaatcaagagagaaagttaaagaagaatgtcgaaacctgtttttaagaaaatcgcactttatactttgggtgcaatcagcggcgtggccg

SEQ ID NO: 3990 - protein, 42 aa, Neisseria gonorrhoeae
LPFAVPVFSGFWKSREKVKEECRNLFLRKSHFILWVQSAAWP

SEQ ID NO: 3991 - DNA, 3156 bp, Neisseria gonorrhoeae
gtgtccgaccaggtccgcctcgcggctttcaaaagtacgttccttatcttttacttcgacatcgggaacaatcccctgtgcctgaatggaacggtcgttcggcgtgtaatacagggcggtcgtcaacttgaccgcgctgccgttggacaaaggaatcaaagtctgaaccgaacctttaccgaagctctgcgtaccgacgatgaccgcgcgtttgtggtcctgcaatgcgccggcgacaatctccgacgcggaagccgaaccggaattgaccaataccgtcatcggaatcgttttcaactcggcaggaatacccgccaaagggtcgccgcccataccgtacacataatcctcgggaacggctttcagtaccatgccgtctttgccgtcgcgtcccttggtgctgacgacgaccgcttcagacggcagaaacgccgccgacacgccgaccgcgccggtcaaaagcccgccggggtcgtcgcgcaaatccaacaccagccccttgagcggttttcctttattttcctttaccagctcttttgcggcggtattgacgctttcgaccgtccgctcttggaactgcgacacgcggatatagccgtaatcgggttcgatcaggtgatggcggacgcttttcactttaataatggcacgggtcaggttgacgactatcggcttgtcggcatttttgcgcgacaacgtcaaagtaatcttcgtacccggcttgccccgcatttttttcaccgcttcgctgaccgtcataccgcgcgtcgaaacattatcgattttcacaatgaaatcgccgcttttcacctccgcccgttcggcaggcgtgtcctcaatcggcgaaaccactttgacaaaaccgtcttcctgcccgatttccatccccaagccgccaaattcgccgctggtggactcctttatctcggcataaccttttttatccatatattcggaatgcggatccaaaccggccaccatacccttcatcgcaccttcaaacaaatcggcatcgggtttgtcatgatagtagtttgccttaatctgaccgtaaacctccgccatcgtacggatggattgcaccggcaggacttcgttatcccgcccgtccttctcggcggcaaaaccctgcaccgccagacttacggccacgccgctgattgcacccaaagtataaagtgcgattttcttaaaaacaggtttcgacattcttctttaactttctctcttgatttccaaaaaccggaaaacacaggtacggcaaacggcaaacttcacggaacagcgcaccatatcggcacgatttgcataaagcctgccgtttcggcaatccgatcaacgtatccagcccgaagggttcaacacctgacctcgataacgtatttgcaggtaaagcccctcttccccgtccggcagcgacccgctcgtgccgattttgcttcctgccgcgaccgtataacccttgccggcggaaatttcgctcaaaccggcatagatgctgatgtagttctcgccgtgatcgatcacgaccactttgccgtagccgtccaactcgtccgcatagcttaccgttcccggcgcaatgctttcaaccgttgcaggcgcagtggaatagaacacgcctttccaaacatcgccgccgctccggttctgcccgaaaagcccggtcggcacaccgtcaaccggttttttcaaacgtccctgcatgcggctgaaaccgtcggcactgccgatacccataaccgaaggcgcttggatgttcctgtcttcggcggtcaggttggacatttccgcacgtcgcgcttcagccttctgctgcgccgcttcttttctggctttttcggctgccgccagtttggcttcagccaattttctttttgcttccgcatcctgaatgcggtgttcggctttttttttctccaaattgctcaagagcttgttcagctgctgctcgttccctttctgttccagcagttttcgggcatctttggagattttggcattctgtctgcggctttccgtctgttccgccgcatcggttacaccctgttttttcagcagggattgcacgtttgcctgaattttcttcaaacgggcaagctcattgttgattttctgctcttgtaccgccaaagccttctgctgtttttccaaatccttgacaacttcccgattggaggcgtttacataacgcgtataacgcaaaaagcggtttttctgacccggttcggcgtttttcaggaacagggcaaccgcattcggccggctgtttttatagttccccgatacgaaacgggaaatctgcgctttcgtagcggcgacttccgttttcaaacggttcagctcggtattgagtttttggaatttgtcccaagcctcgcgctgtttgcggttgacggaagcaaggttgccgcgcgcctgacggatacgctcttggcggatacgttcttggcggatacgctcttcctgaagctgtttgagggaattgctgacatgaagcagcattccttcgctttgtttgagcagggcttttttgttttcgacatcattggtggcagcggcaacggcggctttcaattcgtcggaatcggttttggcatttttctcttccgtgtgttttttgtcctgtttcactgctttgccgttcttgtcggaacgggcttttttatttgcagaaacagtgtctttttccgccttgccgcccttgcgcggattgccctgtccttttgccccttttttgccttgtttgttttcaggctgtgtttttgcgtttttttctttggatccggacacgggcttgccatgtgcctttttgtgttccgccttcgattccttatccccttcgcgtcctttgcgcgcagactgcctggatgtcgcctccttctctgcttctttgcggtttttggcggtttttttgaactcttttgccgcctctttgccgcctgtttttttatctttcactgcggcatttttgcctttttcttttttgccttccgccgcttcgggctgttcttttttgttcttcgcctgttttttcacttcggcggaacggttgtgtgccgcgtcgtgggcggcaacggcgggcgtggaaaaaacgagcatcagggcaagcagaaggggtttgtagcgcatggttcgaccttcggaaaagttgga

SEQ ID NO: 3992 - protein, 1052 aa, Neisseria gonorrhoeae
VSDQVRLAAFKSTFLIFYFDIGNNPLCLNGTVVRRVIQGGRQLDRAAVGQRNQSLNRTFTEALRTDDDRAFVVLQCAGDNLRRGSRTGIDQYRHRNRFQLGRNTRQRVAAHTVHIILGNGFQYHAVFAVASLGADDDRFRRQKRRRHADRAGQKPAGVVAQIQHQPLERFSFIFLYQLFCGGIDAFDRPLLELRHADIAVIGFDQVMADAFHFNNGTGQVDDYRLVGIFARQRQSNLRTRLAPHFFHRFADRHTARRNIIDFHNEIAAFHLRPFGRRVLNRRNHFDKTVFLPDFHPQAAKFAAGGLLYLGITFFIHIFGMRIQTGHHTLHRTFKQIGIGFVMIVVCLNLTVNLRHRTDGLHRQDFVIPPVLLGGKTLHRQTYGHAADCTQSIKCDFLKNRFRHSSLTFSLDFQKPENTGTANGKLHGTAHHIGTICIKPAVSAIRSTYPARRVQHLTSITYLQVKPLFPVRQRPARADFASCRDRITLAGGNFAQTGIDADVVLAVIDHDHFAVAVQLVRIAYRSRRNAFNRCRRSGIEHAFPNIAAAPVLPEKPGRHTVNRFFQTSLHAAETVGTADTHNRRRLDVPVFGGQVGHFRTSRFSLLLRRFFSGFFGCRQFGFSQFSFCFRILNAVFGFFFLQIAQELVQLLLVPFLFQQFSGIFGDFGILSAAFRLFRRIGYTLFFQQGLHVCLNFLQTGKLIVDFLLLYRQSLLLFFQILDNFPIGGVYITRITQKAVFLTRFGVFQEQGNRIRPAVFIVPRYETGNLRFRSGDFRFQTVQLGIEFLEFVPSLALFAVDGSKVAARLTDTLLADTFLADTLFLKLFEGIADMKQHSFALFEQGFFVFDIIGGSGNGGFQFVGIGFGIFLFRVFFVLFHCFAVLVGTGFFICRNSVFFRLAALARIALSFCPFFALFVFRLCFCVFFFGSGHGLAMCLFVFRLRFLIPFASFARRLPGCRLLLCFFAVFGGFFELFCRLFAACFFIFHCGIFAFFFFAFRRFGLFFFVLRLFFHFGGTVVCRVVGGNGGRGKNEHQGKQKGFVAHGSTFGKVG

SEQ ID NO: 3993 - DNA, 1434 bp, Neisseria gonorrhoeae
ttgggtgcaatcagcggcgtggccgtaagtctggcggtgcagggttttgccgccgagaaggacgggcgggataacgaagtcctgccggtgcaatccatccgtacgatggcggaggtttacggtcagattaaggcaaactactatcatgacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggttttgtcaaagtggtttcgccgattgaggacacgcctgccgaacgggcggaggtgaaaagcggcgatttcattgtgaaaatcgataatgtttcgacgcgcggtatgacggtcagcgaagcggtgaaaaaaatgcggggcaagccgggtacgaagattactttgacgttgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgaccggcgcggtcggcgtgtcggcggcgtttctgccgtctgaagcggtcgtcgtcagcaccaagggacgcgacggcaaagacggcatggtactgaaagccgttcccgaggattatgtgtacggtatgggcggcgaccctttggcgggtattcctgccgagttgaaaacgattccgatgacggtattggtcaattccggttcggcttccgcgtcggagattgtcgccggcgcattgcaggaccacaaacgcgcggtcatcgtcggtacgcagagcttcggtaaaggttcggttcagactttgattcctttgtccaacggcagcgcggtcaagttgacgaccgccctgtattacacgccgaacgaccgttccattcaggcacaggggattgttcccgatgtcgaagtaaaagataaggaacgtacttttgaaagccgcgaggcggacctggtcggacacatcggcaatcccttgggcggcgaggatgtgaacagtgaaacccttgccgtaccgcttgaaaaagatgcggataagcccgctgcaaaagaaaaaggtaaaaagaaaaaggacgaggatttgtcttcaaggcggattccgaaccctgcgaaagacgatcagttgcgtaaggctttggatttggtcaagtcgcccgagcagtggcagaagtctttggggctggcggcgaaaaaaccggtttcaaataaagataaaaaagataagaag

SEQ ID NO: 3994 - protein, 478 aa, Neisseria gonorrhoeae
LGAISGVAVSLAVQGFAAEKDGRDNEVLPVQSIRTMAEVYGQIKANYYHDKPDADLFEGAMKGMVAGLDPHSEYMDKKGYAEIKESTSGEFGGLGMEIGQEDGFVKVVSPIEDTPAERAEVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDGMVLKAVPEDYVYGMGGDPLAGIPAELKTIPMTVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 3995 - DNA, 234 bp, Neisseria gonorrhoeae
atgtcaaacatcgaacaacaagttaagaaaattattgctgaacaactgggcgtaaacgaagccgacgtgaaaaacgaatcttccttccaagacgacttgggcgcggattctttggataccgtggagttggttatggctttggaagaagccttcggctgcgaaatccccgacgaagatgccgaaaaaatcaccaccgtccaactggctatcgactacatcaatgcccacaacggc

SEQ ID NO: 3996 - protein, 78 aa, Neisseria gonorrhoeae
MSNIEQQVKKIIAEQLGVNEADVKNESSFQDDLGADSLDTVELVMALEEAFGCEIPDEDAEKITTVQLAIDYINAHNG

SEQ ID NO: 3997 - DNA, 882 bp, Neisseria gonorrhoeae
ttgttcttggtattgggattcgtaggcggcggttttaggggcaatcagcagtttccggctgtcgcggtcgacggcgaaatattcgagcttggtttgggctttaagggtttcggcgttgtagaggtgcagttcggtacggctgcggacggtgccgaatacgtcgacggttacgaatacgtcggtgtcggcgtattcgggcggtacgacttcgatgccgcgcaggtagaagacggtttggatgaggttggtcaggaaggaaacgtcgcgggggttggcgagcagggtttcgttgcggtagtcgcccgtgccgttgacggacagtccggcggagcgttcgcctttgcgtccgttgtttttcgtcagggcggcggcgggggcgttcaaaagcgatgtggaagtggttacgccggagagcgcgtcggatttggtggtggcggtagtgtcataggcggggtagctgtatcgggtggcgctgtcggggttgttgtggtagccgccgcgtatcagtgcgtcgatggagtagcgtccgccgcttatgttgcccgaaccttggtcgcccataacggagacgtaaagggcggctttgcgtcctttcagggcggacaagtccatttctttgacggcggcgcgggacgatgcggcgacgagttcctgttcgacggcaaagcgtttgccgccgccgtgggcgggtatgccggtcagtgtgccgcaggcggtgagtacgagggggatgaggaggagcagggttttcatggcagggtttgttttgttttgaacgggtttgagtgtaaatggattttaagggtttgtaaacgaaaggggtggaaatgccgtctgaacggcagggcgggctttcagacggcattgtttttgtggctgtac

SEQ ID NO: 3998 - protein, 294 aa, Neisseria gonorrhoeae
LFLVLGFVGGGFRGNQQFPAVAVDGEIFELGLGFKGFGVVEVQFGTAADGAEYVDGYEYVGVGVFGRYDFDAAQVEDGLDEVGQEGNVAGVGEQGFVAVVARAVDGQSGGAFAFASVVFRQGGGGGVQKRCGSGYAGERVGFGGGGSVIGGVAVSGGAVGVVVVAAAYQCVDGVASAAYVARTLVAHNGDVKGGFASFQGGQVHFFDGGAGRCGDEFLFDGKAFAAAVGGYAGQCAAGGEYEGDEEEQGFHGRVCFVLNGFECKWILRVCKRKGWKCRLNGRAGFQTALFLWLY

SEQ ID NO: 3999 - DNA, 123 bp, Neisseria gonorrhoeae
atggacggaaatctgccgtctgaacggctcgagcgcctgcacgcacattgccggcccgaggtcggatccgcctatgccgatgtggacaaaatccgcaatccgttttccggttatcccctgata

SEQ ID NO: 4000 - protein, 41 aa, Neisseria gonorrhoeae
MDGNLPSERLERLHAHCRPEVGSAYADVDKIRNPFSGYPLI

SEQ ID NO: 4001 - DNA, 150 bp, Neisseria gonorrhoeae
ttgacgatgccgtctgaaaggatttcagacggcatattatgtttgaaaggacaggttatgagcgattttttaccggaatttgaaccgtgcggcatttatagtggattaacaaaaatcaggacaaggcgacgaagccgcagacagtacaaa

SEQ ID NO: 4002 - protein, 50 aa, Neisseria gonorrhoeae
LTMPSERISDGILCLKGQVMSDFLPEFEPCGIYSGLTKIRTRRRSRRQYK

SEQ ID NO: 4003 - DNA, 2025 bp, Neisseria gonorrhoeae
atggaagttatccgatacccaaattcccccttcaaactccaccaacccttcccgcccgcaggcgaccagcccaccgccattgcgggcctgatcgaagggctttcagacggccttgcctaccaaaccctgctcggcgtaaccggttcgggcaaaacctacacgatggcgaacgtcatcgcgcaaagcggcagacccgccatcattatggcgcacaacaaaacccttgccgcccagctttatgccgaaatgcgcgagtttttccccgaaaacgcagtggaatatttcgtgtcgtattacgactattaccagcccgaagcctatgtgcccagccgcgatttgttcatcgaaaaagacagcgcgatcaacgaacacatcgagcagatgcgcctttccgccaccaaaaacctgatgacgcgcgacgacgtgattatcgtcgccaccgtgtccgccatttacggtatcggcgacccgaccgagtatcaacaaatggtgctgtccgtaaaagaaggcgacaccatcgagcagcgcgacatcatcgccacgctcgtttccatgcagtacgaacgcggcgatttggacttcaaacgcggcagcttccgcgtgcgcggcgacgtgattgacgtgtaccccgccgaaagctccgaaaacgccttgcgtatcagcctgtttgatgacgaaatcgaccgcctcgatatgttcgacccgctttcaggcagcctgcaccagcgtgtcggacgctacaccgtcttcccgtccagccactacgttaccccgcgcgacaccgtattgcgcgcctgcgaatccatcaaagaagaattgcgcgaacgcatcgaatttttcgctcgcgaacaacgccccgtcgagcaacaacgcatcgaacagcgcacccgtttcgacctcgaaatgctctacgaaatgggcttctgcaaaggcattgaaaactactcccgccacttctccggtaaaaaagaaggcgaaccgccgcccacgctgatggactacctgcccgacaacgccatcatgttcatcgacgaaagccacgttaccgttacccaaatcggcggcatgtacaaaggcgacgcatcgcgcaagcaaaacctcgtggactacggcttccgcctgccttccgcccgcgacaaccgcccgctcaaattccacgaatttgaaaaagtcatgccgcaaaccgtcttcgtttccgccacccccgcgaaatacgaagaagaacacgccggacaagtcgtcgaacaagtcgtccgccccacagggctggtcgacccccaaaccatcatccgccccgtcgccacccaagtcgacgatttaatgagcgaaatcaacgaccgtattcaaaaaggcgaacgtgtgctcgttaccacccttaccaaacgcatggcggagcaactcaccgactattacagcgaactcggcatcaaagtgcgctacctgcacagcgacatcgacaccgtcgaacgcgttgaaatcattagagatttgcggctcggcctgtttgacgtactcgttggtatcaacctgttgcgcgaaggcctcgacatccccgaagtctccctcgtcgccatcctcgatgccgacaaagaaggcttcctgcgctcccaccgcagcctgattcaaaccataggccgcgccgcgcgcaacgtgaacggcgtcgccatcctgtacgccgacaaaattaccgactccatgaaagccgccgtcgacgaaaccgaacgccgccgcgaaaaacagattaaattcaacgaagaacacggtatcgtgccgcagcagattaaaaaacaggtcaaagacatcatcgacggcgtgtaccacgaagaagacagtggcaaaggccgtagacaaggcaaaaacaaggtcaaagtcggcgaaatccacaacgaagaagacgcgattaaagaaatcgccaaactggaaaaagccatgcagcaggcggctagggatttacagtttgaagaagctgctgtgttgagggataggattagcaatattaaagagaatttgttgtttggggcggag

SEQ ID NO: 4004 - protein, 675 aa, Neisseria gonorrhoeae
MEVIRYPNSPFKLHQPFPPAGDQPTAIAGLIEGLSDGLAYQTLLGVTGSGKTYTMANVIAQSGRPAIIMAHNKTLAAQLYAEMREFFPENAVEYFVSYYDYYQPEAYVPSRDLFIEKDSAINEHIEQMRLSATKNLMTRDDVIIVATVSAIYGIGDPTEYQQMVLSVKEGDTIEQRDIIATLVSMQYERGDLDFKRGSFRVRGDVIDVYPAESSENALRISLFDDEIDRLDMFDPLSGSLHQRVGRYTVFPSSHYVTPRDTVLRACESIKEELRERIEFFAREQRPVEQQRIEQRTRFDLEMLYEMGFCKGIENYSRHFSGKKEGEPPPTLMDYLPDNAIMFIDESHVTVTQIGGMYKGDASRKQNLVDYGFRLPSARDNRPLKFHEFEKVMPQTVFVSATPAKYEEEHAGQVVEQVVRPTGLVDPQTIIRPVATQVDDLMSEINDRIQKGERVLVTTLTKRMAEQLTDYYSELGIKVRYLHSDIDTVERVEIIRDLRLGLFDVLVGINLLREGLDIPEVSLVAILDADKEGFLRSHRSLIQTIGRAARNVNGVAILYADKITDSMKAAVDETERRREKQIKFNEEHGIVPQQIKKQVKDIIDGVYHEEDSGKGRRQGKNKVKVGEIHNEEDAIKEIAKLEKAMQQAARDLQFEEAAVLRDRISNIKENLLFGAE

SEQ ID NO: 4005 - DNA, 120 bp, Neisseria gonorrhoeae
gtggcgcacacgctatgtattcaggctgcgattactatttcaaaatcactccgccccaaacaacaaattctctttaatattgctaatcctatccctcaacacagcagcttcttcaaactg

SEQ ID NO: 4006 - protein, 40 aa, Neisseria gonorrhoeae
VAHTLCIQAAITISKSLRPKQQILFNIANPIPQHSSFFKL

SEQ ID NO: 4007 - DNA, 756 bp, Neisseria gonorrhoeae; identical to SEQ ID NO: 275

SEQ ID NO: 4008 - protein, 252 aa, Neisseria gonorrhoeae; identical to SEQ ID NO: 276

SEQ ID NO: 4009 - DNA, 102 bp, Neisseria gonorrhoeae
ttgaatcggattcaaatatctttgttgcggctattaatatttttccggataaaggtagccatgcctcatggttatccaaataaagcaggacttatagaaaaa

SEQ ID NO: 4010 - protein, 34 aa, Neisseria gonorrhoeae
LNRIQISLLRLLIFFRIKVAMPHGYPNKAGLIEK

SEQ ID NO: 4011 - DNA, 345 bp, Neisseria gonorrhoeae; identical to SEQ ID NO: 183

SEQ ID NO: 4012 - protein, 115 aa, Neisseria gonorrhoeae; identical to SEQ ID NO: 184

SEQ ID NO: 4013 - DNA, 225 bp, Neisseria gonorrhoeae
ttgggacttggtattcaaacggatcggataacagaccgccggataaaaaaatgccgtctgaagcatgtttgcttacagacggcattctttcaagataaagcagcgggcgatgtttcaatacaagttttgaaacaatggtttgaacggcaaaaacgcgtgtataccgcacgcatccttgtaggttttaacctgcacatcggttttaaagtttattccgcccgcaga

SEQ ID NO: 4014 - protein, 75 aa, Neisseria gonorrhoeae
LGLGIQTDRITDRRIKKCRLKHVCLQTAFFQDKAAGDVSIQVLKQWFERQKRVYTARILVGFNLHIGFKVYSARR

SEQ ID NO: 4015 - DNA, 273 bp, Neisseria gonorrhoeae
aacatcgaacaacaagttaagaaaattattgctgaacaactgggcgtaaacgaagccgacgtgaaaaacgaatcttccttccaagacgacttgggcgcggattctttggataccgtggagttggttatggctttggaagaagccttcggctgcgaaatccccgacgaagatgccgaaaaaatcaccaccgtccaactggctatcgactacatcaatgcccacaacggctaaccggtcgtcgcccgacacaacagcctctgctgcaccgcgcaa

SEQ ID NO: 4016 - protein, 76 aa, Neisseria gonorrhoeae
NIEQQVKKIIAEQLGVNEADVKNESSFQDDLGADSLDTVELVMALEEAFGCEIPDEDAEKITTVQLAIDYINAHNG

SEQ ID NO: 4017 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagcgccccgccgggccgggcggaagctgtttcggcgggcggcgtaaaggcagacgcggtcgcggcgcggcaggaaaagcggttgtcttcggcattccgaaacgcaacgggcgggcctataccgttgccgaggacgatgccgagcctgaaacgttgccccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgacttaactccggcacaccgccccggcagctaaaaatcctgcgggatcggtgtggaatt

SEQ ID NO: 4018 - protein, 217 aa, Neisseria gonorrhoeae
MKITHCKLKKEVQKEPLRSFVPEVTARSAADILGIHPDSAALFYRKIRTVTNHRLALAADEVFERPAGPGGSCFGGRRKGRRGRGAAGKAVVFGIPKRNGRAYTVAEDDAEPETLPPAVKKKIMPDGIVYADSPGSRGKSDAGGFTRCRINRSKEFADRRNHINGIGNFWNQAKRALRKYNGIDRKPFPPLLRECEFRLNSGTPPRQLKILRDRCGI

SEQ ID NO: 4019 - DNA, 1698 bp, Neisseria gonorrhoeae
ttgttagactacattctgctatattttaatccggttctgaaaaatcaaggaaaacagatggatgcttttacccgtgcatggtatgcgctcgaacgccattatcaggatacgtgccacatccttttgcgcgaccgctttgctgccgaacccgaccgttttgagcgtatgcatgagcgtttggacgggatgttgttcgattacagcaaaaaccgttttggcgaagatacgctgcaactgctctgccgtcttgcggagacggcggatttggaagggaaaatgcgtgctttgcggacgggtgcgaaagtcaacggcagcgaggggcgtgccgcgctgcatacggctttgcgcctgcccgacggtgcggatgccgtttatgcggacggcagggacgtgttgcccgaaatccgccgcgagttaaatcgtgcgttgaagtttgcacacagtttggacgacggtttatatcaggggataaccggaaaacggattgcggattttgtccacatcggcataggcggatccgacctcgggccggcaatgtgcgtgcaggcgctcgagccgttcagacggcagatttccgtccattttgtttctaatgccgaccctgcctgcctggatgaggtcttatgccgtctgaaccccgaaacaacaatgttttgcgttgccagcaagtcctttaaaacaccggaaaccctgctcaatgcagaggcggtcaaggcgtggtatcgcggtgcggggttctcggaatccgaaacggcgcaccatttttgcgcggtgtctgccgatacggaagcggcgcaaagtttcggcattgcggcggaacgcgtgtttgcgatgtacgactgggtgggcggacgctattccgtctggtcgcccgtcggtttgcccgtgatggttgcggttggcggggcgcgtttccgcgaactgctagcgggggcgcacgcgatggacagccattttttccacacgcccccgcgtcgcaacattcccgttctgatggcactgattgccgtgtggtataacaatttccagcacgcggacgggcagaccgccgttccgtacagccacaacctgcgcctgctgccggcgtggctgaaccagctcgatatggagagtttgggcaaaagccgcgcttcagacggcagtcccgccgcgtgcaaaacgggcggcatcgtgttcggcggtgaaggggtcaactgccagcacgcctatttccaactgctccaccaaggcacgcgcctgattccctgcgactttatcgtcccgatgacggcgcagggcgcggaggacggacgcagccgttttaccgttgccaacgcctttgcccaagcggaagccctgatgaagggtaaaaccttagacgaagcacgcgccgaactggcagatttgcccgaagcggaacgcgaacgcctcgcgccgcacaaagagttccccggcaaccgccccagcaacagcatcctgctcgaccgcctcacgccctgcaatctgggtatgctgatggcggcttacgaacacaaaaccttcgtccaaggcgcgatatggaacgtcaaccccttcgatcagtggggggttgagtacggcaaacagttggcaaaaaccatcatcggcgaactggaaggcggcacgtccgtacacgatgcctcgaccgaagggctgatggcgttttaccgcgaatgccgtctgaaaggcggcggtgcggca

SEQ ID NO: 4020 - protein, 566 aa, Neisseria gonorrhoeae
LLDYILLYFNPVLKNQGKQMDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETAHHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYRECRLKGGGAA

SEQ ID NO: 4021 - DNA, 714 bp, Neisseria gonorrhoeae
atgacagacacccccgaaaaccaaacaccaaacgacctgccggccggacactcccgcagcatccgcagtttcgtcctccgccaaagccacatgaccgccgcacagcaacgcgccatcgataccttatgggacagcttcggcatcgactaccaagcaacaccggccgatcttgatgcccgtttcggaagcagccgacctaaaatcctcgaaataggcttcggtatgggaatggcaagcgcagaaatcgcccgccgcctgcccgaaaccgactttctcgccatcgacgtacacggccccggcgtaggcaacctgctcaaactcatcaacgaaaaccatttggaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagcagcttcgacaacctgcaaaatacggcggcagactacgcccccactccggactaccgccccgaaaccaaattcgaagcgcgcggcaaacgcctcggacacggcgtttgggacttggtattcaaacggatcgga

SEQ ID NO: 4022 - protein, 238 aa, Neisseria gonorrhoeae
MTDTPENQTPNDLPAGHSRSIRSFVLRQSHMTAAQQRAIDTLWDSFGIDYQATPADLDARFGSSRPKILEIGFGMGMASAEIARRLPETDFLAIDVHGPGVGNLLKLINENHLENIRVMRHDAVEVVENMLQDGSLDGIHIFFPDPWHKKRHHKRRLIQAPFIAKLLPKLKTGGYIHLATDWEEYAQQMLEVLSSFDNLQNTAADYAPTPDYRPETKFEARGKRLGHGVWDLVFKRIG

SEQ ID NO: 4023 - DNA, 141 bp, Neisseria gonorrhoeae
atgtattacttcggacagggcacagccgccgactacaacaaagcccgcaaatggtttgaacaagccacctcgcaaaaaaacagtatggcgttctacaacctcgcctgcatccattacagcggacacggtgtcaaaccggat

SEQ ID NO: 4024 - protein, 47 aa, Neisseria gonorrhoeae
MYYFGQGTAADYNKARKWFEQATSQKNSMAFYNLACIHYSGHGVKPD

SEQ ID NO: 4025 - DNA, 996 bp, Neisseria gonorrhoeae
atgggcaaaacaagcgcaaaaaacaacaatccccacgggcaatacctgctcgcccaatactgccggcacggcacgccgccggattttgaaacggcgcacctgctctaccgcaaagcggcggcacaaggcttgccggaagcacattggcaactcgggctgcaataccgtttcggacaagggacgaaagccgacacggcacaggccgtcaatcatttgcgcgccgccgcgcaacaaggatacattcccgcctacaccccgcttgccgaactcatcctacctacggctcccgatgaagccgtttaccggttccaacaggcggcacaggaaaatgaccccgatgcccatgccgcactggccgacatctacctgcaaggcaagtatctggaaagaaaccacaaacttgccctgcatcatgccgaagcagccgccgccgaacgccatcccgaaggtttgcggataccgggcgacatctgccgctacggtttgggcatagccctcgatacggaaaaagcccggcattattaccggcaggcagccgaagccggcagccttaccgcctatcagaaactcatatccgacagcgcgttaaaccatcccgagcaatatgacggcatcaaagattccgccattaggcggcaacaggcagagcagctttatcaaaagcccaagccctgcattacggattacaatgcgcacccgaatacgcagccgcgctcaaactgtacacagaagccgcagaactcggacacagcaaagcccaaaccaatctgggcagtatgtattacttcggacagggcacagccgccgactacaacaaagcccgcaaatggtttgaacaagccacctcgcaaaaaaacagtatggcgttctacaacctcgcctgcatccattacagcggacacggtgtcaaaccggattaaagaaaaagcctgtcactgcctgcaagaagccataaacaacggatacgggcaaaaaaacgtcctgcaagaactgctg

SEQ ID NO: 4026 - protein, 332 aa, Neisseria gonorrhoeae
MGKTSAKNNNPHGQYLLAQYCRHGTPPDFETAHLLYRKAAAQGLPEAHWQLGLQYRFGQGTKADTAQAVNHLRAAAQQGYIPAYTPLAELILPTAPDEAVYRFQQAAQENDPDAHAALADIYLQGKYLERNHKLALHHAEAAAAERHPEGLRIPGDICRYGLGIALDTEKARHYYRQAAEAGSLTAYQKLISDSALNHPEQYDGIKDSAIRRQQAEQLYQKPKPCITDYNAHPNTQPRSNCTQKPQNSDTAKPKPIWAVCITSDRAQPPTTTKPANGLNKPPRKKTVWRSTTSPASITADTVSNRIKEKACHCLQEAINNGYGQKNVLQELL

SEQ ID NO: 4027 - DNA, 906 bp, Neisseria gonorrhoeae
atgattcgacaaaacggaaaacgatctgatatgaacaatcccgacttaccctatcggcaggccttggaacgcctgtctcaaaaacaatattataactttaccgaagtccgccgactgctgacagaagcggcctcggcagatcatcccgccgccgcattcgagttggcaaaacacctgatgaacgcgaacagcccgcaccaagaccgcgaacaaggtatggaaatgctccgcatcgccgccgaacaggggcatccctatgcgcgttacaatttggcatatatccaagaattggaaggcgcgcccccggaaaccctgataccgctttacaggcctctggcagaagcaggcctgcccgaagcgcaagtccgcctgatgtaccttctgtacgcgtcccgacattttgaagaagccctggaatgggcaaaacaagcgcaaaaaacaacaatccccacgggcaatacctgctcgcccaatactgccggcacggcacgccgccggattttgaaacggcgcacctgctctaccgcaaagcggcggcacaaggcttgccggaagcacattggcaactcgggctgcaataccgtttcggacaagggacgaaagccgacacggcacaggccgtcaatcatttgcgcgccgccgcgcaacaaggatacattcccgcctacaccccgcttgccgaactcatcctacctacggctcccgatgaagccgtttaccggttccaacaggcggcacaggaaaatgaccccgatgcccatgccgcactggccgacatctacctgcaaggcaagtatctggaaagaaaccacaaacttgccctgcatcatgccgaagcagccgccgccgaacgccatcccgaaggtttgcggataccgggcgacatctgccgctacggtttgggca

SEQ ID NO: 4028 - protein, 302 aa, Neisseria gonorrhoeae
MIRQNGKRSDMNNPDLPYRQALERLSQKQYYNFTEVRRLLTEAASADHPAAAFELAKHLMNANSPHQDREQGMEMLRIAAEQGHPYARYNLAYIQELEGAPPETLIPLYRPLAEAGLPEAQVRLMYLLYASRHFEEALEWAKQAQKTTIPTGNTCSPNTAGTARRRILKRRTCSTAKRRHKACRKHIGNSGCNTVSDKGRKPTRHRPSIICAPPRNKDTFPPTPRLPNSSYLRLPMKPFTGSNRRHRKMTPMPMPHWPTSTCKASIWKETTNLPCIMPKQPPPNAIPKVCGYRATSAATVWA

SEQ ID NO: 4029 - DNA, 1884 bp, Neisseria gonorrhoeae
atgccgtctgaagccgtttttcaaatgattgatatgaatacagaaaaccgttctccggaacaattcgacatcccgctcttcctcaaaaacctgcccaagctgccgggcgtgtaccgtttttttgacgaaggcggcaacgtcttatacgtcggcaaagcggtcaacctcaagcggcgcgtgtccggctatttccaaaaaaacgaccattcgccgcgcatcgcgttgatggtgaaacaggttcgccacatcgaaaccaccatcacgcgttccgaagccgaagccctgattctcgaaaacaacttcatcaaagccttgtcgccgaaatacaatatcctttttcgcgacgacaaaagctatccttatttgatgctcagcggccatcaatatccgcaaatggcgtattaccgcggcacgctgaaaaatcccaaccaatacttcggcccgtatccgaacagcaacgccgtgcgcgacagcattcaagtgttgcaaaaagtcttcatgctgcgtacctgcgaagacagcgtgttcgaacaccgcgaccgcccttgcctactgtaccaaatcaaacgctgcaccgcgccctgcgtcggacacatcagcgaagaagactactgcgacagcgtgcgtcaagccgccactttcctcaacggcaaaaccgacgaactgacccgcaccctgcaacacaaaatgcagaccgccgccgcgaatctgcaatttgaagaagccgcccgttatcgcgaccaaatccaagcactcggcattatacagagcaaccagttcatcgacagcaaaaacccgaacaaccccaacgatatcgacctgctcgcgctcgccgtttcagacggccttgtctgcgtacactgggtcagcatccgcggcggacggcacgtcggcgacaaaagcttctttcccgacaccaaaaacgaccccgaaccaaacggtcaagattacgccgaagccttcgtcgcccaacactatctgggcaaaagcaaacccgacatcatcatcagcaactttcccgttcccgatgcgttgaaagaggctttggaaggagaacacggcaagcagatgcagttcgttaccaaaaccataggcgaacgcaaagtttggttgaaaatggcggaacaaaacgcacaaatggcgattacccaacgccacctgcaacaaagcaaccaacaacaccgcatcgacgaacttgccaaaatcctcggcatgaattcagacggaatcaaccgccttgaatgtttcgatatcagccacacgcaaggcgaagccaccatcgcctcctgcgtcgtgtacgacgaacaaaacatccaaccctcgcaataccgccgctacaacatcaccaccgccaaacccggcgacgactacgccgccatgcgcgaagtgttgacgcgccgttatggcaaaatacaggaagccgaagccaacggcgaaagcgtcaaatggccggatgtcgtgttgattgacggcggtaaagggcaaatcggcgtagccgtatccgtatgggaagaactcgggctgcacatccctttagtcggtattgccaaaggccccgaacgcaaagccggcatggaagaactcatactgccttttaccggcgaactcttccgcctgcctcctaatagcccggccttgcatttattgcaaaccgtacgcgatgaatcacaccgctttgccatcacaggccaccgtaaaaaacgcgacaaagcacgcgttacctcgtctctcggcgacattcccggtgtaggcagcaaacgccgccaagccctgcttacccgcttcggcggactgcgcggcgtgattgccgccagccgcgaggacttggaaaaagtggaaggcatcagcaaggcattggcggaaaccatttataatcatctgcat

SEQ ID NO: 4030 - protein, 628 aa, Neisseria gonorrhoeae
MPSEAVFQMIDMNTENRSPEQFDIPLFLKNLPKLPGVYRFFDEGGNVLYVGKAVNLKRRVSGYFQKNDHSPRIALMVKQVRHIETTITRSEAEALILENNFIKALSPKYNILFRDDKSYPYLMLSGHQYPQMAYYRGTLKNPNQYFGPYPNSNAVRDSIQVLQKVFMLRTCEDSVFEHRDRPCLLYQIKRCTAPCVGHISEEDYCDSVRQAATFLNGKTDELTRTLQHKMQTAAANLQFEEAARYRDQIQALGIIQSNQFIDSKNPNNPNDIDLLALAVSDGLVCVHWVSIRGGRHVGDKSFFPDTKNDPEPNGQDYAEAFVAQHYLGKSKPDIIISNFPVPDALKEALEGEHGKQMQFVTKTIGERKVWLKMAEQNAQMAITQRHLQQSNQQHRIDELAKILGMNSDGINRLECFDISHTQGEATIASCVVYDEQNIQPSQYRRYNITTAKPGDDYAAMREVLTRRYGKIQEAEANGESVKWPDVVLIDGGKGQIGVAVSVWEELGLHIPLVGIAKGPERKAGMEELILPFTGELFRLPPNSPALHLLQTVRDESHRFAITGHRKKRDKARVTSSLGDIPGVGSKRRQALLTRFGGLRGVIAASREDLEKVEGISKALAETIYNHLH

SEQ ID NO: 4031 - DNA, 2325 bp, Neisseria gonorrhoeae
gtgttgggacattgtttttcctttgctgtgtcaagttttcggattctacccgaattatcggcgcgtttgagaaattttgaccataccggcgttcagacggcatcccgcagccttgactgccgtctgaacatcaaaacgggaatcaaacttatgcaacaaaaaatccgtttccaaatcgaggggatgacctgtcaggcatgtgcttcgcgcattgaaaaagtgttgaacaaaaaagattttgtcgaatcggcgggagtgaactttgccagtgaggaagcgcaggttacgtttgacggcagcaaaacctcggttgccgacattgccaaaatcattgagaaaaccggttacggcgcgaaggaaaaaacggaagatacattgccgcaacctgaagcagaacaccatatcggctggcggttgtggcttttgctgaccatcaatatcccgttccttatcggtatggtagggatgatgctaaaagggctgaattggacacggcacgattggatgattccgcctgtatggcagtttgtactggcaagcatagtgcaactttggctggcaatcccgttttacaaaagcgcgtgggcaagcattaaaggcgggctggcgaatatggacgtactcgttaccatcggcacggtgtcgatttacctgtattccgtttatatgctgtttttcagttcgcatgcggcgcacggtatggcgcatgtgtattttgaagcgggcgtgatggtgatcggttttgtgtcgctgggtaagtttttggaacaccgcaccaaaaaatccagcctgaacagcttgggcttactgctaaaactcacgccgacccaagtcaacgtgcaacgcaacggcgaatggaaacaactgcccatcgaccaagtgcaaatcggcgaccttatccgcaccaaccacggcgaacgcatcgctgccgacggcattatcgaaagcggcagcggttgggcggacgaaagccaccttaccggcgaatccaatcccgaagagaaaaaggcgggcggcaaagtgttggcgggcgcgctgatgaccgaaggcagcgtggtgtaccgcgccgcgcagctcggcagccaaaccctgctcggcgacatgatgaacgcgctctctgaagcacaaggcagtaaagcaccgattgcgcgcgtggccgataaagcggcggcggtatttgtgccaactgtcgtgggcatcgcgcttctgacttttatcgttgcttggctgattaagggcgattggacggtcgcactgatgcacgccgttgccgttttggtgattgcctgcccgtgcgcgctcggtctggcgacccctgccgcgattatggtcggcatgggcaaagcggtgaaacacggcatttggtttaaagacgcggcggcaatggaggaagcagcccacgtcgatgccgtcgtattggacaaaaccggtacgctgaccgaaggcaggccgcaggttgccgccgtttattacgttcccgacagcggctttgacgaagacgctttgtaccgcatcgccgccgccgtcgagcaaaacgccgcccacccgctcgcccgcgccatcgtctccgccgcacaagcgcgcggtttggagattcccgctgcacaaaatgcgcaaaccgttgtcggagcaggcattaccgccgaagtggaaggcgtgggtttggtgaaatcaggcaaagccgaatttgccgaactgaccttgccgaagttttcagacggcgtttgggaaatcgccagtgcggttaccgtatctgtaaacggcaaaccgatcggcgcattcgcactctccgacgcgttgaaagccgataccgccgaagccataggccgtctgaaaaaacacaatatcgatgtctatattatgagcggcgataaccaaagtacggtcgaatacgtcgccaaacaactgggcatcgcacacgccttcggtaatatgagtccgtgcgacaaagccgccgaagtgcagaaactcaaagccgccggcaaaaccgtggcgatggtcggcgacggcatcaacgacgcgcccgcgcttgccgccgccaacgtcagcttcgccatgaaaggcggtgcggacgttgccgaacacaccgcctccgccacgctgatgcagcattcggtcaatcagctcgccgatgccctgctgatatcgcaggcaacgttggaaaacatcaagcaaaacctatttttcgccttcttctacaatatattgggcattccgctcgccgcgctcggctttttaaatcccgtcatagcaggcgcggcaatggcggcaagctcggtttcggtattgggcaatgccctgcgcctgaaatgggtaaaaatcgat

SEQ ID NO: 4032 - protein, 775 aa, Neisseria gonorrhoeae
VLGHCFSFAVSSFRILPELSARLRNFDHTGVQTASRSLDCRLNIKTGIKLMQQKIRFQIEGMTCQACASRIEKVLNKKDFVESAGVNFASEEAQVTFDGSKTSVADIAKIIEKTGYGAKEKTEDTLPQPEAEHHIGWRLWLLLTINIPFLIGMVGMMLKGLNWTRHDWMIPPVWQFVLASIVQLWLAIPFYKSAWASIKGGLANMDVLVTIGTVSIYLYSVYMLFFSSHAAHGMAHVYFEAGVMVIGFVSLGKFLEHRTKKSSLNSLGLLLKLTPTQVNVQRNGEWKQLPIDQVQIGDLIRTNHGERIAADGIIESGSGWADESHLTGESNPEEKKAGGKVLAGALMTEGSVVYRAAQLGSQTLLGDMMNALSEAQGSKAPIARVADKAAAVFVPTVVGIALLTFIVAWLIKGDWTVALMHAVAVLVIACPCALGLATPAAIMVGMGKAVKHGIWFKDAAAMEEAAHVDAVVLDKTGTLTEGRPQVAAVYYVPDSGFDEDALYRIAAAVEQNAAHPLARAIVSAAQARGLEIPAAQNAQTVVGAGITAEVEGVGLVKSGKAEFAELTLPKFSDGVWEIASAVTVSVNGKPIGAFALSDALKADTAEAIGRLKKHNIDVYIMSGDNQSTVEYVAKQLGIAHAFGNMSPCDKAAEVQKLKAAGKTVAMVGDGINDAPALAAANVSFAMKGGADVAEHTASATLMQHSVNQLADALLISQATLENIKQNLFFAFFYNILGIPLAALGFLNPVIAGAAMAASSVSVLGNALRLKWVKID

SEQ ID NO: 4033 - DNA, 1341 bp, Neisseria gonorrhoeae
atggcaaactgtttgaacccctgccgcaaattacagacggcatctgcacgacagccgcatatgccccccattccgacaaccaacagcgaggttatcatgagtcagagaagagtagtcattacaggcttaggtcaggtttcccctgtcggcaacactgccgcagaggcttgggacaacctgctcgccggcaaaagcggcatcggcgcgattacccgctttgacgcatccgacatcaacagccgtgtcgccggcgaagtgcgcggtttcgacatcggacaatacatcagcgcgaaagaagcgcgccggatggacgtgttcatccactacggcatcgccgccgcattgcaggcgattgccgattcgggtttggacgatgtggaaaacctcgacaaagaccgcatcggcgtgaacatcggttccggcatcggcggactgcccagcatcgaggccaccggcaaagccgtaatcgaaggcggcgcgcgcaaaatcaaccctttctttatccccggttcgctgatcaacctgatttccggacacgttaccatcctcaaaggctaccgcggcccgagctacggcatggtttccgcctgtaccaccggcgcgcacgccatcggcgattccgcccgactgatcaaatacggcgacgcggacataatggttgccggcggcgcggaaggcgcaatcagcaccttgggcgtgggcggttttgctgcgatgaaagccctctccacccgcaacgacgaccccgccaccgcttcccgtccgtgggacaaaggccgcgacggcttcgtcatcggcgaaggcgcgggcatattggtgttggaagaattagaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctgcaaaaccgtcatcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggtacgctggtcttcaaacgcttcaaaggc

SEQ ID NO: 4034 - protein, 447 aa, Neisseria gonorrhoeae
MANCLNPCRKLQTASARQPHMPPIPTTNSEVIMSQRRVVITGLGQVSPVGNTAAEAWDNLLAGKSGIGAITRFDASDINSRVAGEVRGFDIGQYISAKEARRMDVFIHYGIAAALQAIADSGLDDVENLDKDRIGVNIGSGIGGLPSIEATGKAVIEGGARKINPFFIPGSLINLISGHVTILKGYRGPSYGMVSACTTGAHAIGDSARLIKYGDADIMVAGGAEGAISTLGVGGFAAMKALSTRNDDPATASRPWDKGRDGFVIGEGAGILVLEELEHAKKRGAKIYAEIVGFGMSSDAYHITAPNEEGPALAVTRALKDAGINPEDVDYVNAHGTSTPLGDANETKALKRAFGEHACKTVISSTKSMTGHLLGAAGGVEAVYSILAIHDGKIPPTINIFEQDVEAGCDLDYCANEARDAEIDVAISNSFGFGGTNGTLVFKRFKG

SEQ ID NO: 4035 - DNA, 660 bp, Neisseria gonorrhoeae
gtgtgttatcttcatatttcgagggtaacatatctgctaatctggtacagacccttgtcttatcgtttgaatgctgcaccgatgtttaacgataatcctgttgtttacggaaaaatcaaattgcagagttggaaagcgcggcgggatttcaatattgtaaagcaggatttggatttttcctgcggggcggcttcggtggcgacgcttttgaacaatttttacgggcaaaagctgacggaagaagaagtgttggaaaaactgggtaaggaacagatgcgcgcgtcgtttgaggatatgcggcgcattatgcccgatttgggttttgaggcgaaaggctatgccctgtctttcgaacagctcgcgcagttgaaaatccccgtcatcgtgtatctgaaataccgcaaagacgaccatttttcggtattgcgcggagtggatggcaatacggttttgcttgccgacccgtcgccgggtcatgtttcgatgagcagggcgcagtttttggaggcttggcaaacccgtgagggaaatttggcaggcaaaattttggcggtcgtgccgaaaaaagcggaggcgatttcaaataaattgtttttcacacatcatcccaagcggcagacggagtttgcagtcggacaggtaaaatggtggcgtgcttat

SEQ ID NO: 4036 - protein, 220 aa, Neisseria gonorrhoeae
VCYLHISRVTYLLIWYRPLSYRLNAAPMFNDNPVVYGKIKLQSWKARRDFNIVKQDLDFSCGAASVATLLNNFYGQKLTEEEVLEKLGKEQMRASFEDMRRIMPDLGFEAKGYALSFEQLAQLKIPVIVYLKYRKDDHFSVLRGVDGNTVLLADPSPGHVSMSRAQFLEAWQTREGNLAGKILAVVPKKAEAISNKLFFTHHPKRQTEFAVGQVKWWRAY

SEQ ID NO: 4037 - DNA, 102 bp, Neisseria gonorrhoeae
ttgcaggatattgttgcgggtcaaatgccggccggagggtatagtgaattaacaaaaaccggtacggcgttgccccgccccggctcaaagagaacgattccc

SEQ ID NO: 4038 - protein, 34 aa, Neisseria gonorrhoeae
LQDIVAGQMPAGGYSELTKTGTALPRPGSKRTIP

SEQ ID NO: 4039 - DNA, 948 bp, Neisseria gonorrhoeae
atgtcccaacaccgcaaactgattattttgggttccggccccgccggatacaccgccgccgtctatgccgcacgtgccaatttaaaccccgtcattattacaggtatcgcgcaaggcgggcaactgatgacaacgactgaagtggacaactggcctgccgatgccgacggcgtgcaagggccggaattgatggcgcggtttctcgcccacgccgaacgtttcggaacggaaatcatttttgaccaaatcaacgccgtcgatctgcaaaaacgcccgttcgcactcaaaggcgatatgggcgagtacacttgcgatgccctgattgtcgccaccggcgcgtccgccaaataccttggtttgccgagtgaggaagcgtttgcagggaaaggcgtttccgcctgcgccacctgcgacggtttcttctacaaaaatcaagatgttgccgtagtcggcggcggcaatacggcagttgaggaggcactctaccttgccaatatcgccaaaaccgttacgctgattcaccgccgcagcgagttccgtgctgaaaaaatcatgattgacaaactgatgaaacgcgtggaagagggcaaaatcatcctcaagctggaaagcaacctgcaagaagtactgggcgacgatcggggcgtaaatggcgcattattaaaaaacaacgacggttctgatcaacaaattgccgtcagcggcatctttatcgccatcgggcacaagccgaataccgatattttcaaagggcagttggaaatggacgaagccggctacctgaaaacaaaaggcggcacggcggacaatgtcggtgcaaccaatatcgaaggcgtatgggcggcgggcgacgtaaaagaccatacctaccgtcaggcaattaccagcgcggcctccggctgtcaggcggctttggacgcggaacgttggctgggcagccaaaacatt

SEQ ID NO: 4040 - protein, 316 aa, Neisseria gonorrhoeae
MSQHRKLIILGSGPAGYTAAVYAARANLNPVIITGIAQGGQLMTTTEVDNWPADADGVQGPELMARFLAHAERFGTEIIFDQINAVDLQKRPFALKGDMGEYTCDALIVATGASAKYLGLPSEEAFAGKGVSACATCDGFFYKNQDVAVVGGGNTAVEEALYLANIAKTVTLIHRRSEFRAEKIMIDKLMKRVEEGKIILKLESNLQEVLGDDRGVNGALLKNNDGSDQQIAVSGIFIAIGHKPNTDIFKGQLEMDEAGYLKTKGGTADNVGATNIEGVWAAGDVKDHTYRQAITSAASGCQAALDAERWLGSQNI

SEQ ID NO: 4041 - DNA, 366 bp, Neisseria gonorrhoeae
atgcgtcattacgagatcgtgtttatcgttcatcctgatcaaagcgagcaagtgcccgctatggttgaacgttacaaaaccatgattaccgaggcaaacggtaagattcaccgtttggaagattggggccgccgccaactggcttacccgattaacaaaatccataaagcacattatgttttgatgaacatcgaaaccactcccgaagttgttggggagttggaaaccgcgttccgtttcaatgatgcggtattgcgtcatctgaccatcaaaaccaaacacgccgttaccgaagcctcccctatgctgggcggcgaaaaggctaagaacctgttggtcggcgcggctgaagaagcggctgcccaa

SEQ ID NO: 4042 - protein, 122 aa, Neisseria gonorrhoeae
MRHYEIVFIVHPDQSEQVPAMVERYKTMITEANGKIHRLEDWGRRQLAYPINKIHKAHYVLMNIETTPEVVGELETAFRFNDAVLRHLTIKTKHAVTEASPMLGGEKAKNLLVGAAEEAAAQ

SEQ ID NO: 4043 - DNA, 567 bp, Neisseria gonorrhoeae
ttgggcagccgcttcttcagccgcgccgaccaacaggttcttagccttttcgccgcccagcataggggaggcttcggtaacggcgtgtttggttttgatggtcagatgacgcaataccgcatcattgaaacggaacgcggtttccaactccccaacaacttcgggagtggtttcgatgttcatcaaaacataatgtgctttatggattttgttaatcgggtaagccagttggcggcggccccaatcttccaaacggtgaatcttaccgtttgcctcggtaatcatggttttgtaacgttcaaccatagcgggcacttgctcgctttgatcaggatgaacgataaacacgatctcgtaatgacgcatgttatctccttatggatggtaaaaacagccttctgccatgcgaaagcagaaggcaaggttcaaatagcaggcattatattggggtttgccgacggaatcaaggatttggtacgaaaaacttgcattccgccgaaaatttcggtttcagacggcattcaaatgttttggctgcccagccaacgttccgcgtccaaagccgcc

SEQ ID NO: 4044 - protein, 189 aa, Neisseria gonorrhoeae
LGSRFFSRADQQVLSLFAAQHRGGFGNGVFGFDGQMTQYRIIETERGFQLPNNFGSGFDVHQNIMCFMDFVNRVSQLAAAPIFQTVNLTVCLGNHGFVTFNHSGHLLALIRMNDKHDLVMTHVISLWMVKTAFCHAKAEGKVQIAGIILGFADGIKDLVRKTCIPPKISVSDGIQMFWLPSQRSASKAA

SEQ ID NO: 4045 - DNA, 300 bp, Neisseria gonorrhoeae
ttgggattcactaatcttgtttcgcttgccgcgctgattgaaaaggctttccctattcgatatacgcctgccggaatccctgttttagatattattttaaagcacgaatcgtggcaggaggaaaatgggcagcaatgccttgtccaattggaaatccccgcgcggattttgggtaggcaggcggaagagtggcagtatcggcaaggcgactgcgcaacagtcgaaggttttttagctcaaaaaagcagacgttccctgatgccgatgctcaggatacaaaatattaaagaatataaaggt

SEQ ID NO: 4046 - protein, 100 aa, Neisseria gonorrhoeae
LGFTNLVSLAALIEKAFPIRYTPAGIPVLDIILKHESWQEENGQQCLVQLEIPARILGRQAEEWQYRQGDCATVEGFLAQKSRRSLMPMLRIQNIKEYKG

SEQ ID NO: 4047 - DNA, 228 bp, Neisseria gonorrhoeae
atggctcgtcaatcattcaaacgtagaaaattctgccgtttcacggctgaaaaaatccaagaagtcgattacaaacaagttgatttgctgaaagactttatctctgaaaacggtaaaatcattcctgcccgcatcacaggaacgaaggcattctaccaacgccaattggctgttgccgtaaaacgcgcgcgcttcttggcactcctgccttataccgaccaacacaaa

SEQ ID NO: 4048 - protein, 76 aa, Neisseria gonorrhoeae
MARQSFKRRKFCRFTAEKIQEVDYKQVDLLKDFISENGKIIPARITGTKAFYQRQLAVAVKRARFLALLPYTDQHK

SEQ ID NO: 4049 - DNA, 321 bp, Neisseria gonorrhoeae
atgaaagagtttgaagcacgccgcgccgaattggaagccaaacaggccgaaattttggcagatgcccgagcccgtcaggaaaaactggacggtcaaaccgttaccgttgcacagaaagccggtgtggacggccgcctgttcggttccgttaccaatgccgacattgctgccgcaatcgttgctgccggcatcgaagccgtgaaagcaaatgtacgtctgccgaacggtcctctgaaagccgttggagagtacgaagtggaagtggctttacacactgatgccgttgctaaaattactgttgccgtcattgccgcagccgag

SEQ ID NO: 4050 - protein, 107 aa, Neisseria gonorrhoeae
MKEFEARRAELEAKQAEILADARARQEKLDGQTVTVAQKAGVDGRLFGSVTNADIAAAIVAAGIEAVKANVRLPNGPLKAVGEYEVEVALHTDAVAKITVAVIAAAE

SEQ ID NO: 4051 - DNA, 129 bp, Neisseria gonorrhoeae
atgccgtctgaaaccctgccgattatcagaatgtggtttcagacggcatttgttttgttttccgtatattctgcaaaaatcgggacggttgttttttatttgcctgaggtctttgcagaaatggtttgt

SEQ ID NO: 4052 - protein, 43 aa, Neisseria gonorrhoeae
MPSETLPIIRMWFQTAFVLFSVYSAKIGTVVFYLPEVFAEMVC

SEQ ID NO: 4053 - DNA, 177 bp, Neisseria gonorrhoeae
atgcatcaaatttcgttaacaaaccatttctgcaaagacctcaggcaaataaaaaacaaccgtcccgatttttgcagaatatacggaaaacaaaacaaatgccgtctgaaaccacattctgataatcggcagggtttcagacggcatctgataatttcaattactcggctgcggcaa

SEQ ID NO: 4054 - protein, 59 aa, Neisseria gonorrhoeae
MHQISLTNHFCKDLRQIKNNRPDFCRIYGKQNKCRLKPHSDNRQGFRRHLIISITRLRQ

SEQ ID NO: 4055 - DNA, 1806 bp, Neisseria gonorrhoeae
atggtggcgtgcttattgaaatttcgacaaaggtcgtctgaaaaccgaaaacatggtttcagacgacctttgttgtatttggtaactatatgttcccgttgtataattacggatttgcaattcaataataaatacacaggaaccgccatgacagaatccatcacccgcgacagtatgcaatacgatgtcgtgattgtcggcgcaggcccgtcggggttgtccgccgccatcaaactcaagcagcttgccgaacagaacgggcgcgaaatcagcgtttgcgtggtggagaagggttcggaggcgggggcgcattcgctggcgggcgcggttatcgatccgattgcgctgaatgagctgattcccgactggaaagaaaaaggcgcgccgctgacgcgcacggtaactcaggacaaggtgttgttcctgacggagaaaaaagcgttcaatctgcctattaccccgaatttcgacaatcacggcaactacatcgtcagcttaggcgaagtcgtgcgctggttggcggagcaggcggaaaatatgggcgtggaaatctatccgggctttgccgccgccgaagtgctgtatcacgaagacggctcggtcaaaggtattgcgaccggcaatatgggtgtaggcaaagacggcgggccgaccgacagtttccagcccggcatggagctttgggcgcggcaaaccctgtttgccgaaggttgccgaggttcgctttccaagcaaatcatcgaacgtttccaactcgaccaaaacagccagccgcaaacttacggcttgggcatcaaagaagtttgggaagtgccgtctgaacagcatcagcccggtttggtggtgcatagcgcaggctggccgctggacagcaaaacctacggcggtgcgtttatttaccatttcgacgacaacaaagtcgccgtcggcttcgtggtcggtttggactatcaaaacccgtatctgtcgccgtttgaagagttccaacgtttcaaaacccatcccgaaatccgcaaaacctttgaaggcggccgccgcattgcttacggcgcgcgttcgctgattgaaggcggtttgcaaagcctgccgaagctctcgttcaaggggggcgttttaatcggcgatgcggcggggttcctcaatatgccgcgcatcaaaggcattcatacctcgatgaaatccgccatgctcgccgccgaagccgtgttccccttgttggaaaactttgaagaagtggaaagcttcgacagcggcaaagaagcgggaaactatcaaaaactgtttgaacaaagctggctgtatcaagagctttatgccgcgcgcaatgtccgtccgtcattcaaatggggcgtttacctcggctcgctttataccggcatcgaccagatgattttcagaggcaaagccccgtggaccttgaaacatcacggcaaagacaacgagcagctcaaaaaagccgccgtgtgcaagccgattgattatccgaaacccgacggtgtgttgacctttgaccgcttgagcagcgtcttccttgccaatctcgcgcacgaagaaaaccagcccgaccatttggtgctgaacaatccgcaaacgatgatagacgtgaactataaagaatacgcctctcccgaaacgcgctattgtccggccggcgtatatgaaatcatcgaagaaaacggcagtccgcgcctgcaaatcaacgcggcaaactgcgtgcactgcaaaacctgcgacatcaaagacccgacgcaaaacatcacttggatttgccccgaaggcgcaagcggaccgaattacggcgggatg

SEQ ID NO: 4056 - protein, 602 aa, Neisseria gonorrhoeae
MVACLLKFRQRSSENRKHGFRRPLLYLVTICSRCIITDLQFNNKYTGTAMTESITRDSMQYDVVIVGAGPSGLSAAIKLKQLAEQNGREISVCVVEKGSEAGAHSLAGAVIDPIALNELIPDWKEKGAPLTRTVTQDKVLFLTEKKAFNLPITPNFDNHGNYIVSLGEVVRWLAEQAENMGVEIYPGFAAAEVLYHEDGSVKGIATGNMGVGKDGGPTDSFQPGMELWARQTLFAEGCRGSLSKQIIERFQLDQNSQPQTYGLGIKEVWEVPSEQHQPGLVVHSAGWPLDSKTYGGAFIYHFDDNKVAVGFVVGLDYQNPYLSPFEEFQRFKTHPEIRKTFEGGRRIAYGARSLIEGGLQSLPKLSFKGGVLIGDAAGFLNMPRIKGIHTSMKSAMLAAEAVFPLLENFEEVESFDSGKEAGNYQKLFEQSWLYQELYAARNVRPSFKWGVYLGSLYTGIDQMIFRGKAPWTLKHHGKDNEQLKKAAVCKPIDYPKPDGVLTFDRLSSVFLANLAHEENQPDHLVLNNPQTMIDVNYKEYASPETRYCPAGVYEIIEENGSPRLQINAANCVHCKTCDIKDPTQNITWICPEGASGPNYGGM

SEQ ID NO: 4057 - DNA, 147 bp, Neisseria gonorrhoeae
atgaaaaccgccgacatcccgcctgcgggcggcaaacgggacagaatcggatgcgattataccttatttaggcggctgtccggcatttatgcgcacacaataaatcttgcaggatattgttgcgggtcaaatgccggccggagggta

SEQ ID NO: 4058 - protein, 49 aa, Neisseria gonorrhoeae
MKTADIPPAGGKRDRIGCDYTLFRRLSGIYAHTINLAGYCCGSNAGRRV

SEQ ID NO: 4059 - DNA, 171 bp, Neisseria gonorrhoeae
ttgtatgccggtcattatggcggaaataccgtttgggaggcagtcgcatcgcatggagtcggcacggcaggcgatgcgccgatgccttcgggcgtgaaggcagggaaatcggcagtttggaaaaaggcaatggaatccgcaggtaggtgtcgattgggtggtgaaaggcaa

SEQ ID NO: 4060 - protein, 57 aa, Neisseria gonorrhoeae
LYAGHYGGNTVWEAVASHGVGTAGDAPMPSGVKAGKSAVWKKAMESAGRCRLGGERQ

SEQ ID NO: 4061 - DNA, 168 bp, Neisseria gonorrhoeae
gtgcgcccgacttattgcctttcaccacccaatcgacacctacctgcggattccattgcctttttccaaactgccgatttccctgccttcacgcccgaaggcatcggcgcatcgcctgccgtgccgactccatgcgatgcgactgcctcccaaacggtatttccgcca

SEQ ID NO: 4062 - protein, 56 aa, Neisseria gonorrhoeae
VRPTYCLSPPNRHLPADSIAFFQTADFPAFTPEGIGASPAVPTPCDATASQTVFPP

SEQ ID NO: 4063 - DNA, 804 bp, Neisseria gonorrhoeae
atgtggcattgggacattatcttaatcctgcttgccgtaggcagtgcggcaggttttattgccggcctgttcggtgtaggcggcggtacgctgattgtccctgtcgttttatgggtgcttgatttgcagggtttggcacaacatccttacgcgcaacacctcgccgtcggcacatccttcgccgtcatggtcttcaccgccttttccagtatgttggggcagcacaaaaaacaggcggtcgactggaaaaccatatttgcgatgatgccgggtatgatattcggcgtattcgctggcgcactctccgcaaaatatatccccgcgttcgggcttcaaattttcttcatcctgtttttaaccgccgtcgcattcaaaacactgcataccggtcgtcagacggcatcccgcccgctgcccgggctgcccggactgactgcggtttccacactgttcggcgcaatgtcgagctgggtcggcataggcggcggttcactttccgtccccttcttaatccactgcggcttccccgcccataaagccatcggcacatcatccggccttgcctggccgattgcactctccggcgcaatatcgtatctggtcaacggtctgaatattgcaggattgcccgaagggtcgctgggcttcctttacctgcccgccgtcgccgtcctcagcgcggcaaccattgcctttgccccgctcggtgtcaaaaccgcccacaaactttcttctgccaaactcaaagaatccttcggcattatgttgcttttgattgccggaaaaatgctgtacaacctgctt

SEQ ID NO: 4064 - protein, 268 aa, Neisseria gonorrhoeae
MWHWDIILILLAVGSAAGFIAGLFGVGGGTLIVPVVLWVLDLQGLAQHPYAQHLAVGTSFAVMVFTAFSSMLGQHKKQAVDWKTIFAMMPGMIFGVFAGALSAKYIPAFGLQIFFILFLTAVAFKTLHTGRQTASRPLPGLPGLTAVSTLFGAMSSWVGIGGGSLSVPFLIHCGFPAHKAIGTSSGLAWPIALSGAISYLVNGLNIAGLPEGSLGFLYLPAVAVLSAATIAFAPLGVKTAHKLSSAKLKESFGIMLLLIAGKMLYNLL

SEQ ID NO: 4065 - DNA, 627 bp, Neisseria gonorrhoeae
atgcacggacgttatgaaaccgccgccatcgcggtattcatctctatgttgctggacggtatggacgggcgcgtggcgcggctgaccaacagccaaagcgcgttcggggagcagctcgacagccttgccgacatggtcagcttcggcgttgcccccgcgcttattgcctacaaatggcagctttggcagttcggcaaaatcggttattccgtcgccttcatctactgcgcctgcgccgccctacgcctcgcgctgttcaacacgctcatcggcaaggtggacaaacgctggtttatcggcgtacccagtccgactgccgccgcgctgattgtcgggctgatttgggtcaaccacagcgtcgaaaaattccccgccgtccactggtgggcattaggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtccttttcctgttctttctcggatacagcctgtccggctacattatggcggcacgccgattttggaaaaaatacagaaaggcggat

SEQ ID NO: 4066 - protein, 209 aa, Neisseria gonorrhoeae
MHGRYETAAIAVFISMLLDGMDGRVARLTNSQSAFGEQLDSLADMVSFGVAPALIAYKWQLWQFGKIGYSVAFIYCACAALRLALFNTLIGKVDKRWFIGVPSPTAAALIVGLIWVNHSVEKFPAVHWWALGITLFAGLSMIVQIPFWSFKEINIRRQVPFVGMLLAVLLLLLVTWEPSLVLFLFFLGYSLSGYIMAARRFWKKYRKAD

SEQ ID NO: 4067 - DNA, 93 bp, Neisseria gonorrhoeae
ttgcccgcaatgccgtctgaaaacaacggcttgccgctaaggcggcaatatgaggatttgcgctgccgaaaccggtttgctacaacccggcag

SEQ ID NO: 4068 - protein, 31 aa, Neisseria gonorrhoeae
LPAMPSENNGLPLRRQYEDLRCRNRFATTRQ

SEQ ID NO: 4069 - DNA, 363 bp, Neisseria gonorrhoeae
ttgttttcagacggcattgcgggcaacctttgcggcgggcgaaaaaccttgtcctataatttatcccgcttcaaaatcagcatacggtcggaaatgcaaaaaatatctttcaatttgttgaaacctacaaactccctgaaaatagggaaataccgccccggtttgaacggcgcgccgcatattccgatgccttccctccgataccttccggcaagcgcagaaatgcccggcaacaatatccatccggcaaaatccgaaacaacacacccggtggcaggcagagtcaaaccgccccgcaaagcatccgccatcagaaaaacaaaccgcctccgagggcttcatcctaaagggcgtattgttcga

SEQ ID NO: 4070 - protein, 121 aa, Neisseria gonorrhoeae
LFSDGIAGNLCGGRKTLSYNLSRFKISIRSEMQKISFNLLKPTNSLKIGKYRPGLNGAPHIPMPSLRYLPASAEMPGNNIHPAKSETTHPVAGRVKPPRKASAIRKTNRLRGLHPKGRIVR

SEQ ID NO: 4071 - DNA, 480 bp, Neisseria gonorrhoeae
atgatgaaaaagatactggcagtatcggcactatgcctgatgactgcggcggcacaggctgccgatacttacggctatctcgccgtttggcagaatccgcaggatgcaaacgatgttttgcaggttaaaaccacaaaagaagattcggcgaaaagcgaagcgtttgccgagttggaagccttttgcaaaggtcaggacacgcttgcgggcattgccgaagacgagccgaccggatgccggtcggtcgtgtcgctgaacaatacctgtgtctcgctggcatacccgaaagccttgggcgcgatgcgcgttgaaaacgccgtcgtgattacttctccgcgttttacgagcgttcatcaggtcgcactcaaccagtgcataaaaaaatacggcgcacagggacaatgcggcttggaaacagtgtattgcacgtcatcttcttattacggcggggctgttcgctccttaatccaacacctgaaa

SEQ ID NO: 4072 - protein, 160 aa, Neisseria gonorrhoeae
MMKKILAVSALCLMTAAAQAADTYGYLAVWQNPQDANDVLQVKTTKEDSAKSEAFAELEAFCKGQDTLAGIAEDEPTGCRSVVSLNNTCVSLAYPKALGAMRVENAVVITSPRFTSVHQVALNQCIKKYGAQGQCGLETVYCTSSSYYGGAVRSLIQHLK

SEQ ID NO: 4073 - DNA, 126 bp, Neisseria gonorrhoeae
atgcttacattttcaagtaaatccaaacagaaatgccgtctgaacgttgaagccaaggttcagacggcattttttgtcataggttcaaacggggcaggttcgaacaactgccccattccttattcc

SEQ ID NO: 4074 - protein, 42 aa, Neisseria gonorrhoeae
MLTFSSKSKQKCRLNVEAKVQTAFFVIGSNGAGSNNCPIPYS

SEQ ID NO: 4075 - DNA, 1233 bp, Neisseria gonorrhoeae
ttgaaccgattgaaagaagatggtatgaaccaactgaaacttgccgtttccggcgcgcagattttatttgtggcattcggcgcaatggtgctggttcccctgctgaccggtctgaatccggctcttgcgcttttgggcgcaggcttgggaacgctgctgttccaaatcacaaccaaacgcaaagtaccgatttttctcggttcttcgtttgcctttatcgcgccgattatctactccgtcggcgaatgggggctgccttccaccatgttcgggctgtttgccgccggctttatgtattttgtgtttgccgcgctgatccgttggcgcggactggcggcggtacacaaactgctgccgccggtcgtcaccggccctgtcatcatggtcatcggtctgtctgttgccgtggcggcaagcagcatggcaatgggtcaggctgacggcaaacaggtcatcgactataccgattcgctgattctttccggctttacctttgccgttaccgccatcgtatcggttttcggcagcaggatgatgaagctgattcccatcttgatcggtgtcgcttcgggttatgttttggcactgctgatgggactggtggacacgacaagcattgcacacgcgccctggttcgccgttccccattttgaaacgcctcaggtcaactggcaggcggcactgtttatgctgcccgttgccgtcgcccccgccatcgaacacatcggcggcatcatggcaatcggcaatgtaacgggaaaagactacacaaaagacccgggcttggacaaaacccttgcgggcgacggcttgggcgtgtgcgttgcgggtctgatcggcggcccgccggttacaacctacggcgaagtaacgggtgcggtgatgattaccaaaaacagcaaccccgtcatcatgacttgggcggcggtttttgccgtctgcatggcgtttttcggcaaattcaatgcgtttttggcttccattccgatgcccgtgatgggcggcattatgctgctgctgttcggcacgattgcttctttaggcatcaaaaccctgattgatgccaaagtcgatttgatgctgccgaaaaacctggtcatcgtcagctcggtactgaccacgggcatcggcggtatgacactcaaattgggcagcttcagctttgtcggcgtgggcttgtgcgccgtactcgccattgtgttgaacagcctgctgcccgatccgaaagaatcc

SEQ ID NO: 4076 - protein, 411 aa, Neisseria gonorrhoeae
LNRLKEDGMNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVTGPVIMVIGLSVAVAASSMAMGQADGKQVIDYTDSLILSGFTFAVTAIVSVFGSRMMKLIPILIGVASGYVLALLMGLVDTTSIAHAPWFAVPHFETPQVNWQAALFMLPVAVAPAIEHIGGIMAIGNVTGKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGIKTLIDAKVDLMLPKNLVIVSSVLTTGIGGMTLKLGSFSFVGVGLCAVLAIVLNSLLPDPKES

SEQ ID NO: 4077 - DNA, 102 bp, Neisseria gonorrhoeae
atggagtataatccgacactttccatattcaatccgcaagccgtcccgaacccttatttcagacggcattttccggtaatacggcatgacagaaaaatccca

SEQ ID NO: 4078 - protein, 34 aa, Neisseria gonorrhoeae
MEYNPTLSIFNPQAVPNPYFRRHFPVIRHDRKIP

SEQ ID NO: 4079 - DNA, 270 bp, Neisseria gonorrhoeae
ttgtcggctttcttgttgcgtgcggacgttggggacgggcttcccgccctgccttttgctgtttttttatgggatttttctgtcatgccgtattaccggaaaatgccgtctgaaataagggttcgggacggcttgcggattgaatatggaaagtgtcggattatactccatttctcccgctttcatcctgcaacagacagacgttgcctttcagacggcatatctttgcccgacgtatgtatttttacgcagcccctcggcaaaccagta

SEQ ID NO: 4080 - protein, 90 aa, Neisseria gonorrhoeae
LSAFLLRADVGDGLPALPFAVFLWDFSVMPYYRKMPSEIRVRDGLRIEYGKCRIILHFSRFHPATDRRCLSDGISLPDVCIFTQPLGKPV

SEQ ID NO: 4081 - DNA, 2229 bp, Neisseria gonorrhoeae
atgggtttggcggcaaccctgtatttggcgatttccctgatcagtttcgatatgggcgatccgtcttggtcgcacagttcaccggttgtggaagatgccgccaattggggcggactgttcggcgcgtatgttgccgatgtcggctattatcttttcggctggtcgttctggtggtggatagcggctgcctgcgtcgtgctgtataaaaatttccgtctgcacgcaaaacagacggaaaacgaggcatacaaccacaaaatcgctgccgccgcgctgtttgtcctgacggtcttcagccccgtcttggagtattttgtgctgggcggaaaatatgccgactccctgcctgtcggagcaggcggtatggtcggcatacgtgtcggcgcagtgtttgcgtggctgttggggaaatcgggcagcctgctgattatcctggttgttctgctgttgtcgttgtccctgctggtgcagatttcatggctggaatttttgaacggtgcgggcagggcggttcaaaaccgcctgagtgccttatccggcaaggtcatggctttgagaaaacgccggccgaataccaaaacagacggtgtcgatacccaaaatacacggcgcatggtgaaagaagccaaaaacatcactgccaaacccgttgccttgcccgaaggcagcagcagcaaccgcaaatccgtcgcggtttccgttgcgccgccgcctaaaatccaaccttcgctgtttgaagacaatgaagtacagcagaacggcgaataccacaagcctacattgaacctattgcggattcccgacagcgagccggtcagcatcaatcccgccgaattggagcgcactgccgaactaatcgaatccaaactggcagaattcggcatcggcgtacaagtcgtatccgcgacatccggccccgtcatcacgcgctacgaaatcgaacccgcgcaaggtgtcaaaggcagccaaattgttgccctgtcgaaagatttggcacgctctatgtcgctgcaatccgtgcgtatcgtcgaaaccattgcgggcaaaaacacgatgggcatcgagttgcccaacgacaaacgccaagacgtgatgttgagcgaaatcttgtcctcgcccgtgtttgccgaagccaaatccaagctgaccgtcgcgctgggcaaagacatcgccggtacgcccgtcgtcggcgacttggcgaaaatgccgcaccttttggtcgccggcatgaccggttcgggcaaatccgtcggcgtgaacggcatgattatgtctatgcttttcaaagctacgcccgaagaagtccgcttcattatgatagacccgaaaatgctcgagttgagcatttacgacggcattccgcacctactctgtcccgtcgttaccgatatgcgcgaagcagggcaggcgttgaactggtgcgtcgccgaaatggaaaaacgctaccgcctgctctcccacgccggtgtacgcaatctggaaggcttcaaccaaaaagtcgaacaagccaaagcggcaggcaagccgctgctcaatccgttcagcctgaacctcgacgaacctgagccactggaaaaactgccgatgatcgtggtcgttatcgacgaacttgccgacctgatgatgaccgaacgcaaagctgtcgagcagcaaatcgcccgcctcgcccaaaaagcgcgcgccgccggcatacacatgattgtcgccacccaacgcccaagcgtcgatgtcgtaaccggtctgattaaagccaacatcccgacgcgtatggcgtttaccgtgcaaagcaaaatcgacagccgtaccatcctcgaccaaatgggcgcggacgaactgctcaaatatggcgattcgctgttcctgcaaccgggcagtgccgaaccgacccgcctgcaaggcacgtttgtttcagacggcgaagtgcatcaagtcgtcaactacgtcaaatcgcaagccccagccgactatattgaaggtctgctcagcggcgaagccgcgctggaaactgccaatatcgttaatccgaatgcagacagcgacgaattattcgatcaggcagtcgcctatgttttggaaagcaaaaaaacctccatttcgtctttgcagcggcagttgcgtatcggctataaccgcgcggcaaacctgatggaggcactggaaaatgcgggtatcgtttctccctccgacctcaacggcagccgtaaaattttggcgcacaaggaccattta

SEQ ID NO: 4082 - protein, 743 aa, Neisseria gonorrhoeae
MGLAATLYLAISLISFDMGDPSWSHSSPVVEDAANWGGLFGAYVADVGYYLFGWSFWWWIAAACVVLYKNFRLHAKQTENEAYNHKIAAAALFVLTVFSPVLEYFVLGGKYADSLPVGAGGMVGIRVGAVFAWLLGKSGSLLIILVVLLLSLSLLVQISWLEFLNGAGRAVQNRLSALSGKVMALRKRRPNTKTDGVDTQNTRRMVKEAKNITAKPVALPEGSSSNRKSVAVSVAPPPKIQPSLFEDNEVQQNGEYHKPTLNLLRIPDSEPVSINPAELERTAELIESKLAEFGIGVQVVSATSGPVITRYEIEPAQGVKGSQIVALSKDLARSMSLQSVRIVETIAGKNTMGIELPNDKRQDVMLSEILSSPVFAEAKSKLTVALGKDIAGTPVVGDLAKMPHLLVAGMTGSGKSVGVNGMIMSMLFKATPEEVRFIMIDPKMLELSIYDGIPHLLCPVVTDMREAGQALNWCVAEMEKRYRLLSHAGVRNLEGFNQKVEQAKAAGKPLLNPFSLNLDEPEPLEKLPMIVVVIDELADLMMTERKAVEQQIARLAQKARAAGIHMIVATQRPSVDVVTGLIKANIPTRMAFTVQSKIDSRTILDQMGADELLKYGDSLFLQPGSAEPTRLQGTFVSDGEVHQVVNYVKSQAPADYIEGLLSGEAALETANIVNPNADSDELFDQAVAYVLESKKTSISSLQRQLRIGYNRAANLMEALENAGIVSPSDLNGSRKILAHKDHL

SEQ ID NO: 4083 - DNA, 447 bp, Neisseria gonorrhoeae
atgagcaccttcttccggcaaaccgcccaagccatgactgccaaacacatcggccgcttcccgctatcggagttggaccaggtgattgattggcagccgatcgaacaatacctgatccgtcaaaaaacccgttacctccgagaccgccgcggccgtcccgcccatcccctgtcgtccatgttcaaagccgtcctgcccggacaatggcacagcctctccgatcccgaactcgaacacagcctcatcacccgcatcggtttcaacctgttttgccgttttgacggaccgggcatccccggttgcagcaccttatgccgctaccgtaaattccgctatgcgcgggcagcctatttcgggctgctcaaagtgggtgtgcaaagccacctgaaggcgatgtgtttgaacctgttgaaagccgccaacaggctaagtgcgcccgctgccgcc

SEQ ID NO: 4084 - protein, 149 aa, Neisseria gonorrhoeae
MSTFFRQTAQAMTAKHIGRFPLSELDQVIDWQPIEQYLIRQKTRYLRDRRGRPAHPLSSMFKAVLPGQWHSLSDPELEHSLITRIGFNLFCRFDGPGIPGCSTLCRYRKFRYARAAYFGLLKVGVQSHLKAMCLNLLKAANRLSAPAAA

SEQ ID NO: 4085 - DNA, 93 bp, Neisseria gonorrhoeae
atgcggttcaaatatcgtaccgttgcgctgtttgcttccccatgtagggaagaaggtttatcattttatcaacacaacaaatttaagggctta

SEQ ID NO: 4086 - protein, 31 aa, Neisseria gonorrhoeae
MRFKYRTVALFASPCREEGLSFYQHNKFKGL

SEQ ID NO: 4087 - DNA, 1311 bp, Neisseria gonorrhoeae
atgatgagcgtaactgttgaaattttagaaaatctggaacgcaaagtagtgttgtccctgccttggtccgaaatcaacgcagaaaccgataaaaaactgaaacaaacccaacgccgtgcaaaaatcgacggtttccgtccgggtaaagcacctttaaaaatgattgcccaaatgtacggtgcgagcgcgcaaaacgacgtgatcaacgagctggtgcaacgccgcttctacgatgttgccgttgcccaagagttgaaagtggcaggctatccacgttttgaaggcgttgaagaacaagacgataaagagtctttcaaagttgccgccatttttgaagtgttccccgaagtcgttatcggcgatttgtctgcacaagaggtcgaaaaagtaaccgcttccgtcggcgatgccgaagtcgaccaaactgtagaaatcctgcgtaaacaacgtacccgcttcaaccatgttgaccgcgaagcccgaaacggcgaccgcgtcatcatcgactttgaaggcaaaatcgacggcgaaccttttgccggcggcacatccaaaaactacgccttcgtattgggcgcaggtcaaatgctgcctgaatttgaagccggcgtagtcggcatgaaagcgggcgaaagtaaagacgttaccgtcaacttccctgaagaataccacggcaaagatgttgccggtaaaactgccgtgttcaccattacgctgaacaatgtttccgagcccactctgcctgaagtcgatgcagattttgcaaaagccttgggtattgcggatggcgatgttgccaaaatgcgtgaagaagtgaagaaaaacgtaagccgcgaagtggaacgccgcgtgaacgaacaaaccaaagaatccgtaatgaacgcgctgattaaagccgtagagttgaaagttccggttgctttggtcaatgaagaagccgcccgcctggcaaacgaaatgaaacaaaacttcgttaaccaaggtatgaccgatgccgcgaacttggatttgcctttggatatgttcaaagaacaagccgaacgtcgcgtatctttgggtctgattttggccaaactggttgacgaaaacaaactggaaccgactgaagggcaaatcaaagccgttgtcgccaacttcgcagaaagctacgaagatcctcaagaagtgattgactggtactacgcagatacttcccgcctgcaagccccgacttctttggcagtagaaagcaacgttgttgatttcgttttgggcaaagccaaagtaaacaaaaaagctttgtcttttgacgaagtgatgggcgcgcaagcc

SEQ ID NO: 4088 - protein, 437 aa, Neisseria gonorrhoeae
MMSVTVEILENLERKVVLSLPWSEINAETDKKLKQTQRRAKIDGFRPGKAPLKMIAQMYGASAQNDVINELVQRRFYDVAVAQELKVAGYPRFEGVEEQDDKESFKVAAIFEVFPEVVIGDLSAQEVEKVTASVGDAEVDQTVEILRKQRTRFNHVDREARNGDRVIIDFEGKIDGEPFAGGTSKNYAFVLGAGQMLPEFEAGVVGMKAGESKDVTVNFPEEYHGKDVAGKTAVFTITLNNVSEPTLPEVDADFAKALGIADGDVAKMREEVKKNVSREVERRVNEQTKESVMNALIKAVELKVPVALVNEEAARLANEMKQNFVNQGMTDAANLDLPLDMFKEQAERRVSLGLILAKLVDENKLEPTEGQIKAVVANFAESYEDPQEVIDWYYADTSRLQAPTSLAVESNVVDFVLGKAKVNKKALSFDEVMGAQA

SEQ ID NO: 4089 - DNA, 627 bp, Neisseria gonorrhoeae
atgaaaggagacgaaatgtcttttgataaccatcttgtccctaccgttatcgagcagagcggtcgcggtgagcgtgcattcgatatctattcccggcttttgaaagagcgcatcgtatttctggttggcccggtaaccgatgagtctgctaatctggtggtcgcccaactgttgtttttggaaagtgagaatccggataaggatattttcttctacatcaattcccccggcggctcggtaacggccggtatgtcgatttacgacacgatgaatttcatcaagcccgatgtatcgactttgtgcttggggcaggcggcaagtatgggcgcgttcttattgtcggcaggcgagaaaggcaaacgtttcgccctgcccaacagccggattatgattcaccagcctttaatcagcggcggcttgggcggtcaggcatccgacattgaaatccacgcacgcgagttgttgaaaatcaaagaaaaactcaaccgcctgatggcgaaacattgcggccgcgatttggcagatttggagcgcgacaccgaccgtgataatttcatgtctgccgaagaagcaaaagaatatggtttgatcgaccaagttttggaaaaccgcgcttctttgcggctt

SEQ ID NO: 4090 - protein, 209 aa, Neisseria gonorrhoeae
MKGDEMSFDNHLVPTVIEQSGRGERAFDIYSRLLKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCGRDLADLERDTDRDNFMSAEEAKEYGLIDQVLENRASLRL

SEQ ID NO: 4091 - DNA, 555 bp, Neisseria gonorrhoeae; identical to SEQ ID NO: 143

SEQ ID NO: 4092 - protein, 185 aa, Neisseria gonorrhoeae; identical to SEQ ID NO: 144

SEQ ID NO: 4093 - DNA, 1230 bp, Neisseria gonorrhoeae
atggctaaaaatgggggattttctttgttcgcaaagaaagaaaaacgctttatctttgaaggcaggcattctgcctccgacaaactggtcaacggcgaagtatccgcgtttaccgaagaagaggcacgcaaaaaactggcaaaacgcggcatccgcccgttgcagattacccgtgtgaaaacaagctccaagcgcaaaatcacacaagaagacattaccgttttcacccgccagctttccacgatgattaaagcgggcctgccgctgatgcaggcatttgaaatcgtggcgcgcggacacggcaacccgtctatgacggaaatgctgatggaaatccgaggccaagtggaacagggcagctcgttgagccgcgcattctcaaaccacccgaaatatttcgaccgcttctactgcaacctggttgcggcgggcgaaacgggcggtgtattggaaagcctgctggacaaattggcaatttacaaggaaaaaacccaggccatccgcaaaaaggtaaaaaccgcgctaacctatccggtatccgtcatcgccgtcgccatcggtttggtattcgtgatgatgattttcgtactgcccgcctttaaagaagtttacgccaatatgggcgcggagcttcccccactgacccaaacagtgatggatatgtccgactttttcgtctcatacggctggatggtgctgatcgcactgggctttgccatatacggcttccttaaattgaaggcgcgttcgattaaaatccaacggcgtatggatgccatactgctgcgtatgccgattttcggagacattgtccgcaaagggacgattgcccgctggggcaggacgacggcaacgctgtttgccgccggcgtgcctttggtcgatgtattggactccactgccggcgcggcgggcaatttaatctatgaagaagccacccgggaaatccgtacgcgcgtcatccaaggtctgtctatgacttcggggatgcgtgcgacggaactgttccccaatatgatgttgcagatgtcctccatcggcgaggaatcgggttctttggacgatatgctcaacaaagccgccgaattttacgaagacgaggtggacaatgcggtcggcaggctgtccgctatgatggagccgattattattgtgattttgggcttggtcatcggtacgcttctggtcgctatgtatctgccgctgttcaacttgggcaacgtggtcgcc

SEQ ID NO: 4094 - protein, 410 aa, Neisseria gonorrhoeae
MAKNGGFSLFAKKEKRFIFEGRHSASDKLVNGEVSAFTEEEARKKLAKRGIRPLQITRVKTSSKRKITQEDITVFTRQLSTMIKAGLPLMQAFEIVARGHGNPSMTEMLMEIRGQVEQGSSLSRAFSNHPKYFDRFYCNLVAAGETGGVLESLLDKLAIYKEKTQAIRKKVKTALTYPVSVIAVAIGLVFVMMIFVLPAFKEVYANMGAELPPLTQTVMDMSDFFVSYGWMVLIALGFAIYGFLKLKARSIKIQRRMDAILLRMPIFGDIVRKGTIARWGRTTATLFAAGVPLVDVLDSTAGAAGNLIYEEATREIRTRVIQGLSMTSGMRATELFPNMMLQMSSIGEESGSLDDMLNKAAEFYEDEVDNAVGRLSAMMEPIIIVILGLVIGTLLVAMYLPLFNLGNVVA

SEQ ID NO: 4095 - DNA, 489 bp, Neisseria gonorrhoeae
atccggaacaaccttcatttttggggaaatccgcgtcatgaaagagtccagcagtatggttaccggcccgtcgttgcagagcgacacctgcatatgcgtgcggaaacgccctgtttcgacatgaatcccgtgtccgcgtaacagctccgccgttcgcaggtaaagccgttgcgcctgttctgccggcgcggcttgggaaaacgaaggccgccgcccgcttgccgcgtcggcataaagcgtaaactgcgacaccagcagcaccgcgccgccgacatctttcaaagacaggttcagcttgcccgcttcgtcttcaaacacgcgcaaatgtgcgattttgtcggcgatatagcgtgcatctttttctgtgtcgctatgcgttacaccgagtaacacgacaaacccgccgtcgattttgccgcaggtttccgtgccggcttcggacacgacatccacctttgcacctaccgttttctgtatgaccgcacgcat

SEQ ID NO: 4096 - protein, 46 aa, Neisseria gonorrhoeae
IRNNLHFWGNPRHERVQQYGYRPVVAERHLHMRAETPCFDMNPVSA

SEQ ID NO: 4097 - DNA, 177 bp, Neisseria gonorrhoeae
atgataaaaccgaacctgaggccgaagctcggctcttccgcgctgattgcctttctttccctgtattcttcgctggtattgaattacgccttttttgccaaagttgtcgaacttcgcccttttaacgacaccggggcggacatcttcctctatacgatgccggtggtgctgtttttt

SEQ ID NO: 4098 - protein, 59 aa, Neisseria gonorrhoeae
MIKPNLRPKLGSSALIAFLSLYSSLVLNYAFFAKVVELRPFNDTGADIFLYTMPVVLFF

SEQ ID NO: 4099 - DNA, 573 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttaccaatcatcgtttggccttggctgccgatgaggttttcgagggccccgccgggccgggcgcaagctgtttcggcggacggcgtaaaggcagacgcggtcgcggcgcggtaggaaaagcggttgtcttcggcattccgaaacgcaacgggcgggcctataccgttgccgaggacaatgccgagcctgaaacgttgctccctgccgtcaaaaaaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcgaaaatacaacggaatcgaccgcaaacctttcccgccgttct

SEQ ID NO: 4100 - protein, 191 aa, Neisseria gonorrhoeae
MKITHCKLKKEVQKEPLRSFVPEVTARSAADILGIHPDSAALFYRKIRTVTNHRLALAADEVFEGPAGPGASCFGGRRKGRRGRGAVGKAVVFGIPKRNGRAYTVAEDNAEPETLLPAVKKKSCRTVLFMPIARAAAASRTRAVLPVAASTVPRNLQTVGTTLTALGTFGIRQNAPCENTTESTANLSRRS

SEQ ID NO: 4101 - DNA, 1263 bp, Neisseria gonorrhoeae
atgaacacactccaacgccgcaagacgcatcaagtcctcatcgatcatatcaccgtcggttcagaagcacccgtcgttatccaatctatgaccaacaccgacactgccgatgcaaaagccaccgcattgcagattaaggaattgagcgatgccggctcggaaatggtgcggattaccgtcaacagccccgaagccgcgtccaaagttgccgaaatccgccgccgcttggacgatatgggctatgccacaccactgattggcgatttccattttaacggcgaacgcctgttggcggaatttcccgaatgcggcaaagcattgtccaaataccgcatcaatcccggcaatgtcggcaaaggcgtaaaaggcgatgaaaaatttgcctttatgattcggactgctgctgaaaacgataaagccgtccgtatcggcgtaaactggggttctttggatcagagcctcgccaaacgtatgatggatgccaacctcgtttcttccgcgccgaaaccgcccgaagaagtgatgaaggaagcactgattgtctccgctttggaatctgccgaaaaagccgttctattgggactgcccgaagacaaaatcatcctgtcgtgcaaagtcagcgcggttcatgatttgattcaggtttaccgcgaactgggcagccgttgcgtctatccgctgcatttgggtttgaccgaagccggtatgggcagcaaaggcattgtcgcatcaacggcggcattatctgttttgcttcaagaaggaattggcgacaccatccgcatttcactcactccggaaccgggcagcccgcgtactcaggaggtcgtcgtcgggcaagagattttacagactatgggtttgcgctcgtttacgccgatggttaccgcctgcccgggatgcgggcgtaccaccagtaccgtatttcaagagctggcacaagatgttcaaaattacctgcgccaaaaaatgtctatatggcgtaccctttatcccggggttgaatccctgaacgttgccgtaatgggctgcgttgtcaatggccccggagaaagcaaattggccgacatcggaatcagccttcccggtacgggggaaacacccgtcgcacctgtttatgtagatggggagcgcaaagtcacactgaaaggtaataatattgcaagcgaattcctagctattgtagaggaatatgttaaaaccaattatggcaaaaacagttctaaacgcaataaaggaaaagtcatcccgatacagtctcta

SEQ ID NO: 4102 - protein, 421 aa, Neisseria gonorrhoeae
MNTLQRRKTHQVLIDHITVGSEAPVVIQSMTNTDTADAKATALQIKELSDAGSEMVRITVNSPEAASKVAEIRRRLDDMGYATPLIGDFHFNGERLLAEFPECGKALSKYRINPGNVGKGVKGDEKFAFMIRTAAENDKAVRIGVNWGSLDQSLAKRMMDANLVSSAPKPPEEVMKEALIVSALESAEKAVLLGLPEDKIILSCKVSAVHDLIQVYRELGSRCVYPLHLGLTEAGMGSKGIVASTAALSVLLQEGIGDTIRISLTPEPGSPRTQEVVVGQEILQTMGLRSFTPMVTACPGCGRTTSTVFQELAQDVQNYLRQKMSIWRTLYPGVESLNVAVMGCVVNGPGESKLADIGISLPGTGETPVAPVYVDGERKVTLKGNNIASEFLAIVEEYVKTNYGKNSSKRNKGKVIPIQSL

SEQ ID NO: 4103 - DNA, 795 bp, Neisseria gonorrhoeae
atggcagcagattttaatcggacaacaggggtaattatgccttttaagccatccaaacgaatctctttattacttgttcttgccttgggcgcgtgcagcacttcctaccgcccctcgcgggcagaaaaagccaatcaggtttccaatatcaaaacccagttggcgatggaatatatgcgcggtcaggactaccgtcaggcaacggcaagtattgaagatgccttgaaatcgaaccctaaaaacgaacttgcctggctggtccgtgccgaaatctatcaatacctgaaagttaacgacaaggcgcaggaaagtttccggcaagccctctccatcaaacccgacagtgccgaaatcaacaacaactacggctggttcctgtgcggcaggctcaaccgccctgccgaatctatggcatatttcgacaaagccctggccgaccccacctacccgaccccttatattgccaacctgaataaaggtatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgtgcaggcggcatacgaatatgaagcacaattgcaggcaaatttcccctactcggaagaattgcaaaccgtcctcaccggtcaa

SEQ ID NO: 4104 - protein, 265 aa, Neisseria gonorrhoeae
MAADFNRTTGVIMPFKPSKRISLLLVLALGACSTSYRPSRAEKANQVSNIKTQLAMEYMRGQDYRQATASIEDALKSNPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNVQAAYEYEAQLQANFPYSEELQTVLTGQ

SEQ ID NO: 4105 - DNA, 1092 bp, Neisseria gonorrhoeae
atgaaaaccaatctgctcaactacgaccttcaagggctaacccgacattttgccgatatgggtgaaaaaccattccgcgccaaacaggttatgcgttggatgcaccaatccggcgcgcaaaattttgacgaaatgaccgatttggcaaaatcgttgcgccataaactgaacgaacaggcaagcatcgaaattcccaagctgatgatgtcccaagaatcttcagacggcactcgaaaatggcttttggatgtcggtacggggaacggcgtggaaaccgtcttcatccccgaatcggatcgcggcacgctctgcatttcctcgcaagtcggctgcgctttggaatgtacattttgttcgaccggccggcagggcttcaaccgcaatttaaccgctgccgaaatcatcggacagttgtggtgggcaaacaaagcgatgggcgttacaccgaaaaacgagcgtgtgatttccaacgtcgtcatgatgggcatgggcgagccgatggcgaacttcgacaatgtcgttaccgccttgagcatcatgctggacgaccacggctacggtttgagccgccgccgcgtaaccgtttccacttcgggtatggttccccaaatggacaggttgcgcgatgtcatgccggtggccttggcggtttccctccacgcttccaatgacgaagtccgcaaccaaatcgtaccgttgaacaaaaaatatcccttgaaagaattgatggccgcatgccaacgctatctggtcaaagcgcccagggatttcatcactttcgagtatgtgatgctggacggtgtcaacgataaggcacaacatgcatacgaacttattgaactggtcaaagatgttccctgcaaattcaatttaatcccgtttaatcctttccctaattcgggatatgaacgttcaagtaacgaaaacatccgtattttcagagatatcctgcaacaagccgaatttgtcgttaccgttcgaaaaactcgtggcgacgatatcgatgccgcctgcggacagttggcaggtcaggttcaggataaaacgcgccgccaacaaaaatggcagcagattttaatcggacaacagggg

SEQ ID NO: 4106 - protein, 364 aa, Neisseria gonorrhoeae
MKTNLLNYDLQGLTRHFADMGEKPFRAKQVMRWMHQSGAQNFDEMTDLAKSLRHKLNEQASIEIPKLMMSQESSDGTRKWLLDVGTGNGVETVFIPESDRGTLCISSQVGCALECTFCSTGRQGFNRNLTAAEIIGQLWWANKAMGVTPKNERVISNVVMMGMGEPMANFDNVVTALSIMLDDHGYGLSRRRVTVSTSGMVPQMDRLRDVMPVALAVSLHASNDEVRNQIVPLNKKYPLKELMAACQRYLVKAPRDFITFEYVMLDGVNDKAQHAYELIELVKDVPCKFNLIPFNPFPNSGYERSSNENIRIFRDILQQAEFVVTVRKTRGDDIDAACGQLAGQVQDKTRRQQKWQQILIGQQG

SEQ ID NO: 4107 - DNA, 129 bp, Neisseria gonorrhoeae
ttgatacaatacaccgcccaattcctattcagacggcataaaatatatccatgccgtctgaaaactctgttgcaaaagacttcaaatcaaacttgcctgccctgcaattttttatttgaagccttaatt

SEQ ID NO: 4108 - protein, 43 aa, Neisseria gonorrhoeae
LIQYTAQFLFRRHKIYPCRLKTLLQKTSNQTCLPCNFLFEALI

SEQ ID NO: 4109 - DNA, 423 bp, Neisseria gonorrhoeae
atggcgattgaacgtaccatatccatcatcaaacccgatgccgtcggcaaaaacgttatcggcaaaatatacagccgctttgaggagaacggtctgaaaatcgttgccgccaaaatgaagcagcttaccctcaaagaagcccaagaattttatgcggttcataaagaccgccccttctatgccggattggttgaatttatgaccggcggtccggttatgattcaagtactggaaggcgaaaacgccgttctgaaaaaccgcgaactgatgggggcgaccaatcccaccgaagccgcagaaggcacgatacgcgcggactttgccacttcggtcagcattaacgccgtacacggttccgacagtgtggaaaatgccgctttggaaattgcctactttttcagccaaaccgaaatctgcccccgt

SEQ ID NO: 4110 - protein, 141 aa, Neisseria gonorrhoeae
MAIERTISIIKPDAVGKNVIGKIYSRFEENGLKIVAAKMKQLTLKEAQEFYAVHKDRPFYAGLVEFMTGGPVMIQVLEGENAVLKNRELMGATNPTEAAEGTIRADFATSVSINAVHGSDSVENAALEIAYFFSQTEICPR

SEQ ID NO: 4111 - DNA, 459 bp, Neisseria gonorrhoeae
ttggctgaaaaagtaggcaatttccaaagcggcattttccacactgtcggaaccgtgtacggcgttaatgctgaccgaagtggcaaagtccgcgcgtatcgtgccttctgcggcttcggtgggattggtcgcccccatcagttcgcggtttttcagaacggcgttttcgccttccagtacttgaatcataaccggaccgccggtcataaattcaaccaatccggcatagaaggggcggtctttatgaaccgcataaaattcttgggcttctttgagggtaagctgcttcattttggcggcaacgattttcagaccgttctcctcaaagcggctgtatattttgccgataacgtttttgccgacggcatcgggtttgatgatggatatggtacgttcaatcgccatgctatatccttatttttacttaagaagaatcaaatcggtattctaccaaaaaaa

SEQ ID NO: 4112 - protein, 153 aa, Neisseria gonorrhoeae
LAEKVGNFQSGIFHTVGTVYGVNADRSGKVRAYRAFCGFGGIGRPHQFAVFQNGVFAFQYLNHNRTAGHKFNQSGIEGAVFMNRIKFLGFFEGKLLHFGGNDFQTVLLKAAVYFADNVFADGIGFDDGYGTFNRHAISLFLLKKNQIGILPKK

SEQ ID NO: 4113 - DNA, 180 bp, Neisseria gonorrhoeae
tggtggcttgccggcggcaacaacggcggcaacaacgccgcccacacccaacacacccaagccacacacggacaaagcctcggagaagcagtcaaaaccgccttcaaaaccccaagctacatcctgctgcacctgagctttttcgcctgcggcttccacatcgcctttctcgtaacccac

SEQ ID NO: 4114 - protein, 60 aa, Neisseria gonorrhoeae
WWLAGGNNGGNNAAHTQHTQATHGQSLGEAVKTAFKTPSYILLHLSFFACGFHIAFLVTH

SEQ ID NO: 4115 - DNA, 492 bp, Neisseria gonorrhoeae
atgaagaaaaccctgttggcaattgttgccgttttcgccttaagtgcctgccggcaggcggaagaggcaccgccgcctttaccccggcagattagcgaccgttcggtcggacactattgcagtatgaacctgaccgaacacaacggccccaaagcccagatttttttgaacggcaaacccgatcagcccgtttggttctccaccgtcaagcagatgttcggctataccaagctgcccgaagagcccaaaggcatccgcgtgatttacgttaccgatatgggcaatgttaccgattggacgaatcctaatgccgacacggagtggatagatgcgaaaaaagccttttacgtcatcgacagcggctttatcggcggtatgggcgcggaagacgcgctgccgttcggcaacaaggagcaggctgaaaaatttgcaaaggataaaggcggcaaggtcgtcggttttgacgatatgcccgatgcttacattttcaag

SEQ ID NO: 4116 - protein, 164 aa, Neisseria gonorrhoeae
MKKTLLAIVAVFALSACRQAEEAPPPLPRQISDRSVGHYCSMNLTEHNGPKAQIFLNGKPDQPVWFSTVKQMFGYTKLPEEPKGIRVIYVTDMGNVTDWTNPNADTEWIDAKKAFYVIDSGFIGGMGAEDALPFGNKEQAEKFAKDKGGKVVGFDDMPDAYIFK

SEQ ID NO: 4117 - DNA, 1149 bp, Neisseria gonorrhoeae
atgaataatagagaccaactttttaaagccccgccgtttgaaaaccacagcccgctgacctggtatcaggctgcctcacaactgcccaacttcatccgcgacgacgcacaggcggccgccatcgaacaccttgaccggctttggaccgaattgatgatgttcaaacgcaaaagaaaccgttttttaggcaggagtttgcgttccccgcaagttcccaaagggctttatttctatggcggagtcggacgcggcaagagctttctgatggacgcttttttcggctgcctcccttaccgccgcaaacgccgcgtccactttcatgcctttatggcggaaatccaccggcggctgaaagccctgaaaagcgaaagcaacccgttgaaatccgttgccgccgagattaccaaagaaacccgagtattgtgttttgacgaatttcatgtcagcgatattgcggatgcaatgattttaggccgtctgttggaaaacctgcttaacgagggcgttgttttggtggcgacttcaaactacgcgccttccgaactctacccgcaaggtcaaaaccggagcggttttcttcccacaatcgcgctcatcgagtccagtctgaccgtcttaaacgttgacggaggggaagactaccggctgcgtaccctccgccccgccgagattttctttacgcctgccaatgaagaaaatgaggcaaaactggcaaaactgttcaaagaaatgacaggcattaccgatttgaaccccggcatcagcaccatccacggccgggaaattccccacaaagccgagtccggtcgtaccatatggtttgatttccgcgcactgtgcttcagtccccgctcacagtccgactatctgtatttggccgaacattatgaaatggtttttatttcaggtttggaacaactctcaccgcaagaaaaggcggaggcgcgacggctgacttggctgattgacgtactctacgatttccgggtcaaactgtgtgccaccggcgcggtagatgtcaaccatatctacacggaaggcgattttgccgaagaatttacccgcaccgccagccggatggtcgaaatgcagtccgaagtttatttggaacagccgcacctgaccttatctcccaaggcttcaggcgga

SEQ ID NO: 4118 - protein, 383 aa, Neisseria gonorrhoeae
MNNRDQLFKAPPFENHSPLTWYQAASQLPNFIRDDAQAAAIEHLDRLWTELMMFKRKRNRFLGRSLRSPQVPKGLYFYGGVGRGKSFLMDAFFGCLPYRRKRRVHFHAFMAEIHRRLKALKSESNPLKSVAAEITKETRVLCFDEFHVSDIADAMILGRLLENLLNEGVVLVATSNYAPSELYPQGQNRSGFLPTIALIESSLTVLNVDGGEDYRLRTLRPAEIFFTPANEENEAKLAKLFKEMTGITDLNPGISTIHGREIPHKAESGRTIWFDFRALCFSPRSQSDYLYLAEHYEMVFISGLEQLSPQEKAEARRLTWLIDVLYDFRVKLCATGAVDVNHIYTEGDFAEEFTRTASRMVEMQSEVYLEQPHLTLSPKASGG

SEQ ID NO: 4119 - DNA, 114 bp, Neisseria gonorrhoeae
ttggcgtttcccgtggaaaagaataatgacgcgcacaaagggggtataagcaaaggcggcgttttaatatggtgcagatatgagccaaaatgccttttatttcaggctgcgttt

SEQ ID NO: 4120 - protein, 38 aa, Neisseria gonorrhoeae
LAFPVEKNNDAHKGGISKGGVLIWCRYEPKCLLFQAAF

SEQ ID NO: 4121 - DNA, 180 bp, Neisseria gonorrhoeae
ttgtcctccttcaatattaaaacgcagcctgaaataaaaggcattttggctcatatctgcaccatattaaaacgccgcctttgcttataccccctttgtgcgcgtcattattcttttccacgggaaacgccaagtttgaaggaaatcatttataataccagcggtaagcattttctttct

SEQ ID NO: 4122 - protein, 60 aa, Neisseria gonorrhoeae
LSSFNIKTQPEIKGILAHICTILKRRLCLYPLCARHYSFPRETPSLKEIIYNTSGKHFLS

SEQ ID NO: 4123 - DNA, 105 bp, Neisseria gonorrhoeae
ttggagggggcgaaaacacaacaggaacaggttgcttatgcaaattcggcaacgaataatacgaagcccgaaagtgaagtaggaaatacgggcgattttaatgtt

SEQ ID NO: 4124 - protein, 35 aa, Neisseria gonorrhoeae
LEGAKTQQEQVAYANSATNNTKPESEVGNTGDFNV

SEQ ID NO: 4125 - DNA, 744 bp, Neisseria gonorrhoeae
atgaaatttgccgtctatttgccggataatccggaaaatcaaccgcttggtgtgatttattggctttccggcttgacgtgtacggaacaaaatttcattaccaaatcgagcttccggcgttatgcggcagaacatcaagtggttgtggtcgcccccgataccggccctcgcggagagcaagtgccgaacggtgccgcttatgatttaggacagggggcaggcttttatttgaatgcgaccgaacagccttgggcggcgaattatcaaatgtatgattacattttgaacgagttgccccgtctgattgaggagcattttcctaccaacggcaaacgttccattatggggcattcgatggacggacacggcgcattggtattggcactacggaatcgggaacattatcaaagtgtttctgccttttcgcctattttatcgccaagcctcgtaccgtggggagaaaaagcctttactgcttatttagggaaagaccgtgaaaaatggcagcaatatgatgctaactcactcattcaacaaggctataaagtgcaaggtatgcgtatcgatcagggcttggaagatgagtttttgccgacacaattgcgtaccaaagattttatcgaaacctgtcgtgcggcaaatcagccaatcgatgtgcgtttccataaaggatacgatcacagctattacttcatcgccagttttattggtgagcatatcgcttatcacgccgcatttttgaag

SEQ ID NO: 4126 - protein, 248 aa, Neisseria gonorrhoeae
MKFAVYLPDNPENQPLGVIYWLSGLTCTEQNFITKSSFRRYAAEHQVVVVAPDTGPRGEQVPNGAAYDLGQGAGFYLNATEQPWAANYQMYDYILNELPRLIEEHFPTNGKRSIMGHSMDGHGALVLALRNREHYQSVSAFSPILSPSLVPWGEKAFTAYLGKDREKWQQYDANSLIQQGYKVQGMRIDQGLEDEFLPTQLRTKDFIETCRAANQPIDVRFHKGYDHSYYFIASFIGEHIAYHAAFLK

SEQ ID NO: 4127 - DNA, 402 bp, Neisseria gonorrhoeae
ttgagcccgaaagattacgataaaccaatcaaagatgtgttgttagacatcaacaaatggggcattgaccacacctttgaatgtatcggcaatgtaaacgtaatgcgtcaggcattagaaagtgcacaccgaggttggggacaatccatcatcatcggcgtagcggatgcaggacaagaaatttcaacgcgtccgttccaatcggtaacaggccgtgtttggaaaggctcggcatttggtggtgttaaaggccgctccgagcttccgaaaatggtggaggattcaatgaaaggcgatatccaattagaaccatttgtgacccatgcaatgacccttgatcaaatcaatgaagcctttgagttaatgcacgaaggtaaatcgatccgcgctgttattcattac

SEQ ID NO: 4128 - protein, 134 aa, Neisseria gonorrhoeae
LSPKDYDKPIKDVLLDINKWGIDHTFECIGNVNVMRQALESAHRGWGQSIIIGVADAGQEISTRPFQSVTGRVWKGSAFGGVKGRSELPKMVEDSMKGDIQLEPFVTHAMTLDQINEAFELMHEGKSIRAVIHY

SEQ ID NO: 4129 - DNA, 774 bp, Neisseria gonorrhoeae
atgttgctcaggcaaggctattttgttaatgaattaagaggaaagacaatggaaatgaaacaaaccgattcaaccatcaaatctcgtgcggcggtggcattcgcccctaaccaacccttacaaattgtggaaatcgacgtggaaatgccgcgtaaagacgaggtgttaattcgtaacacccacactggcgtgtgccatactgatgcatttaccttatcaggaagcgatcctgaaggcgtattccctgtggtgcttggacacgaaggtgcgggtgtggtcgttgctgtgggcgagggtgtgtcaagcgtaaaaccgggtaatcacgtcattccgctttacaccgcagaatgtggcgaatgtgagttttgcctctcgggtaaaaccaatttatgcgtctcagtgcgtgatacacaaggtaaaggcttaatgccagacggcacgacgcgtttttcttatcaaggtcagccgatttatcactatatgggctgttcgactttcagtgaatattctgttgttgccgaagtttcactggcgaaaatcaacccgaaagccaaccacgaacaagtatgtttgctcggctgcggcgttaccactggtattggtgcggtacataacacggcaaaagtacaagaaggcgattctgttgccgtgtttggcttgggagcgattggtttggctgtggtgcaaggtgcgcgtcaagccaaagccggtcgcattatcgccattgataccaatcctgcaaaattcgagttggcaaaacagtgttggtgcaac

SEQ ID NO: 4130 - protein, 258 aa, Neisseria gonorrhoeae
MLLRQGYFVNELRGKTMEMKQTDSTIKSRAAVAFAPNQPLQIVEIDVEMPRKDEVLIRNTHTGVCHTDAFTLSGSDPEGVFPVVLGHEGAGVVVAVGEGVSSVKPGNHVIPLYTAECGECEFCLSGKTNLCVSVRDTQGKGLMPDGTTRFSYQGQPIYHYMGCSTFSEYSVVAEVSLAKINPKANHEQVCLLGCGVTTGIGAVHNTAKVQEGDSVAVFGLGAIGLAVVQGARQAKAGRIIAIDTNPAKFELAKQCWCN

SEQ ID NO: 4131 - DNA, 405 bp, Neisseria gonorrhoeae
atgacttataccactgccaaagctgccgaaaaaataggcatctccgcccacactttacgcttttacgacaaagaaggcttgttgcctaatatcggacgtgatgaatacggtaaccgttgttttaccgataacgatttgcaatggttgtacttattgcaatgcttgaaaaatacgggaatgagcttaaaagacatcaaacgctttgcggaatgtaccgtcattggcgacgataccattgaagaacgcctttccttgtttgaaaatcaaatagaaaatgtgaagtgtcaaattgccgaattaaaacgttatttagatttgcttgaatacaaattggcgttttaccaaaaagcgaaagcattaggctcggtaaaagctgtaaatttgccgcaaattcctgaaacggct

SEQ ID NO: 4132 - protein, 135 aa, Neisseria gonorrhoeae
MTYTTAKAAEKIGISAHTLRFYDKEGLLPNIGRDEYGNRCFTDNDLQWLYLLQCLKNTGMSLKDIKRFAECTVIGDDTIEERLSLFENQIENVKCQIAELKRYLDLLEYKLAFYQKAKALGSVKAVNLPQIPETA

SEQ ID NO: 4133 - DNA, 285 bp, Neisseria gonorrhoeae
ttggcagaagtatttgccgccaaaaacggcacgcatcttctggcaaaagacgtagagtacagcgtaaaagtcttggttgacaccatgacccgatcgcttgcccgaggtcaacgcatcgaaattcgcggtttcggcagcttcgatttgaaccatcgtcctgcccgcatcggtcgcaatcccaaaaccggcgagcgcgtggaagtacctgaaaaacatgtaccccacttcaagcctggtaaagaattgcgcgagcgggtcgacttggctttaaaagaaaatgccaat

SEQ ID NO: 4134 - protein, 95 aa, Neisseria gonorrhoeae
LAEVFAAKNGTHLLAKDVEYSVKVLVDTMTRSLARGQRIEIRGFGSFDLNHRPARIGRNPKTGERVEVPEKHVPHFKPGKELRERVDLALKENAN

SEQ ID NO: 4135 - DNA, 1611 bp, Neisseria gonorrhoeae
ttggcggcaaatacttctgccaagcgaaccattaactcagactttgtcatgtctgcaaccttattcttgttcgccggagagtttggctttcagcaggtcgcccaagctggtggtaccggcattcgcattggcggcggcattgacggagttcagtgcttcgcggctttctttggcatctttggctttaacggaaagtttgatgctgcggtttttgcggtcaacggtaacgatgacggcttcaacttcgtcgccttctttcagtttggtggtcaagtcttcaacgcggtcggctgcaaattcggaagcaggcaggtagccttctacttcgtcagacagggcgataacagcgcctttggcgtcaacagatttcacggaacctttaaccaaagaacctttgtcgttcacgctgatgaagttgccgaaaggatcgccttccagttgtttgatacccaaggagatgcgttctttttccacatcgattgccaatacgacggcttcgacttcttctccttttttgtatttgcgtacggcttcttcgccggattcggtccaagacaggtcggacaggtgaaccagaccgtcgatgccgccgggcaggccgacgaatacgccgaaatcggtaatggatttaaccgcaccggagattttgtctcctttgttgtggttggcggcaaattcttcccaaggattggcttggcattgtttcatacccaaagagatacggcggcggccttcgtcgatttccaaaatcatgacttcgacttcgtcacccagttgtacgactttgctcgggtgtacgtttttgttggtccagtccatttcggagacgtgtaccaaaccttcgatgccttgttcgatttcgacgaatgcgccgtagtcggtcaggttggatactttgccgaacaggcgggtggcttgcggataacggcgggtcagaccgctccaaggatcttcgcccagttgtttcatacccaaggaaacacgttgtttttcttggtcgaatttcaatactttggcttcaacttcctgaccgacttccaagacttcgctcgggtgtttcacgcgacgccatgccaaatcggtgatgtgcagcaggccgtcgatgccgcccaggtcaacgaatgcgccgtagtcggtgatatttttgacgatgcctttgatgacggagccttcttgcaggttttccagcagggctttgcgttcttcacccaaagtggcttccaaaacggcgcggcgggaaacaacgacgttgttgcgttttttgtccagtttgatcactttgaattcgatctctttgccttcaaaatgggaagtgtctttaacgggacgtacgtcgaccaaagaacccggcaggaatgcgcggatgctgctgatcataacggtcaggccgcctttgactttaccgttgatgatgccggacaggatgttgccgttttccatggcttcttccaaagcgatccaatcggctgcgcgtttggctttttcgcgggacagtttggtttcgccgaagccgttttcgacggattcgatggtaacggtaacgaagtcgccgactttaacttcaatttcgccttgagcgtttttgaattcagctacatcgatcagggattc

SEQ ID NO: 4136 - protein, 537 aa, Neisseria gonorrhoeae
LAANTSAKRTINSDFVMSATLFLFAGEFGFQQVAQAGGTGIRIGGGIDGVQCFAAFFGIFGFNGKFDAAVFAVNGNDDGFNFVAFFQFGGQVFNAVGCKFGSRQVAFYFVRQGDNSAFGVNRFHGTFNQRTFVVHADEVAERIAFQLFDTQGDAFFFHIDCQYDGFDFFSFFVFAYGFFAGFGPRQVGQVNQTVDAAGQADEYAEIGNGFNRTGDFVSFVVVGGKFFPRIGLALFHTQRDTAAAFVDFQNHDFDFVTQLYDFARVYVFVGPVHFGDVYQTFDALFDFDECAVVGQVGYFAEQAGGLRITAGQTAPRIFAQLFHTQGNTLFFLVEFQYFGFNFLTDFQDFARVFHATPCQIGDVQQAVDAAQVNECAVVGDIFDDAFDDGAFLQVFQQGFAFFTQSGFQNGAAGNNDVVAFFVQFDHFEFDLFAFKMGSVFNGTYVDQRTRQECADAADHNGQAAFDFTVDDAGQDVAVFHGFFQSDPIGCAFGFFAGQFGFAEAVFDGFDGNGNEVADFNFNFALSVFEFSYIDQGF

SEQ ID NO: 4137 - DNA, 675 bp, Neisseria gonorrhoeae; identical to SEQ ID NO: 145

SEQ ID NO: 4138 - protein, 225 aa, Neisseria gonorrhoeae; identical to SEQ ID NO: 146

SEQ ID NO: 4139 - DNA, 858 bp, Neisseria gonorrhoeae
atgtctgatttgtctgtattgtcgccgtttgccgtgcctttggcagcagttttggggctgctggtcggcagcttcctgaatgtcgtcatttaccgcgtacccgttatgatggaacgcggctggacggtatttgccaaagaacatttaaacctgccgctgaccgacgatgaaagccgtaccttcaacctgatgaagccggattcctgctgtcccaaatgccgtgtgccgatacgcgcgtggcagaacatcccgattgtcagttacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggtttgatactgaccgcgtttctgatttccctgacctttatcgatgcggacacccaatacctgcccgactcgatgacattacccttgatctggctggggctgatatttaatttggacggcggcttcgtgcctttgcagtctgccgttttaggtgcggttgccggctatagttcattatggctcttatgtgcagtgtataaactgctcacaggaaaaaccggtatgggcaacggagatttcaaactgattgccgcattgggcgcgtggctcggcatatccgcattgcccgtgctgatttttgtttcctctctgatcggtttggtcgcggcaatcgttatgcgcgtcgccaaggggcggcattttgccttcggccccgcactgacagtttcgggctggataatttttacggcaaacgattccgtatggcgggcggtcaactggtggctgacccatccggtgaga

SEQ ID NO: 4140 - protein, 286 aa, Neisseria gonorrhoeae
MSDLSVLSPFAVPLAAVLGLLVGSFLNVVIYRVPVMMERGWTVFAKEHLNLPLTDDESRTFNLMKPDSCCPKCRVPIRAWQNIPIVSYLLLRGKCASCQTKISIRYPLIELLTGVLFGLVAWQYGWSWITLGGLILTAFLISLTFIDADTQYLPDSMTLPLIWLGLIFNLDGGFVPLQSAVLGAVAGYSSLWLLCAVYKLLTGKTGMGNGDFKLIAALGAWLGISALPVLIFVSSLIGLVAAIVMRVAKGRHFAFGPALTVSGWIIFTANDSVWRAVNWWLTHPVR

SEQ ID NO: 4141 - DNA, 1656 bp, Neisseria gonorrhoeae
ttggaagaaagctttaccctgcaagaaatgaacccgggtgaggtgattaccgctgaagtagtggcaatcgaccaaaacttcgttaccgtaaacgcaggtctgaaatcagaatccctgatcgatgtagctgaattcaaaaacgctcaaggcgaaattgaagttaaagtcggcgacttcgttaccgttaccatcgaatccgtcgaaaacggcttcggcgaaaccaaactgtcccgcgaaaaagccaaacgcgcagccgattggatcgctttggaagaagccatggaaaacggcaacatcctgtccggcatcatcaacggtaaagtcaaaggcggcctgaccgttatgatcagcagcatccgcgcattcctgccgggttctttggtcgacgtacgtcccgttaaagacacttcccattttgaaggcaaagagatcgaattcaaagtgatcaaactggacaaaaaacgcaacaacgtcgttgtttcccgccgcgccgttttggaagccactttgggtgaagaacgcaaagccctgctggaaaacctgcaagaaggctccgtcatcaaaggcatcgtcaaaaatatcaccgactacggcgcattcgttgacctgggcggcatcgacggcctgctgcacatcaccgatttggcatggcgtcgcgtgaaacacccgagcgaagtcttggaagtcggtcaggaagttgaagccaaagtattgaaattcgaccaagaaaaacaacgtgtttccttgggtatgaaacaactgggcgaagatccttggagcggtctgacccgccgttatccgcaagccacccgcctgttcggcaaagtatccaacctgaccgactacggcgcattcgtcgaaatcgaacaaggcatcgaaggtttggtacacgtctccgaaatggactggaccaacaaaaacgtacacccgagcaaagtcgtacaactgggtgacgaagtcgaagtcatgattttggaaatcgacgaaggccgccgccgtatctctttgggtatgaaacaatgccaagccaatccttgggaagaatttgccgccaaccacaacaaaggagacaaaatctccggtgcggttaaatccattaccgatttcggcgtattcgtcggcctgcccggcggcatcgacggtctggttcacctgtccgacctgtcttggaccgaatccggcgaagaagccgtacgcaaatacaaaaaaggagaagaagtcgaagccgtcgtattggcaatcgatgtggaaaaagaacgcatctccttgggtatcaaacaactggaaggcgatcctttcggcaacttcatcagcgtgaacgacaaaggttctttggttaaaggttccgtgaaatctgttgacgccaaaggcgctgttatcgccctgtctgacgaagtagaaggctacctgcctgcttccgaatttgcagccgaccgcgttgaagacttgaccaccaaactgaaagaaggcgacgaagttgaagccgtcatcgttaccgttgaccgcaaaaaccgcagcatcaaactttccgttaaagccaaagatgccaaagaaagccgcgaagcactgaactccgtcaatgccgccgccaatgcgaatgccggtaccaccagcttgggcgacctgctgaaagccaaactctccggcgaacaagaa

SEQ ID NO: 4142 - protein, 552 aa, Neisseria gonorrhoeae
LEESFTLQEMNPGEVITAEVVAIDQNFVTVNAGLKSESLIDVAEFKNAQGEIEVKVGDFVTVTIESVENGFGETKLSREKAKRAADWIALEEAMENGNILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQATRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNAAANANAGTTSLGDLLKAKLSGEQE

SEQ ID NO: 4143 - DNA, 156 bp, Neisseria gonorrhoeae
gtgccgtctgaaaccttatttacccgcctgccgtgccaaggactgcagacacccaccaacccaacccgcaccccttggcggtgtaccgaaaagagttatatatgtctatggaaaattttgctcagctgttggaagaaagctttaccctgcaagaaa

SEQ ID NO: 4144 - protein, 52 aa, Neisseria gonorrhoeae
VPSETLFTRLPCQGLQTPTNPTRTPWRCTEKSYICLWKILLSCWKKALPCKK

SEQ ID NO: 4145 - DNA, 108 bp, Neisseria gonorrhoeae
gtgggtgtctgcagtccttggcacggcaggcgggtaaataaggtttcagacggcacatggaaattcatgctgtctgaagcgcaatgcgggcgattatacctgaaaatt

SEQ ID NO: 4146 - protein, 36 aa, Neisseria gonorrhoeae
VGVCSPWHGRRVNKVSDGTWKFMLSEAQCGRLYLKI

SEQ ID NO: 4147 - DNA, 873 bp, Neisseria gonorrhoeae
atgccgtctgaaggtcatacctctttcagacggcattgcattgatgcccgccacgccggaatccgaaccggcttgccggcttctgtcggacgctttccgggcaggcggcgttccgtctgcttagacaatcgtcctttaaaacaggtagaatccgccccaacgggaaacacacccttcagacggcaaaacccataccccaaaccatcaggaatcccccttatgaacagacaaaaagtcatcgccatcgacggtccgggcgcatcgggcaaaggcacggtcgccgcccgcgttgccgccgcattgggatacgattatctcgataccggcgcgctctaccgcctgaccgccctatatgcacaaaaacaaggcgtggaatggcacgatgaagaaaacgtttccgcacttgccaaaaaactgcccgccgtattttcaggcaaccgcatcctacttgatggcgaagacgtttcagacggcatccggacagaagccatcggtatgggcgcatccgcagttgcgcaatggcccaaagtccgcgccgcactgctgcaacgccaacgcgattttctgaccgaaaaaggactggttgccgacggacgggacaccggatcggtcgtcttcccccaagccgaactcaaaatttttctgacagccgaatctaaaatccgtgccgaacgccgcgccaaacaaatcggcattccctgcgaaggtttcacattcgagcgcatcctgtccgacatcgagaccagagacgaagcagaccgaaaccgcaaggttgcccccctgaaacaacagcccgatgccctgcttttggatacgagccgcctaactatagaagaaactgtaaaaaaagtgcttgattggtatcgtaaagtt

SEQ ID NO: 4148 - protein, 291 aa, Neisseria gonorrhoeae
MPSEGHTSFRRHCIDARHAGIRTGLPASVGRFPGRRRSVCLDNRPLKQVESAPTGNTPFRRQNPYPKPSGIPLMNRQKVIAIDGPGASGKGTVAARVAAALGYDYLDTGALYRLTALYAQKQGVEWHDEENVSALAKKLPAVFSGNRILLDGEDVSDGIRTEAIGMGASAVAQWPKVRAALLQRQRDFLTEKGLVADGRDTGSVVFPQAELKIFLTAESKIRAERRAKQIGIPCEGFTFERILSDIETRDEADRNRKVAPLKQQPDALLLDTSRLTIEETVKKVLDWYRKV

SEQ ID NO: 4149 - DNA, 1368 bp, Neisseria gonorrhoeae
atgtcttccccttcaaataccaaccgtcaaacctggtccagccgtttgacttatatccttaccgttgccggcgcgactgtcggtttcggcgcgacgtggcgtttcccgtatttggtcggtgaaaacggcggcggcgcgtatgtgtttttattctgtatcgcgatgctggttatcggcatcccgatgattttggtggaaaacgtcatcggacggcgcaaaggcgtgaacgcgctggatgcgttcggcggcccgatgaacggcaaacctgttgccaaaatttggaaactggtcggccggatggggctgctcggcgcgttcggcatcatggcttattatatggtactcggtggctgggtaatcagctatatcgttaatattattggaggaaatttgaatatttccagccccgtcgacggtgtggttacaaaaggcttctttaccgaacacattgaaaacagcccttgggaaattgcgtcttatacgctgctttttgtcgccgtgaaccaatggattttggtcaaaggcgttatcggcggcattgaaaaaacggcgaaatacctgatgcctctgctgtttttgttcctaatcgcgatggtcgtccgcaacgttacccttccgggcgcaatggaaggggttgctttctatctgaaacctgatttcagcaagattaccgccgaactgttcgtcttcgttttgggacaggtattttttgccctgagcctgggtttcggcgtgatgattaccttatccagctatctggataaaaacgaaaatctggttcagacggcagttatcacggcaattaccaataccatcatcgctgtacttgcgggctttatgattttcccgtcgctcttcagcttcggcgtcgcgcccaattccggcccgactttggtgttccaaagtttaccgattgtgttctcacatatgtgggcaggacctgtgttcgccgtcattttcttctctctgctcctgattgccgcgttgacaacttcgctgacgatttatgaagtgttgattacgaccattcaggaaaaaaccaaaatccgccgtaccgccgcaatcacgattgtattgtccgtcatcttcgttttcggcaacatcccgtctattttgagctatggcccgtggaaagacgtttccgtgttcggcaaaaatattttcgatgccttcgactacatcagcggcaacatcttgtttatgctgaccgcgctcggttccgcattgtttgtcggttttgtgatgaaggacgaagcgaaggaagaattgctttataaaggcaaccatacgacggtcaatatttggtttgcctatgtgaaataccttgtgccgctggtgattctgctgattttcgtcagcaacctgttc

SEQ ID NO: 4150 - protein, 456 aa, Neisseria gonorrhoeae
MSSPSNTNRQTWSSRLTYILTVAGATVGFGATWRFPYLVGENGGGAYVFLFCIAMLVIGIPMILVENVIGRRKGVNALDAFGGPMNGKPVAKIWKLVGRMGLLGAFGIMAYYMVLGGWVISYIVNIIGGNLNISSPVDGVVTKGFFTEHIENSPWEIASYTLLFVAVNQWILVKGVIGGIEKTAKYLMPLLFLFLIAMVVRNVTLPGAMEGVAFYLKPDFSKITAELFVFVLGQVFFALSLGFGVMITLSSYLDKNENLVQTAVITAITNTIIAVLAGFMIFPSLFSFGVAPNSGPTLVFQSLPIVFSHMWAGPVFAVIFFSLLLIAALTTSLTIYEVLITTIQEKTKIRRTAAITIVLSVIFVFGNIPSILSYGPWKDVSVFGKNIFDAFDYISGNILFMLTALGSALFVGFVMKDEAKEELLYKGNHTTVNIWFAYVKYLVPLVILLIFVSNLF

SEQ ID NO: 4151 - DNA, 147 bp, Neisseria gonorrhoeae
atgatgatgaaagagagggaatttgaaatagaaaaccatctatacaaggggagaagtatagatggcaaaacacattatggggaaaacgtcttgctcataatcctgcttgaacaggcgttacttagacaagcggattatatcgtaaac

SEQ ID NO: 4152 - protein, 49 aa, Neisseria gonorrhoeae
MMMKEREFEIENHLYKGRSIDGKTHYGENVLLIILLEQALLRQADYIVN

SEQ ID NO: 4153 - DNA, 228 bp, Neisseria gonorrhoeae
atgtgcgaatcgccggcggtgaaggtgttgcacgcggttgccggcggcagcaaccatgcgtttgacttggtggtattttccttcggtaatggtcagcagcagggtggtcggattttccaaaacggcatcggcggcacaaacggtttcgttttcgtcgtggagcggcacgccgtttttcaaagtttcgcagagcgtttctcctgtagggtgtttgagcgttacttcgta

SEQ ID NO: 4154 - protein, 76 aa, Neisseria gonorrhoeae
MCESPAVKVLHAVAGGSNHAFDLVVFSFGNGQQQGGRIFQNGIGGTNGFVFVVERHAVFQSFAERFSCRVFERYFV

SEQ ID NO: 4155 - DNA, 768 bp, Neisseria gonorrhoeae
ttggaagctgattcggatacggcacatgacaggactttctcagtcctgtctttttcatcccacatttcccataccatcatgaaactcatcaaatacctgcaatatcaaggcataggaagccgcaagcagtgccaatggctgattaggggcggctacgtctccatcaacggaacctgcatggacgacaccgatgcagacatcgattcctcatacgtcgaaacgttggatattgacggggaagcagtaaccgtcgttcccgaaccctatttctacatcctgctcaacaagcctgaagattacgaaacttcgcacaaaccgaaacactaccgcagcgtattcagtctgttccccgacaatatgcggaacatcgatatgcaggcggtcggcaggctggatgcggatacgaccggcgtattgctgattaccaacgacggcaaactgaaccacaacctgacttcgccgagcagaaaaattcccaagctatacgaagtaacgctcaaacaccctacaggagaaacgctctgcgaaactttgaaaaacggcgtgccgctccacgacgaaaacgaaaccgtttgtgccgccgatgccgttttggaaaatccgaccaccctgctgctgaccattaccgaaggaaaataccaccaagtcaaacgcatggttgctgccgccggcaaccgcgtgcaacaccttcaccgccggcgattcgcacatttggaaacagaaaacctcaaacccggggaatggaaatttatcgaatgtccgaaattc

SEQ ID NO: 4156 - protein, 256 aa, Neisseria gonorrhoeae
LEADSDTAHDRTFSVLSFSSHISHTIMKLIKYLQYQGIGSRKQCQWLIRGGYVSINGTCMDDTDADIDSSYVETLDIDGEAVTVVPEPYFYILLNKPEDYETSHKPKHYRSVFSLFPDNMRNIDMQAVGRLDADTTGVLLITNDGKLNHNLTSPSRKIPKLYEVTLKHPTGETLCETLKNGVPLHDENETVCAADAVLENPTTLLLTITEGKYHQVKRMVAAAGNRVQHLHRRRFAHLETENLKPGEWKFIECPKF

SEQ ID NO: 4157 - DNA, 828 bp, Neisseria gonorrhoeae; identical to SEQ ID NO: 5

SEQ ID NO: 4158 - protein, 276 aa, Neisseria gonorrhoeae; identical to SEQ ID NO: 6

SEQ ID NO: 4159 - DNA, 1974 bp, Neisseria gonorrhoeae
atgtccaaactcaaaaccatcgccctgaccgcatcaggtctgtccgtttgtccgggtttcctatatgcccaaaacacctcatcacaccaagtcggtttagcgattatgcggttaaactcttcaatactcgacctgccaccgacaaaacaatatttccaatccggcagcctgtgggacgagctgcgccaaggcttccggatgggcgaagtcaatcccgaactggtacgccgccacgaaagcaaattcatcgcaagccgcagctatttcgacagggtcgtcaaccggagccgaccctatatgtaccatatcgccaacgaagtcaaaaaacgcaatatgcccgccgaagccgccctgcttcccttcatcgaaagcgcgttcgtcaccaaagccaaatcacacgtcggcgcatcgggcctgtggcagttcatgcccgctaccggcaggcattacggcttggaaaaaacaccggtttacgacggcaggcacgacgtttacgcagctaccgatgccgcactcaactatctgcaatatctctatggactgttcggcgactggccgctcgcctttgccgcctacaactggggtgaaggcaacgtcggacgcgccgtcaaccgcgcccgcgaccaagggctcgaaccgacctacgaaaacctgcgtatgcccaacgaaacgcgcaactatgtccccaagctgctcgccgtgcgcaacattattgccaccccccaatctttcggcatgaatatcagcgacatagacaacaaaccctattttcaggcagtcgaaccgggccgtccgctcgacaacgaagccatcgcccggcttgccggcatcacgcaaagcgagctgctcgccctgaatcctgcattcaacgtccccgcgttcatccccaaaaacaaacgcaaactgctgcttcctgtcgcgtccgtccaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaagacccttcatacggcatcggaatccgtcgtttccatcgacatcgacaatacgcccgacacctaccgttccaatatgccggcaggcacggtgaacgtcagcattgcccgaatccaacccgccgccgcacagacagcggacattaccgtcgcacctttgccgcaagaaaccgtccgtacggaacccgatccccttgtccgcattaccgaacccgcccttgcgacagccgcagcgcaacctcaaaccgaaaaacagactgccatgccgtctgaaacccaaaccgcaacactcgcgcaggtcatccccccaaacgacatgcaggcggcagacgaactcatgcagcttgttgcccgaaacaacctgcgccggcaggctgaagaaaccatctccgccgtcatcggcacgcctgacacagttgccgaacacaacatttcctcatctccgcaacataccgttgccgccgacggcaaacgccgggcacgtttggaaacgcgcgtagccaaagctgccgacggcgaagccgaaacctccccgctccatgccagcatccaccgcgttgtagaaggcgacaccctgttcaacattgccaaacgctacaacgtcagcgtagccgacctgattgtcgccaacaacatcaaaggcaacaccatccaaaaaggacaggtactccgcctggcgcaggcagcccctgcccaaacccgtattgaaaaagtatcctacaccgcgcgcaaaggcgacaccttcaaaagtatcgccgcgcgcttcaatatccatatcgacgacatccgccggctcaatcccaacctgaacaccatcaatccgggacagagggtcaaactgattggaagc

SEQ ID NO: 4160 - protein, 658 aa, Neisseria gonorrhoeae
MSKLKTIALTASGLSVCPGFLYAQNTSSHQVGLAIMRLNSSILDLPPTKQYFQSGSLWDELRQGFRMGEVNPELVRRHESKFIASRSYFDRVVNRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAVNRARDQGLEPTYENLRMPNETRNYVPKLLAVRNIIATPQSFGMNISDIDNKPYFQAVEPGRPLDNEAIARLAGITQSELLALNPAFNVPAFIPKNKRKLLLPVASVQTFQSNYLNAAPDSLFSWEVYTPAAKTSLSDISTATGMSIADIKRLNNLNGNLVNAGRSILVAKNGKTLHTASESVVSIDIDNTPDTYRSNMPAGTVNVSIARIQPAAAQTADITVAPLPQETVRTEPDPLVRITEPALATAAAQPQTEKQTAMPSETQTATLAQVIPPNDMQAADELMQLVARNNLRRQAEETISAVIGTPDTVAEHNISSSPQHTVAADGKRRARLETRVAKAADGEAETSPLHASIHRVVEGDTLFNIAKRYNVSVADLIVANNIKGNTIQKGQVLRLAQAAPAQTRIEKVSYTARKGDTFKSIAARFNIHIDDIRRLNPNLNTINPGQRVKLIGS

SEQ ID NO: 4161 - DNA, 213 bp, Neisseria gonorrhoeae
atgcatccatattgcgtccgtttcaaacagattgcctgccgatattttattccaaacaggatttctgtcaaaaaacacatcggccgcccatttccgaatccgcataaagttcctgtaaaacttgacgctttttcagtcaaacagtaccatcggacgataaaatatgtttattccgccgagtataaatcatgtccaaactcaaaaccatcgccc

SEQ ID NO: 4162 - protein, 71 aa, Neisseria gonorrhoeae
MHPYCVRFKQIACRYFIPNRISVKKHIGRPFPNPHKVPVKLDAFSVKQYHRTIKYVYSAEYKSCPNSKPSP

SEQ ID NO: 4163 - DNA, 663 bp, Neisseria gonorrhoeae
atggatgcatggtttgaagatacggcgatggggcggtatgttgcaaaattggaacaggacttctttaatcggtatgtggcgtcataccgtttttcgggaatgtgtgcggttcaggtgggcggtcagtggctgagcctgtctgaagacattgtctgtgtgccgcgagatatgtcgatgtcggcggagaatatggctttggcggatgtttttgcggatatgctgcttttgccgcatacgctggaatgcggcgtaccttcgcaaatcctgtcggaagcgcaccggatattgaaaccgtccggacgtttgatgctgacgggtttcaatccgtattcgctttggggattctgccgttggtttgacggtgtccgtctgccggaaaaacggttttgtctgccgctgcccgagttgaaaaggcagcttgccgatgccggtttcgatattgaatttgggaaattcatggtgtatctgcctcccgtttcgtcgctcgggcaaatacgcttttggcggtttatggaaaaggcgggcgaccgttggtggccgcaatgtgccgcagtgtacggtttggttttggtcaaaagggcggcgggcgtaacgcccctgcccgcgtgggacgggtattggggcggcaaagcccttgcggcgggtgcggcaagggttgcggat

SEQ ID NO: 4164 - protein, 221 aa, Neisseria gonorrhoeae
MDAWFEDTAMGRYVAKLEQDFFNRYVASYRFSGMCAVQVGGQWLSLSEDIVCVPRDMSMSAENMALADVFADMLLLPHTLECGVPSQILSEAHRILKPSGRLMLTGFNPYSLWGFCRWFDGVRLPEKRFCLPLPELKRQLADAGFDIEFGKFMVYLPPVSSLGQIRFWRFMEKAGDRWWPQCAAVYGLVLVKRAAGVTPLPAWDGYWGGKALAAGAARVAD

SEQ ID NO: 4165 - DNA, 900 bp, Neisseria gonorrhoeae
gtgcggcaagggttgcggattaagggacggccgtctttcagacggcatctgtcagaagaaatgtcgggaggggttatgccggaattgccggaagtggaaacgacgttgcgcggcatcgcgccgcatattgaaggaaaaacggtggaagccgtgatattgcgccaactgaagctgcgctggcagatcaatcccgatttgggggagattttgtccggccggcaggttttgtcctgcggcaggcgtgccaaatatctgattgtccgtttccaaacggggattttgctgattcacttggggatgtcgggcagcttgcggatctttacgccgtcggacggacgtatcggcaggccggacagacacgatcacgtcgatattgtgttttcagacggcacggtcatgcgttaccgcgatccgagaaagttcggcgcgatactttggtatgagggaatcgaagaacgtcatccgctgttggaaaaactggggccggagcctttgtcggaggcattttgcacggattatctgtatgcggggctgaaggcgcagaaacgcgcggtcaaactcgctctgatggacaataccgtcgtggtcggcgtgggcaatatttatgccaacgagagtctgttcagggcgggcatttcgccccaccgtcctgccaaccgcctaaaaaagaaagagtgcgcggttttggttgaaaccgtcaaagcggtgttgcagcgcgccattgaaacgggcggcagtacgctgagggattttgtggacagcgacggcaaaagcggctactttcaacaggaatatacggtgtacgggcggcacaatcagccgtgcctccggtgcggcggtttggttgtgaaagaaactttggggcagcgcggcacgttttattgcacgaactgtcagaaa

SEQ ID NO: 4166 - protein, 300 aa, Neisseria gonorrhoeae
VRQGLRIKGRPSFRRHLSEEMSGGVMPELPEVETTLRGIAPHIEGKTVEAVILRQLKLRWQINPDLGEILSGRQVLSCGRRAKYLIVRFQTGILLIHLGMSGSLRIFTPSDGRIGRPDRHDHVDIVFSDGTVMRYRDPRKFGAILWYEGIEERHPLLEKLGPEPLSEAFCTDYLYAGLKAQKRAVKLALMDNTVVVGVGNIYANESLFRAGISPHRPANRLKKKECAVLVETVKAVLQRAIETGGSTLRDFVDSDGKSGYFQQEYTVYGRHNQPCLRCGGLVVKETLGQRGTFYCTNCQK

SEQ ID NO: 4167 - DNA, 180 bp, Neisseria gonorrhoeae
gtgcctccggtgcggcggtttggttgtgaaagaaactttggggcagcgcggcacgttttattgcacgaactgtcagaaatagggcggaaaacggtttctgacggcattttatcggtatgccgtccgaacgtttcaacaacaaacaccgattatcgggaaagaattgcccatgtcttcaaa

SEQ ID NO: 4168 - protein, 60 aa, Neisseria gonorrhoeae
VPPVRRFGCERNFGAARHVLLHELSEIGRKTVSDGILSVCRPNVSTTNTDYRERIAHVFK

SEQ ID NO: 4169 - DNA, 771 bp, Neisseria gonorrhoeae
ttgcccatgtcttcaaataaagcttcattttttacacgtctgcgccgcttgtgccgcttgacggtctggctgttcaaaaccggcaaaaacctgcgcggtattgacggcggctgccccaagtcgcgcaatcgggcagttatagcgttgggcaagggcgctttggcggctttggatatcggattggaggtgggcagacccgcacccgaacatccgaacggtgtcttggttgccgccaaccacgtgtcctggctggatattttcgcgatgagcgcggtttatccgagtagctttatcgccaagcaggaaatcaaaagctggccggtattgggcaagatggggcagaacgcgggaacggtgttcatcaaccgcaattcgcggcgcgacatcgaaccgattaaccgcgccgtctgcgaaaccttgcaacgcggtcaaaacgtcagttttttccctgaggcgcgaacttcctccggactggggctcctgccgttcaaggctgcgctgttccaatccgccatcgatgcgggggcaaaggttttggcggtcgcactgcgttattatgacgaaacgggaaaaaggacggcccgtccgtcgtatgccgatgtcggtttgccgacttgcctgtggcgaatcgtgtctatgaaaaaactgactatcaaagtcgatttcgtttgcgtggcggacgcggcggaaagcgaagaccgttatgctttaaaagataaaatcgaagaaagcatccgtgccgttgtcgcaggcgatgcggatgttgccgtc

SEQ ID NO: 4170 - protein, 257 aa, Neisseria gonorrhoeae
LPMSSNKASFFTRLRRLCRLTVWLFKTGKNLRGIDGGCPKSRNRAVIALGKGALAALDIGLEVGRPAPEHPNGVLVAANHVSWLDIFAMSAVYPSSFIAKQEIKSWPVLGKMGQNAGTVFINRNSRRDIEPINRAVCETLQRGQNVSFFPEARTSSGLGLLPFKAALFQSAIDAGAKVLAVALRYYDETGKRTARPSYADVGLPTCLWRIVSMKKLTIKVDFVCVADAAESEDRYALKDKIEESIRAVVAGDADVAV

SEQ ID NO: 4171 - DNA, 828 bp, Neisseria gonorrhoeae
ttgccgtcgggctgctgctcgcattcggcaccggttccggcgggttttccatcattatgggacaggtcgccgcccaagtccccacacacaaacgcggcttggcatccggactggtcaacgcaggcggttcggcaggacaattcctgttcgcaccgctggttcaaggactcaaggactcgtcgtcctgcccgaagtcggctggacgggtacattttacgtttggggcgcaatcgccctgctgattctgcccgtctcatggtggcttgccggcggcaacaacggcggcaacaacgccgcccacacccaacacacccaagccacacacggacaaagcctcggagaagcagtcaaaaccgccttcaaaaccccaagctacatcctgctgcacctgagctttttcgcctgcggcttccacatcgcctttctcgtaacccacctacccacggaagtcgccctgtgcggactgcccgccaccgtcgcctcgacatccatcgccatcatcggactggcaaacatcgccggttgcgtgttctcaggctgatgcaccggacgcttcaaaggaaaacacatcctgttcggactctacgcctcacgcgtcgccatggtgctgatttacatcttctcacccaaaaccgacctcaacttttacattttcgccgccgcactcggattcacatggctcgccaccgtcgccccgaccgccgccgttaccggcaaactcttcggcacgcgctacctcgccaccctgttcggactggtgatgctcacccaccaaatcggcggattcctcggctcgtacatcggcggcatcgtgattacacaattcgg

SEQ ID NO: 4172 - protein, 276 aa, Neisseria gonorrhoeae
LPSGCCSHSAPVPAGFPSLWDRSPPKSPHTNAAWHPDWSTQAVRQDNSCSHRWFKDSRTRRPARSRLDGYILRLGRNRPADSARLMVACRRQQRRQQRRPHPTHPSHTRTKPRRSSQNRLQNPKLHPAAPELFRLRLPHRLSRNPPTHGSRPVRTARHRRLDIHRHHRTGKHRRLRVLRLMHRTLQRKTHPVRTLRLTRRHGADLHLLTQNRPQLLHFRRRTRIHMARHRRPDRRRYRQTLRHALPRHPVRTGDAHPPNRRIPRLVHRRHRDYTIR

SEQ ID NO: 4173 - DNA, 669 bp, Neisseria gonorrhoeae
atggcgggcggtcaactggtggctgacccatccggtgagatgacagcatgggtcggactgaccggcggaatcggcagcggcaaatcggcagccgcgcaatattttgccgatttgggcgtgccgcgcatcgatgcggacgcggcggcgcactcgctgacggcttcagacggcatcgccctgccggaaatcaggcggctgttcggcgacaccgttttcgacacacagggtttgttgcggcgcgacatattgcgtaaagaaatctttgcctccccatcgcgcaaagccttgctcgaatccgtgatgttgccgctgattttctcagaaatcaaaaaacagcaagaaacctttaccgatgcggtttacggcattgtcgaaattccgctgctgacggagaagcgtcaatttatcagcctgatacggcgtgtcctgaccataagcgcacctttggaaaaacgtatcggcagggtaatggcacgcagcgggctgacgcgcggcgaggtggcggacatcatcagccatcaggcatccgaatccgaacgcctgctgcttgcagacgatgtactgctcaatgacggcagcctcaaaagcctacgtgagaaaacaatgctcctgcacgcgttttattcagggattttcgcctcaaaaccaacacaaggaaaacacaatggc

SEQ ID NO: 4174 - protein, 223 aa, Neisseria gonorrhoeae
MAGGQLVADPSGEMTAWVGLTGGIGSGKSAAAQYFADLGVPRIDADAAAHSLTASDGIALPEIRRLFGDTVFDTQGLLRRDILRKEIFASPSRKALLESVMLPLIFSEIKKQQETFTDAVYGIVEIPLLTEKRQFISLIRRVLTISAPLEKRIGRVMARSGLTRGEVADIISHQASESERLLLADDVLLNDGSLKSLREKTMLLHAFYSGIFASKPTQGKHNG

SEQ ID NO: 4175 - DNA, 222 bp, Neisseria gonorrhoeae
ttgtcggaatgtggcggtatgattcgcttttgcggatgccttaaggctgcggtaacgggagtacctcaaaagaaatgccgtaaggatagtttgttgtatagtggattaaatttaaatcaggacaaggcggcgaagccgcagacagtacaaatagcacggcaaggcgaggcaacgccgtaccggtctaaatttaatccactatatctatggaaaatgccatct

SEQ ID NO: 4176 - protein, 74 aa, Neisseria gonorrhoeae
LSECGGMIRFCGCLKAAVTGVPQKKCRKDSLLYSGLNLNQDKAAKPQTVQIARQGEATPYRSKFNPLYLWKMPS

SEQ ID NO: 4177 - DNA, 309 bp, Neisseria gonorrhoeae
atgcttgccatactgttgtctgcaatactgggactggtatcaacaactgccgctgccggtacgtcagaacccgcccaccgacataccaaacatatcagcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgcaccctgccttatgcggaacagaaaatccaatgccgggcggcttatgaggctttcgatgatttcgacggcggcaggttccgccgt

SEQ ID NO: 4178 - protein, 103 aa, Neisseria gonorrhoeae
MLAILLSAILGLVSTTAAAGTSEPAHRHTKHISKANKQMLHPECRKYLERRAAWYRSQGNVQELRENKKARKAFRTLPYAEQKIQCRAAYEAFDDFDGGRFRR

SEQ ID NO: 4179 - DNA, 366 bp, Neisseria gonorrhoeae
atgagtctgaaactgccgacagtttgcccgttccatccttccatcctatactggaaggaattacaaactgaaaggatcgtcatgtccgtcaataaagatgcttgccatactgttgtctgcaatactgggactggtatcaacaactgccgctgccggtacgtcagaacccgcccaccgacataccaaacatatcagcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgcaccctgccttatgcggaacagaaaatccaatgccgggcggctta

SEQ ID NO: 4180 - protein, 122 aa, Neisseria gonorrhoeae
MSLKLPTVCPFHPSILYWKELQTERIVMSVNKDACHTVVCNTGTGINNCRCRYVRTRPPTYQTYQQGKQADAAPRMQEIFGTPCRVVPIARQRAGIARKQKGAQSIPHPALCGTENPMPGGL

SEQ ID NO: 4181 - DNA, 135 bp, Neisseria gonorrhoeae
ttgttaaattttgcaaagtatgatttttgccacgccgccgccgacaaattccattttcttaccgattggaatttattattgagattaatatgttatttgaatttgcatatcaaacggcaagttttgtcggctgaa

SEQ ID NO: 4182 - protein, 45 aa, Neisseria gonorrhoeae
LLNFAKYDFCHAAADKFHFLTDWNLLLRLICYLNLHIKRQVLSAE

SEQ ID NO: 4183 - DNA, 156 bp, Neisseria gonorrhoeae
ttgcaaaatttaacaattcgcaggggcggaaaaccggaagttttcctttttcgtcggaaaatccttatttcatcgccttgtagccggagccggtcaaaaggcaaaaaatttacccgttttttatcggtaaagaattatcagataaaacaaatgtta

SEQ ID NO: 4184 - protein, 52 aa, Neisseria gonorrhoeae
LQNLTIRRGGKPEVFLFRRKILISSPCSRSRSKGKKFTRFLSVKNYQIKQML

SEQ ID NO: 4185 - DNA, 2277 bp, Neisseria gonorrhoeae
atgaatacaccgactgatttaaaagtaaccaaacgagacggaagattggaagccattgatttggataagattcaccgtgtcgttacttgggcggcggaaggattggaaaatgtttccgtgtcgcaggtcgagttgaaatcgcacatccagttctacaacggcatccgcaccgacgacatccacgaaaccatcatcaaagccgctgcagatttaatttcggaagataccccggactaccaataccttgccgcacgtttggcgattttccatcttcgtaaaatagcctacggcgaatacgagccgccgcacctttacaaccatgttaaaaagctcaccgatgccggaaaatacgacaggcatatccttgaggattacagccgcgaagaatttgacgaactgaacgcctatatcgaccacgaacgcgatatgtccttttcctatgccgccgtcaaacagctcgaaggcaaatatctggtacagaaccgcgttacccgccagatttacgaaacgccgcagtttttatatgttttggtggcgatgtgccttttcagcaaatacccgaaagaggcgcgcttggattacgtcaaacggttttacgatgccgtttccacattcaaagtatcgttgcccacgccgattatgagcggcgtgcgtacgcctacgcgccagttctcaagctgtgtgctgattgaatgcgacgatagtttggattccatcaatgccactaccagcgcgattgtgaaatacgtttcccaacgcgcgggcatcggcatcaatgccggacgtatccgcgggctggacagcgaaatccggggcggtgaagcccggcataccggctgcattcccttctttaagatgtttcaggcggcggtcaaatcttgttcgcaaggtggcgtgcgcggcggcgcggcaaccttgttctaccccttgtggcatattgaagccgaaagcctgctggtgttgaaaaacaaccggggcgtggaagacaaccgtatccgccagcttgattatggcgtgcaaatcaaccgcctgctgtacacccgcctgattaagggcggcaacattacgctgttttcgcccaacgaggtttcggggttgtacgaagcgttttttgccgaccaagacgaatttgagcggctctatacgaaatacgagcaagacccgaacatacgcaagcgtatcattccggctgccgacctgttttccacgctgatgcaggagcgtgccgggaccgggcgcatctacattcaaaacgtcgatcactgcaatacgcacagcccgttcgatccgcgcgttgcgcctgttcatcagtccaacttgtgtatggaaatcgccctgccgaccaaaccgctggacaacatcaacgaccctgacggcgaaatagccctgtgtacactgtccgccttcaacttgggtgcattaaacagcttggacgaattggaagggcttgccgatttgaccgtgcgcgcactcgatgcacttttagattatcagggatatccggtagaagccgcgcgtacctctactatggaccgccgttcgctcggcatcggtgtcatcaactacgcctactatctggcgaaaaacggtgtccgctacagcgacggttccgcgctcggtctgacccaccgtacctttgaagccatacagtattacctgctcaaagcatcggcaaaccttgccaaagaatacggagcgtgcacgctctttaaccaaaccgtttattcgcaaggcaaactgcccatcgacacctacaaaaaagatttggatgccgtctgcggcgagcctttgcattacgactgggaaagcctgcgtgccgacatcgtcaaatacggcctgcgcaactctactctgaccgcgctcatgccgtctgaaaccagctcgcaaatcgccaacgccaccaacggcatcgagccgccgcgcggattggtaacggtcaaagcatcgaaagacggcattttgaaacaagtcgtgccggagtttgaaaccttgaaaaatgcctacgaaaccctgtggcagcttccgggcaacgaaggctacctgaaacttgtcggcgtaatgcaaaaattcgtcgatcaggcgatttccgccaacactgcttacgacccgggcaaattcgaaggtaacaaagtttctatgaaacaaatgctcaaagacctgctgactgcctacaaatacggcgtcaaaaccctgtactaccacaacacccgcgacggcgcggacgacacgcagaccgatattcaagatgacggctgcgctggtggggcttgtaagatt

SEQ ID NO: 4186 - protein, 759 aa, Neisseria gonorrhoeae
MNTPTDLKVTKRDGRLEAIDLDKIHRVVTWAAEGLENVSVSQVELKSHIQFYNGIRTDDIHETIIKAAADLISEDTPDYQYLAARLAIFHLRKIAYGEYEPPHLYNHVKKLTDAGKYDRHILEDYSREEFDELNAYIDHERDMSFSYAAVKQLEGKYLVQNRVTRQIYETPQFLYVLVAMCLFSKYPKEARLDYVKRFYDAVSTFKVSLPTPIMSGVRTPTRQFSSCVLIECDDSLDSINATTSAIVKYVSQRAGIGINAGRIRGLDSEIRGGEARHTGCIPFFKMFQAAVKSCSQGGVRGGAATLFYPLWHIEAESLLVLKNNRGVEDNRIRQLDYGVQINRLLYTRLIKGGNITLFSPNEVSGLYEAFFADQDEFERLYTKYEQDPNIRKRIIPAADLFSTLMQERAGTGRIYIQNVDHCNTHSPFDPRVAPVHQSNLCMEIALPTKPLDNINDPDGEIALCTLSAFNLGALNSLDELEGLADLTVRALDALLDYQGYPVEAARTSTMDRRSLGIGVINYAYYLAKNGVRYSDGSALGLTHRTFEAIQYYLLKASANLAKEYGACTLFNQTVYSQGKLPIDTYKKDLDAVCGEPLHYDWESLRADIVKYGLRNSTLTALMPSETSSQIANATNGIEPPRGLVTVKASKDGILKQVVPEFETLKNAYETLWQLPGNEGYLKLVGVMQKFVDQAISANTAYDPGKFEGNKVSMKQMLKDLLTAYKYGVKTLYYHNTRDGADDTQTDIQDDGCAGGACKI

SEQ ID NO: 4187 - DNA, 318 bp, Neisseria gonorrhoeae; identical to SEQ ID NO: 147

SEQ ID NO: 4188 - protein, 106 aa, Neisseria gonorrhoeae; identical to SEQ ID NO: 148

SEQ ID NO: 4189 - DNA, 207 bp, Neisseria gonorrhoeae
atggctgaatcgcggcaaacacgccttcaagtcaaatgtccgacctgtcaaacggcagtagtatggaaaccggaaaacgcattccgcccgttctgttcgcaacgctgcaaactgatcgacttgggcggatgggcagacgggaaatatacggtttccggtcaaacggaaagtttgccggaaatatccgaacccgacggggcataccgc

SEQ ID NO: 4190 - protein, 69 aa, Neisseria gonorrhoeae
MAESRQTRLQVKCPTCQTAVVWKPENAFRPFCSQRCKLIDLGGWADGKYTVSGQTESLPEISEPDGAYR

SEQ ID NO: 4191 - DNA, 924 bp, Neisseria gonorrhoeae
atgccgtctgaaaacacaaaaggaacaaccatgaccacacatcatgtcgaattgaggaaggtaaccaaacggttcggggcgcaaaaagccgtcagccaagtcgatttggttttgaaggcaggagaaagcgtcgggcttgccggacacaacggcgcgggcaagtccaccatcatgaagctgatactcgggctgattaccccgaccgaaggcgaagtgatgcttttgggcgaacgtaccggcagcaaagcgggggcgcggcttcgcagccaaatcggctacctgcccgaaaccgttgcgctgcacccttcgctgaccggcatcgaaacgctggatttttatgccaaacttaaaaaacagccgctcacgcagaaccgggggctgcttgagcgcgtcggcatttcccagaccgcacaccgccgcgtcggcacttattctaaagggatgcgccaacgccttgccttggcacaagccctgctgggcgagcccaaagtcctgctgtttgacgaaccgacaaccggccccgaccctgcatcacgacaaatgttttacgaagtcgtgcgcgaactcaacgggcgcggcgcgaccatattgctcagtacccacgcccttgccgagttggacggacacgccgaccgcattgtcgtgatgaaaaacggcgttaaggttgccgacggcagtatggacgaattgcacgtccaaagcgggctgccgctgaccgtcaatatccgcctcaatgcgccgcgcaccctcagcagccgctggcagccgctttcagacggcatttcctaccgggcgcaatgtcaggccgaagaacgtatggaactgttgggcgaattgggcagcctgtccgaccttgcctatttcgacatccacacgccgacgcttgacgaaatgtacgcacggttcttgaaaagggaggacgta

SEQ ID NO: 4192 - protein, 308 aa, Neisseria gonorrhoeae
MPSENTKGTTMTTHHVELRKVTKRFGAQKAVSQVDLVLKAGESVGLAGHNGAGKSTIMKLILGLITPTEGEVMLLGERTGSKAGARLRSQIGYLPETVALHPSLTGIETLDFYAKLKKQPLTQNRGLLERVGISQTAHRRVGTYSKGMRQRLALAQALLGEPKVLLFDEPTTGPDPASRQMFYEVVRELNGRGATILLSTHALAELDGHADRIVVMKNGVKVADGSMDELHVQSGLPLTVNIRLNAPRTLSSRWQPLSDGISYRAQCQAEERMELLGELGSLSDLAYFDIHTPTLDEMYARFLKREDV

SEQ ID NO: 4193 - DNA, 147 bp, Neisseria gonorrhoeae
atggatgtcattcggtcattcttagttgaatataaattttatatatttattagtgttcttttagtatttgctattttaggatggcactttattgatagaattcaacatgttttatatggtgaattaaaaattaatagaaaagtcgac

SEQ ID NO: 4194 - protein, 49 aa, Neisseria gonorrhoeae
MDVIRSFLVEYKFYIFISVLLVFAILGWHFIDRIQHVLYGELKINRKVD

SEQ ID NO: 4195 - DNA, 1080 bp, Neisseria gonorrhoeae
atgtttttcggtcagccggtaaatgtcgcccgttatgaccagcagaaatacgaggtatttgaaaaactgattgaaaaacaattgtcgtttttttggcggccggaagaaatcgacgtgtcgcgcgaccgtatcgactacgccaacctgcccgaacacgaaaaacatattttcatcagcaatctgaaatatcaaacactgctcgattccatccaagggcgcagtccgaatgttgccttgctgcctttggtttcgattcccgagctggaaacttgggttgaaacgtggagcttcagcgaaaccatccactcgcgcagctatacccacatcatccgcaatattgtgaatgatccgtcggtcgtgtttgatgatattgtcgaaaacgaatacattaccgcccgcgccgaagacattgcctgctattatgatgatttaatcgaatacacccaatattacaacctgttgggcgaaggggtgcacaatgtcggcggaaaacccgttactgtgtctttgcgcgggttgaagaaaaaactctatctctgcctgatgtgcgtcaatgtgttggaagccatccgtttctacgtttcatttgcctgctcgtttgcttttgctgagcgtgagttgatggaaggcaacgccaaaatcatcaaactgattgcccgcgatgaagccctgcacctgaccggcacgcagcatatgcttaatctgatgcgttcgggtgttgatgatccggaaatggcggaaattgccgccgagttgcaggacgaatgtttccaactcttcaaaaaagcggcggaacaggaaaaagaatgggcggcatatttgtttaaagacggttcgatgatcggtttgaacaaagaaatcttatcccaatacgtcgaatatattaccaatctgcgtatgcaggcggtggggctgccggccggatttgaaggcgcaaatcaaaacccgattccgtggattaatgcgtggctgtcgtccgacaacgtacaggtcgcgccgcaggaagtggaaatatcctcttatttgattggtcaaatcgattctgaagtgaatacggatgacttgggcgattttgagttg

SEQ ID NO: 4196 - protein, 360 aa, Neisseria gonorrhoeae
MFFGQPVNVARYDQQKYEVFEKLIEKQLSFFWRPEEIDVSRDRIDYANLPEHEKHIFISNLKYQTLLDSIQGRSPNVALLPLVSIPELETWVETWSFSETIHSRSYTHIIRNIVNDPSVVFDDIVENEYITARAEDIACYYDDLIEYTQYYNLLGEGVHNVGGKPVTVSLRGLKKKLYLCLMCVNVLEAIRFYVSFACSFAFAERELMEGNAKIIKLIARDEALHLTGTQHMLNLMRSGVDDPEMAEIAAELQDECFQLFKKAAEQEKEWAAYLFKDGSMIGLNKEILSQYVEYITNLRMQAVGLPAGFEGANQNPIPWINAWLSSDNVQVAPQEVEISSYLIGQIDSEVNTDDLGDFEL

SEQ ID NO: 4197 - DNA, 288 bp, Neisseria gonorrhoeae
atggcgcgcattggtacgaataagggcctttttgagctcttggagggtgagaccctgttggaaggcttggaacggacggggcatatggtggaatatcagtgccgaagcggatattgcggatcgtgccgggtaaagattttggagggaagcgttacttatcgggagccgcctttggcttttttggggcgggacgagatactgccgtgctgctgttgcgtcgagggggatgtcaggctggattgcggtttggcgggggaggatgaggggctgtctgacagtttgttgaaa

SEQ ID NO: 4198 - protein, 96 aa, Neisseria gonorrhoeae
MARIGTNKGLFELLEGETLLEGLERTGHMVEYQCRSGYCGSCRVKILEGSVTYREPPLAFLGRDEILPCCCCVEGDVRLDCGLAGEDEGLSDSLLK

SEQ ID NO: 4199 - DNA, 279 bp, Neisseria gonorrhoeae
ttgatgaagtgggtaactgtcgttttatccttcgcacttgtctgttgccaatacagcctgtggttcggcaaaggcagcatcggacgcaacagcagtctgagagaacagattgccgttcaagaagaaaaaaaccagacactcgccctacgcaatcattcccttgccgccgaagtctatgatttggaaaacggtcaagaagccatttcggaaatcgcccgggtagaactgggttatatccaagacggcgaaaccttttaccgactcatcaggcataaccgg

SEQ ID NO: 4200 - protein, 93 aa, Neisseria gonorrhoeae
LMKWVTVVLSFALVCCQYSLWFGKGSIGRNSSLREQIAVQEEKNQTLALRNHSLAAEVYDLENGQEAISEIARVELGYIQDGETFYRLIRHNR

SEQ ID NO: 4201 - DNA, 1191 bp, Neisseria gonorrhoeae
atgggacgtgcggccgtaccgagcggcgcatccaccggtcagaaagaagctttggaacttcgcgacggcgacaaatcccgctattccggcaaaggcgtattgaaggccgtcgaacacgtcaacaaccaaatcgcccaagccctcatcggtatcgatgccaacgagcaatcttatatcgaccaaatcatgatcgaattggacggtactgaaaacaaaggcaatttgggtgcgaatgcgactttggcggtctctatggcggttgcacgcgccgctgccgaagactcaggcctgccgctttaccgctacttggggggcgcaggtccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagtaaaggcttcccgaccacagtcggcgacgaaggcggtttcgcccccaacctgaacagccacaaagaagccctgcaactgatggtcgaagcggccgaagccgccggctacaaggcgggcgaagacgtattattcgcattggactgcgcgtccagcgagttctacaaagacggcaaataccacttggaagccgaaggccgctcctacaccaacgcggaatttgccgaatacttggaaggcttggttaacgaattcccgattatttccattgaagacgggatggacgaaaacgactgggaaggctggaaactgctgaccgaaaaattgggcaaaaaagttcaattggtcggcgacgacttgttcgtaaccaatccgaaaattcttgccgaaggcatcgaaaaaggcgtagcaaacgcattgctggtcaaagtcaaccaaatcggtactttaagcgaaaccctgaaagccgtcgatctggcaaaatgcaaccgctacgccagcgtgatgagccaccgctccggcgaaaccgaagacagtaccattgccgacttggcagtcgccaccaactgtatgcagattaaaaccggttctttgagccgttccgaccgcatggcgaaatacaaccaactgctgcgtatcgaggaagaattggcggaagccgcctactaccccggcaaagccgcattctaccaactgggcaaa

SEQ ID NO: 4202 - protein, 397 aa, Neisseria gonorrhoeae
MGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 4203 - DNA, 438 bp, Neisseria gonorrhoeae
atgatgcagactttccgaaaaatcagcctgtatgccgcaaccttgtggctcggtatgcagattatggcaggttatatcgccgcaccggtgctgttcaaaatgctgcccaaaatgcaggcgggcgaaattgccggcgtattgttcgacatcctctcttggagcgggcttgccgtttggggcacggtactggctgccgcctttgccgccctaacccggcggcaaaccgccctgctgctttttttattgtccgcccttgccgccaaccaatttttggttacacccgttatcgaggcactgaaatacgggcatgaaaattggctgttgtcggttgcaggcggatccttcggaatgtggcacggtatttccagcatgactttcatggcaaccgccctactttcagcagttttaagttggcggctttccggcaaagaggccgtc

SEQ ID NO: 4204 - protein, 146 aa, Neisseria gonorrhoeae
MMQTFRKISLYAATLWLGMQIMAGYIAAPVLFKMLPKMQAGEIAGVLFDILSWSGLAVWGTVLAAAFAALTRRQTALLLFLLSALAANQFLVTPVIEALKYGHENWLLSVAGGSFGMWHGISSMTFMATALLSAVLSWRLSGKEAV

SEQ ID NO: 4205 - DNA, 456 bp, Neisseria gonorrhoeae
cccaaaaccgacctcaacttttacattttcgccgccgcactcggattcacatggctcgccaccgtcgccccgaccgccgccgttaccggcaaactcttcggcacgcgctacctcgccaccctgttcggactggtgatgctcacccaccaaatcggcggattcctcggctcgtacatcggcggcatcgtgattacacaattcggtgactacggctggatgtggtacgccgatgccgtactcgccggcacggcagccctgcttgtcctgcccgtccgcgaaccccgaaccgccgcatgacagaatgccgtctgaaaccttcagacggcattttccaaacaccccgcccgttgccggactgcacggcacgcaaatcagccttatcaaaccgcaaataaccgccgcgattaaaccgccattcaaataagcccgttttcccttcgggtgtaaaatcatcac

SEQ ID NO: 4206 - protein, 98 aa, Neisseria gonorrhoeae
PKTDLNFYIFAAALGFTWLATVAPTAAVTGKLFGTRYLATLFGLVMLTHQIGGFLGSYIGGIVITQFGDYGWMWYADAVLAGTAALLVLPVREPRTAA

SEQ ID NO: 4207 - DNA, 840 bp, Neisseria gonorrhoeae
atggatattaaaatcaacgacatcaccctcggcaacaattcgcctttcgtcctattcggcggcatcaacgttttagaagatttggattccaccctccaaacctgtgcgcattacgtcgaagttacccgcaaactgggcatcccctatatctttaaagcctctttcgacaaggcaaaccgctcgtctatccattcctatcgcggcgtaggcttggaagaaggcttaaagatttttgaaaaagtcaaagcagagttcggcatccccgtcattaccgacgtacacgaaccccatcaatgccaacccgtcgccgaagtgtgcgatgtcatccagcttcccgcctttcttgcgcggcagaccgatttggtggccgcaatggcggaaacgggcaatgttatcaacatcaaaaaaccccagttcctcagcccttcgcaaatgaaaaacatcgtggaaaaattccgcgaagccggcaacgggaagctgattttatgcgaacgcggcagcagcttcggctacgacaacctcgttgtcgatatgctcggtttcggcgtgatgaaacaaacctgcggcaacctgccggttattttcgacgttacccattccctgcaaacccgcgatgccggttctgccgcatccggcggtcgtcgcgcacaggctttggatttggcacttgcaggcatggcaacccgccttgccggcctgttcctcgaatcgcaccccgatccgaaactggcaaaatgcgacggccccagcgcgctgccgctacaccttttagaaaattttttaatccgcatcaaagcattggacgatttaatcaaatcacaaccgattttaacaatcgag

SEQ ID NO: 4208 - protein, 280 aa, Neisseria gonorrhoeae
MDIKINDITLGNNSPFVLFGGINVLEDLDSTLQTCAHYVEVTRKLGIPYIFKASFDKANRSSIHSYRGVGLEEGLKIFEKVKAEFGIPVITDVHEPHQCQPVAEVCDVIQLPAFLARQTDLVAAMAETGNVINIKKPQFLSPSQMKNIVEKFREAGNGKLILCERGSSFGYDNLVVDMLGFGVMKQTCGNLPVIFDVTHSLQTRDAGSAASGGRRAQALDLALAGMATRLAGLFLESHPDPKLAKCDGPSALPLHLLENFLIRIKALDDLIKSQPILTIE

SEQ ID NO: 4209 - DNA, 381 bp, Neisseria gonorrhoeae
atgttccgtactatacttggcggaaaaatccaccgcgccaccgtaaccgaagccgatttaaactacgtcggcagcattaccgtcgatcaagacctgttagacgcggcaggcatctgccccaacgaaaaagtcgccatcgtcaacaacaacaacggcgaacgttttgaaacctataccattgcagggaaacgcggcagcggcgtgatttgcctgaacggtgctgcagccaggctggtacagaaaggcgacatcgtcatcattatgtcttatatccaactttccgaaccggaaatcgccgcacacgaacccaaagtcgtcttagtggacggaaacaataaaatccgcgacatcatctcctacgagccgccgcacaccgtactg

SEQ ID NO: 4210 - protein, 127 aa, Neisseria gonorrhoeae
MFRTILGGKIHRATVTEADLNYVGSITVDQDLLDAAGICPNEKVAIVNNNNGERFETYTIAGKRGSGVICLNGAAARLVQKGDIVIIMSYIQLSEPEIAAHEPKVVLVDGNNKIRDIISYEPPHTVL

SEQ ID NO: 4211 - DNA, 300 bp, Neisseria gonorrhoeae
ttggatgcatttgccgccttcctgtccgaattggaaaaagccgacgatgctgcacgcgccgcactgacggaatatttgaaacgggacagccgctatatcgactttcacaccgaagatacccaaacaagccgtgatgcggcaaaatttgtccgcactatgcagttgatctatatcagcttatgggcaaaaaatccggcttttgccgttatggattatatgcccgccaatatagaaagcgacgaaatccttgccgtcaaactgcatttggacggcagcattttctcaatcgattgggagagt

SEQ ID NO: 4212 - protein, 100 aa, Neisseria gonorrhoeae
LDAFAAFLSELEKADDAARAALTEYLKRDSRYIDFHTEDTQTSRDAAKFVRTMQLIYISLWAKNPAFAVMDYMPANIESDEILAVKLHLDGSIFSIDWES

SEQ ID NO: 4213 - DNA, 291 bp, Neisseria gonorrhoeae
ttgggtatcttcggtgtgaaagtcgatatagcggctgtcccgtttcaaatattccgtcagtgcggcgcgtgcagcatcgtcggctttttccaattcggacaggaaggcggcaaatgcatccaatgtttcggttggcaggctgttttcattttctgcctacaggaatacctcgacaagattgcctttgacggtcagctcgtcttcccagaggacatcttcttctccgtcaaaaccttcggtggacagttgttggaaataggggtgaaaaatcgacatgattgttccttttgg

SEQ ID NO: 4214 - protein, 97 aa, Neisseria gonorrhoeae
LGIFGVKVDIAAVPFQIFRQCGACSIVGFFQFGQEGGKCIQCFGWQAVFIFCLQEYLDKIAFDGQLVFPEDIFFSVKTFGGQLLEIGVKNRHDCSFW

SEQ ID NO: 4215 - DNA, 117 bp, Neisseria gonorrhoeae
atgtcgatttttcacccctatttccaacaactgtccaccgaaggttttgacggagaagaagatgtcctctgggaagacgagctgaccgtcaaaggcaatcttgtcgaggtattcctg

SEQ ID NO: 4216 - protein, 39 aa, Neisseria gonorrhoeae
MSIFHPYFQQLSTEGFDGEEDVLWEDELTVKGNLVEVFL

SEQ ID NO: 4217 - DNA, 126 bp, Neisseria gonorrhoeae
gtgcgccccgccaaaaacggcacgggcggcagcttctgcatcgccgtggcaaccggtacgaacaacacgtccgccgcgccgcttttaatctgccacaacgccgacagccgctccgacaccaaatcc

SEQ ID NO: 4218 - protein, 42 aa, Neisseria gonorrhoeae
VRPAKNGTGGSFCIAVATGTNNTSAAPLLICHNADSRSDTKS

SEQ ID NO: 4219 - DNA, 1227 bp, Neisseria gonorrhoeae
atgcggcgcgcttggcaaaggtttgcccgccgcgccccgtatccggcatttcatcaatgcagaccgcatttccaatcctatattcaaggtgtccgccttatgaaaatcgtttttatcacaacagtcgcatccagcatttacggtttccgcgcccccgtcattaaaaaattaatcggcaaaaaccatcaggtgtatgcctttgtatcggagttttccgataatgagttggacattatcagggaaatgggggttacacccgttacctaccggtcaaaccgcagcggggtaaacccgttttccgatataaaatccaccttcctcatatttaaagcactcaaaaaaatatcgccggatttggttttcccttatttcgcaaaacccgtgattttcggcacttttgccgcaaaattggcaggcgtgcccagaatcgtcgggatgctggaaggtttgggattcgcatttaccccgcagccggaaggcataccgttaaaaacaaaaataataaagggcattttgattgccctgtaccgcattgccctgccgatgttggaaagcctgatcgtattaaaccccgacgacaaagacgagctgctgcatcaatacggcatcaaaataaaaaacattcatattttgggcggaatcggtctggatttgcggcaatatccttattccgaggcggatattcccgatgaaaaagaacccgtaaaatttctctttatcggcagatttctgaaagaaaaggggattgatgattttattcgggcggcggaacaggttaagggcaaataccccgatacggtttttaccgctttgggcgcaatcgacaaatcacgcgggggggggggagatttagaacgctttatcgcccgcgatattatccgtttccccggttttgtgaacaatgtttccgaagtgataaaggcgcatcatatattcgtattgccgtcttattatagggaaggcgttccccgaagcacccaggaggcaatggccgtcggcagggcggtgattacgacggatgtccccggatgcagggaaacggttgccgacaaggtcaacggcttcctgatcgaaccttggaatccccgcatcttggccgaaaaaatgatttattttatcgaaaacagggctgccgtccgcctgatggcgaatgcaagttatgcgattgccaaagataaattcgatgccgaaaaagtcgatttgaaatttctcgatattttgaaggcg

SEQ ID NO: 4220 - protein, 409 aa, Neisseria gonorrhoeae
MRRAWQRFARRAPYPAFHQCRPHFQSYIQGVRLMKIVFITTVASSIYGFRAPVIKKLIGKNHQVYAFVSEFSDNELDIIREMGVTPVTYRSNRSGVNPFSDIKSTFLIFKALKKISPDLVFPYFAKPVIFGTFAAKLAGVPRIVGMLEGLGFAFTPQPEGIPLKTKIIKGILIALYRIALPMLESLIVLNPDDKDELLHQYGIKIKNIHILGGIGLDLRQYPYSEADIPDEKEPVKFLFIGRFLKEKGIDDFIRAAEQVKGKYPDTVFTALGAIDKSRGGGGDLERFIARDIIRFPGFVNNVSEVIKAHHIFVLPSYYREGVPRSTQEAMAVGRAVITTDVPGCRETVADKVNGFLIEPWNPRILAEKMIYFIENRAAVRLMANASYAIAKDKFDAEKVDLKFLDILKA

SEQ ID NO: 4221 - DNA, 576 bp, Neisseria gonorrhoeae
atgctcaactatgtcaactattccgatattcacgacaatattatcaacaaagcgggcaagtgcgtttttgcctacaatgccaactacgataaactgtccgccaatcattttgaaaactgccaaatcggcatgcactttaccgccgccatcgaaggcacgtccctgcacgacaattcctttatcaacaacggaagccaggtcaaatatgtcagtacgcgctttctcgactggagcgagggcggacacggcaactactggagcgacaacagcccgttcgatttgaacggcgacggcttcggagacagcgcgtaccgtcccgacggcatcatcgaccaaatcatctggcgcgcgcccgtatcgcgcctcttgatgaacagtcccgcaatcagcatcgtcaaatgggcgcaggcgcagtttcccgccgttctgcccggcggcgtggtggacagcaaaccgctgatgaagccttatgcccccaaaattcaaacccgttatcaggcgatgaaggacgagttgctcaaagaagccgaaacgcggcagtcggaacggggcagggcggaaaacggttctttgaac

SEQ ID NO: 4222 - protein, 192 aa, Neisseria gonorrhoeae
MLNYVNYSDIHDNIINKAGKCVFAYNANYDKLSANHFENCQIGMHFTAAIEGTSLHDNSFINNGSQVKYVSTRFLDWSEGGHGNYWSDNSPFDLNGDGFGDSAYRPDGIIDQIIWRAPVSRLLMNSPAISIVKWAQAQFPAVLPGGVVDSKPLMKPYAPKIQTRYQAMKDELLKEAETRQSERGRAENGSLN

SEQ ID NO: 4223 - DNA, 3702 bp, Neisseria gonorrhoeae
atgacctgccccatccccaaaccccgtgaaaaatcccgttggttcaatctttcgcaaggctcgctgcccttggctttggcgcgttatttgccgcacaagcggctcaaagccgtgctgacccaagatgcggaacaggcgttgcgccttcagacggcatggcggtttttccgtccgcacgacacggcggtgttcctgccggactgggaaacgctgccttacgagcgtttttctccgcatcaggatttggtgtcggagcggctgtcggcgttgtggcagattaaaagcggcgcggcggacgtgttgttcgtaccggttgccacggcgatgcagaagctgccgcccgtgccgtttttggcggggcgcacgttttggctgaaaacggggcagactttggatataggccgcctgaaaaccgatttggtggatgcgggctacaatcatgtttcccacgttgtcgcggcgggcgagtttgccgtgcgcggcggcattgtcgatttgttcccgatgggcagcgaaacgccgtaccgcatcgatttgtttgacgatgaaatcgacagcattaaaaccttcgataccgacacgcagcgcaccatttcccccgtttccgaaatccgcctgctgccggcgcacgagttccccaccgacagcgaggcgcaaaaaatcttccgcagccgcttccgcgaggaagtcgacggtaatccgaacgatgccgccgtgtacaaagccgtcagcaacggccacttcggcgcgggcgtggaatattatctgccgctgttttttgaaaacgagctggaaacgctgtttgactatatcggcgaagatgcgctgtttgtctctttgggcgatgttcatgccgaggcaaaccgcttttggaacgacgttaaatcacgttacgccatggcgcagggcgacgaaacctatccgcctttgcttccacagcatttgtatctctctgccgatgtgttcgcaggccgtctgaaaaactacggacaagttctgcctgatgtttccggcaaggcacactccctgcccgaccttgccgtcaaccgccaatccgacgatcctttgcaggcattgaaggattttcagacggcctttgacgggcggattttgctgtgcgccgaaagtttgggacggcgcgaaaccatgctcggtttcttgcagcaaaacggtttgaaagccaaacctgtgtccgactggcagggcttcttgtcggcgcacgagccgctgatgattacggtcgcgccgttggcttacggattcaaactgggcggactgcaatcttcaagccaacagcaaactgttcccgcctccgagggagaaggcaaagcggttaccgaccaaaccgaattttccgcatccgcaacaaaccctctccccagccctctcccgcaggagagggaacaaagtgccgccgccgtttcagacggcctgaaagcagccgccgtttcaaccgaaagcagcctgtatctcgtcgcaagtgatctgcacgggcaaacccgacagcaatctgccccctcccccgtgggggagggttggggagagggcaaagcggttgccgctcaaagtgccatcgccgtcatcaccgaatccgatctttaccaatacgtcgcccgttcgcgcgtccacaaccgccgtaagaaacacgccgccgtttcagacggcctgttgcgcgaccttgccgaaatcaatatcggcgatcccgtcgtgcacgaagaacacggcatcgggcggtatacgggcttggtaacgatggatttaggcggcgaaaccaacgaaatgatgttgctcgaatacgcgggcgaagcgcagctttatgtgcctgtttcgcaactgcatttaatcagccgctactccggtcaggcgcatgaaagcgtcgccctgcacaagctcggcagcggcgcgtggaacaaggcgaagcgcaaagccgccgaaaaagcgcgcgataccgccgccgagttgctcaacctctacgcccaacgcgccgcccaatcgggacacaagtttgaaatcaacgagtcggactatcaggcgtttgccgacggcttcggctacgaggaaaccgaagaccaggccgccgccatcgccgccgtgattaaagatttgacgcaggcgaagccgatggaccgacttgtgtgcggcgatgtcggtttcggcaaaaccgaagtcgcccttcgcgccgcgtttgtggcggtgatgggcggcaaacaggtcgccgtactcgccccgaccacgcttctggtcgagcagcacgcgcaaaacttcgccgaccgtttcgccgatttccccgtgaaagtcgccagcctttcgcgtttcaacaacagcaaagccaccaaagccacgctcgaaggcatggcggacggtactgtcgatatcgttatcggtacgcacaaattggtgcaggacgacataaaattcaaaaacttaggtttattgattatcgatgaagaacaccgcttcggcgtgcgacagaaagagcagctcaaacgcctgcgcgccaatgtcgacatcctaaccatgaccgccacgccgattccgcgcaccctcagcatggcgctcgaaggtctgcgcgacttctcgctgattaccactgcaccgagccgccgcctcgccgtgaaaacctttgtcaaaccgttcagcgaaggcagcgtgcgcgaagccgtgttgcgcgaactcaaacgcggaggacaggtatttttcctgcacaatgaagtagatacgattgagaatatgcgcgagcggctggaaaccctgctgcccgaagcccgtatcggcgtggcgcacggacaactgcgtgagcgcgagctggaacaagtcatgcgcgactttttgcagcaaagattcaatgtgttgctctgttccaccatcatcgaaaccggcatcgacatccccaacgccaacaccatcatcatcaaccgcgccgacaaattcgggctggcccaactgcaccagcttcgcggacgcgtcggccgcagccaccaccaagcctacgcctacctgctcacgcccgaatacatcaccaaagacgcagaaaaacgcctcgacgccatcgcggcggcagacgaactcggcgcaggtttcaccctcgccatgcaggatttggaaatccgcggcgcaggcgaaatcctcggcgaagggcagtccggcgaaatgatgcaggtcggcttcacgctctacaccgaaatgctcaaacaggccgtgcgcgacctcaaaaaaggccgccaacccgacctcgacgcaccgttgggcattaccaccgaaatcaaactgcacagcccggcattactgcctgaagactactgccccgacatccacgagcgcctcgtcctctacaaacgcctcgccgtatgcgaaaccgtgcagaaaatcaacgccatacacgaagaactcgtcgaccgcttcggcctgaccgaacaacccgtcaaaaccctcattgaaagccaccacctgcggcttgcggcaaaagaactgggtattgatgccatcgatgccacaagtgaagccgtaaccgttaccttcggcaaacaccactgtatcgacccgacggggattatcctgctgattcagacggataaaaaataccggctggcaggggcagacaaattgaggtttgcagcggaaatggaaaacatcgaggtcaggatcaataccgtcaaaaccgtactaaaaaccctgcaaggcaaacgcctgcccaaaggaaat

SEQ ID NO: 4224 - protein, 1234 aa, Neisseria gonorrhoeae
MTCPIPKPREKSRWFNLSQGSLPLALARYLPHKRLKAVLTQDAEQALRLQTAWRFFRPHDTAVFLPDWETLPYERFSPHQDLVSERLSALWQIKSGAADVLFVPVATAMQKLPPVPFLAGRTFWLKTGQTLDIGRLKTDLVDAGYNHVSHVVAAGEFAVRGGIVDLFPMGSETPYRIDLFDDEIDSIKTFDTDTQRTISPVSEIRLLPAHEFPTDSEAQKIFRSRFREEVDGNPNDAAVYKAVSNGHFGAGVEYYLPLFFENELETLFDYIGEDALFVSLGDVHAEANRFWNDVKSRYAMAQGDETYPPLLPQHLYLSADVFAGRLKNYGQVLPDVSGKAHSLPDLAVNRQSDDPLQALKDFQTAFDGRILLCAESLGRRETMLGFLQQNGLKAKPVSDWQGFLSAHEPLMITVAPLAYGFKLGGLQSSSQQQTVPASEGEGKAVTDQTEFSASATNPLPSPLPQEREQSAAAVSDGLKAAAVSTESSLYLVASDLHGQTRQQSAPSPVGEGWGEGKAVAAQSAIAVITESDLYQYVARSRVHNRRKKHAAVSDGLLRDLAEINIGDPVVHEEHGIGRYTGLVTMDLGGETNEMMLLEYAGEAQLYVPVSQLHLISRYSGQAHESVALHKLGSGAWNKAKRKAAEKARDTAAELLNLYAQRAAQSGHKFEINESDYQAFADGFGYEETEDQAAAIAAVIKDLTQAKPMDRLVCGDVGFGKTEVALRAAFVAVMGGKQVAVLAPTTLLVEQHAQNFADRFADFPVKVASLSRFNNSKATKATLEGMADGTVDIVIGTHKLVQDDIKFKNLGLLIIDEEHRFGVRQKEQLKRLRANVDILTMTATPIPRTLSMALEGLRDFSLITTAPSRRLAVKTFVKPFSEGSVREAVLRELKRGGQVFFLHNEVDTIENMRERLETLLPEARIGVAHGQLRERELEQVMRDFLQQRFNVLLCSTIIETGIDIPNANTIIINRADKFGLAQLHQLRGRVGRSHHQAYAYLLTPEYITKDAEKRLDAIAAADELGAGFTLAMQDLEIRGAGEILGEGQSGEMMQVGFTLYTEMLKQAVRDLKKGRQPDLDAPLGITTEIKLHSPALLPEDYCPDIHERLVLYKRLAVCETVQKINAIHEELVDRFGLTEQPVKTLIESHHLRLAAKELGIDAIDATSEAVTVTFGKHHCIDPTGIILLIQTDKKYRLAGADKLRFAAEMENIEVRINTVKTVLKTLQGKRLPKGN

SEQ ID NO: 4225 - DNA, 213 bp, Neisseria gonorrhoeae
atgtgctttaaaaaagcagccgtgtccatggttgacggctgcgcgctcggttcggtgtgtatcatcggcttcctctgtcggttcccattaatcggcggccggtcaaaccgcctgccacagtttagagttaattttctaaactttaccacaaagtgcaccgggcaacaatccgccggcctttcagacggcatcgcgcaccctcacgtgctaaaa

SEQ ID NO: 4226 - protein, 71 aa, Neisseria gonorrhoeae
MCFKKAAVSMVDGCALGSVCIIGFLCRFPLIGGRSNRLPQFRVNFLNFTTKCTGQQSAGLSDGIAHPHVLK

SEQ ID NO: 4227 - DNA, 1389 bp, Neisseria gonorrhoeae
atggacacggctgcttttttaaagcacatcgaatccgcattccgccgcattttttcagacggcatcgacctgatgcgatacctgcccgaagacaaatggcttgccttgaagcaggcgggtttgctgttgcccttcctcgacaaaaaacacggcgggcgcaagggcagtcagtttgaaatccaagaagtcctaaggattgcggggcattacggcgtgcccgttacgctgcgtaccggcatcgaaggcgcgctggtgttgcagcctctgcaagagttcggcggcgaagcgcaagtcgcacaaggtttggacatgattttcaaaggcgaaggcggcggtttgggcgttaccgaacccgaaacctccggcgcggcgattgcacgcgaaatgcagtcctgctacgaatataccgacgaacaaaccatttacgtcaacgccgcgaaatactggcagggcaattcgcaaagcgacttcctcctcgttgccgccaaagagcgcaaaaacggcaaactcgccaaagtcatcgacctgctgctcgtccccaaaacatacatccgctgcgaaaccctcgcatccgaaggcctgcgcgccgtccgttacgccgtcaaccgcatcgatgccgaaatgcctgcaaccgccgtgatgaaactctcccggggcgacgctgccggtttgcgcgcgttccaaaacatctttatccgcagccgcctgcaactgatcggcatgacgcacggcattatggaatacatccttgacaacctgaaccgatatgtccgcaacgatatcagattcgtcgattacgaacgccgcgaaatccaacgccgccatcaggtttccgaaatcctttaccgctacgtctgccattccgtttcgcccgtcgcgcccgtcgcccatcaattgatggaggcgaacatcgtcaaaaccctcgccacggaatacacttacgccgccgcgcaaatgttgcaaaaactcttgggcgcgaagggttttgaacgcggacacccagccggcaatatcgccatcgatatccgccccttcacgatttttgaaggcccgaacgatatgctttatgccgaaatttacgaccagttcgtccgcgccaccgccgaagaaaaagaagcaggcattaagttggacaaaaaccaaaccctgctcgaccgcctgcaaaccgatgtccgctttgccgccgttgcccgcgactacgctttgcccgaagacatccgcagcttcctgcaggaacacaccctgaccgacgcctgcgccctgcaaaaagtcttcatcggcaaaatcatcgcccgactttttgtcttcgtacaggaggaacacgaagacaccacagccttcctgctgaacgacatccgcaaagatatattggactgccgatattgcgga

SEQ ID NO: 4228 - protein, 463 aa, Neisseria gonorrhoeae
MDTAAFLKHIESAFRRIFSDGIDLMRYLPEDKWLALKQAGLLLPFLDKKHGGRKGSQFEIQEVLRIAGHYGVPVTLRTGIEGALVLQPLQEFGGEAQVAQGLDMIFKGEGGGLGVTEPETSGAAIAREMQSCYEYTDEQTIYVNAAKYWQGNSQSDFLLVAAKERKNGKLAKVIDLLLVPKTYIRCETLASEGLRAVRYAVNRIDAEMPATAVMKLSRGDAAGLRAFQNIFIRSRLQLIGMTHGIMEYILDNLNRYVRNDIRFVDYERREIQRRHQVSEILYRYVCHSVSPVAPVAHQLMEANIVKTLATEYTYAAAQMLQKLLGAKGFERGHPAGNIAIDIRPFTIFEGPNDMLYAEIYDQFVRATAEEKEAGIKLDKNQTLLDRLQTDVRFAAVARDYALPEDIRSFLQEHTLTDACALQKVFIGKIIARLFVFVQEEHEDTTAFLLNDIRKDILDCRYCG

SEQ ID NO: 4229 - DNA, 246 bp, Neisseria gonorrhoeae
ttgcggatagcgggcaaatacggcggcaggcagatttcgggcggcgcaaaaggcaacgcgcggcattctgcaaaaccgccgattgcggcggataccgcatttcgcgcctcacccttgtgccgctttcccacttaccctatttgttcggaatgtgtttatggaaaagagaaaaatactgccgctggcaatttgtttggcggctttgtctgcctgtacggcgatggaggcccgcacaccccgggcaaa

SEQ ID NO: 4230 - protein, 82 aa, Neisseria gonorrhoeae
LRIAGKYGGRQISGGAKGNARHSAKPPIAADTAFRASPLCRFPTYPICSECVYGKEKNTAAGNLFGGFVCLYGDGGPHTPGK

SEQ ID NO: 4231 - DNA, 1026 bp, Neisseria gonorrhoeae
atggaggcccgcacaccccgggcaaatgaagcccaagccccccgcgcggatgaaatgaaaaaagaaagccgccccgcgtttgacgcggcagccgtaccggtatccgacagcgggtttgccgccaatgcaaatgtccgccgttttgtggacgatgaagtcgggaaaggggatttttcccaggcggaatggcaggatttttttgacaaagcggcttacaaggcggacatcgtcaagattatgcaccgaccctccacatcgcgtccgtggtatgtgttccgcacgggaaattcgggcagggcgaaatttcacggcgcgcgcaggttttatgcggaaaaccgcgcggttatcgatgatgtggcgcaaaaatacggcgtgcctgccgagcttatcgtggcgattatcgggattgaaacgaattacggcaaaaatacgggcagtttccgtgtggcggacgcattggcgactttaggctttgattatccccgccgcgccgggtttttccaaaaagaattggtcgagcttttaaagctggcaaaagaagaaggcggtgatgttttcgcctttaagggcagctatgcgggtgcaatgggtatgccgcaatttatgccttcgagctaccggaaatgggcggtggattatgacggggacggacatcgggatatatggggcaacgtcggtgatgtcgcggcatcggttgccaattatatgaagcagcacggttggcgcacgggcggtaaaatgttggtgtcggcgacgttggcgccgggtgcggatgttcaggcaatcattggcgaaaaaaccgccctgacgcggacggtggcggatttgaaggcgtacggcatcatccccggggaaacgctcgcagatgatgaaaaggcggttttgttcaaactggaaaccgcacccggcgtgtttgaatattatttgggcttgaacaatttttatacggtatggcagtacaaccacagccggatgtatgtaacggcggtcagggacattgccaattcgctcggcggcccgggattg

SEQ ID NO: 4232 - protein, 342 aa, Neisseria gonorrhoeae
MEARTPRANEAQAPRADEMKKESRPAFDAAAVPVSDSGFAANANVRRFVDDEVGKGDFSQAEWQDFFDKAAYKADIVKIMHRPSTSRPWYVFRTGNSGRAKFHGARRFYAENRAVIDDVAQKYGVPAELIVAIIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGETLADDEKAVLFKLETAPGVFEYYLGLNNFYTVWQYNHSRMYVTAVRDIANSLGGPGL

SEQ ID NO: 4233 - DNA, 90 bp, Neisseria gonorrhoeae
gtggcgcgagaaaatgccgagtttgatgagtgccggataaatgtgtatttgcgcgagccagatgtaaaaacaccggctgaagcgggacag

SEQ ID NO: 4234 - protein, 30 aa, Neisseria gonorrhoeae
VARENAEFDECRINVYLREPDVKTPAEAGQ

SEQ ID NO: 4235 - DNA, 816 bp, Neisseria gonorrhoeae
atgatgctttattttgttcggccataccgaacgaaacagagggacactatgcacacatccgcgctccgtatatggctgaaggccgtgctgatacttgccgccggcagcatttttcagacggcatcggcagccgtcgtccacgtttccccgcaagacaaccttgccgaaatttttgcccgcgcccgggcgggcgatacgatcaaactggcttccggcgtatatcaaaccaaactttatatcgacaaaccgattacgattgaagggcctgccgaccgttccgcaaccatcgaaggggacaagagcgggcgtaccatagccgtacacgcgccggacgtaacgctccgcaacctgaccgttacccgttccggtatgagcctgccagcaatggatgccggtatttatctcgaaaaagccgccccgcgcgccctggttgaacacaacaatatttttgataattcgttcggcgtataccttcatggttctgccgatgcgatggtgcgcgagaataaaatcgtcggcgatgcgaccttgcgcgtgaatgagcgcggcaatggcgttaccgtttggaacgcgcccggcgcgcaggtcgtcggcaacgacatttccaaagggcgggacggcattttttccaataccagcacgcacaacacctataaaaacaaccgcttcagcgacctgcgtttcgccgtccactatatgtacaccaacgacagcgaagtcagcggcaatatttccgtgggcaacaatatgggctatgtgctgatgttttccgaacggctcaaagtgttcgacaatatcgccgtcggcagccgcgat

SEQ ID NO: 4236 - protein, 272 aa, Neisseria gonorrhoeae
MMLYFVRPYRTKQRDTMHTSALRIWLKAVLILAAGSIFQTASAAVVHVSPQDNLAEIFARARAGDTIKLASGVYQTKLYIDKPITIEGPADRSATIEGDKSGRTIAVHAPDVTLRNLTVTRSGMSLPAMDAGIYLEKAAPRALVEHNNIFDNSFGVYLHGSADAMVRENKIVGDATLRVNERGNGVTVWNAPGAQVVGNDISKGRDGIFSNTSTHNTYKNNRFSDLRFAVHYMYTNDSEVSGNISVGNNMGYVLMFSERLKVFDNIAVGSRD

SEQ ID NO: 4237 - DNA, 2004 bp, Neisseria gonorrhoeae
atggcagatatgaagaaaattacccctcaaaacctgcgtcccctgctttcggaaagcttgggacataccgattttgtcaacgtcctcaacgcattgattaaatttttgcgccgtggcggcaaaaaatgtgcgggggagcgtttcgacctgattatcgacacattcaaacaagacagggaattactgtcccgcttcagccggtgtttttacatctggctcgcgcaaatacacatttatccggcactcatcaaactcggcattttctcgcgccacagctttgcccgggaaatgggcatacgcatatacgaacgcttcaacccgtcatataaagattttgccaacttgggcgaagtcttcctttatcttttccattccgaaaacgacgacaaatggctgcaaacgctcaatatccgccaatggctggttttatacgaactcatccgtagccacgccgagccgtccaaattgcagacggcgggcatccgccttgccgatgcgcgtttgcgcgccatcgaaatgctgtctgtctggacggcatccgaagccatcgaacccgatctcatccgtatcgccccgcgcctgctggaagccgattcttccttcgtcgccctccaacgcgaaaccgccaaactggtcgaacactaccgcaacggcaccgcgccttacgacaccgcccacctcgaagtgatgttcgaccaatgtttcagccagattgactatttgcgtcgcaaagggacgggcgccggctccggttcgtcggtcaaagtcgcccacctgctcgaacgactccggcagaccgtaggccgtctgaagctgctcacagacatacaaaccggtgccggcaacagcaaccgcctgaccatcgccctgatgaactccctcatctacgcggcggtcgaacaatacagcacccgccacctgcgccgcagcagcatccgtatgctcgcccgcagcattaccgaaaacaaaagccaccacggcgaacactacatcacccgcaaccgcaaagaatatttcaaaatgttctactcggcagcaggcggcggcggcatcatcgccctgatggcgctgctcaaaatccgcatcggcacactcgacctcagtcccttcctcgcttccttgtcggctgggttcaactacggcatcggctttatgatcatccatatgctgcactgcaccgtcgccaccaagcagcccgcgatgactgccgccagctttgccgaacaggtcgatctcaacgaaggcggcaaagcggtggacaacaaactctccaagctcctcatcgacgtatgccgctcccaaagcgtcgccgtcttcggcaacgtttccatcgccatccttttggcgtgcgccatatcgttcggctatgcccatctgtaccggctgcccatactcgatgcccacaccgccgcctaccagttcaaatccatagacatcatcaatcatcctaccctatggtatgccgctattgcaggcttgtggctgttctgctccggcatcatcgcaggttttttcgacaaccgcgccgactacctcaacctgcgccaacgcctgcccttcaatcccttgctgcgtaaaatcatgcgccccgggccccgccgcgtcctcgccgcctacatccacaaacactacggctcgctggtcggcaacttcatcttcggaatgctcttgggtatgaccggctatttcggacacctcctcgggctgccgctggacatccgccacgtcgccttttcctccgccaacctcggctatgccgccgtcagcggcaacgtcggctttggtacattcgtactcggcattttcagcgtcctcgccatcggcttggtcaacctctgcgtcagcttcagcctcgccctcttcgtcgccctgcgctcgcgcggcacaaaaatcggcagcatccgcaacctgatcaaaagtttttggaatcagattaaaagcaatccttgcatacttttcctcccgcccgccaaaggacagggacatcctccttcggacaagcct

SEQ ID NO: 4238 - protein, 668 aa, Neisseria gonorrhoeae
MADMKKITPQNLRPLLSESLGHTDFVNVLNALIKFLRRGGKKCAGERFDLIIDTFKQDRELLSRFSRCFYIWLAQIHIYPALIKLGIFSRHSFAREMGIRIYERFNPSYKDFANLGEVFLYLFHSENDDKWLQTLNIRQWLVLYELIRSHAEPSKLQTAGIRLADARLRAIEMLSVWTASEAIEPDLIRIAPRLLEADSSFVALQRETAKLVEHYRNGTAPYDTAHLEVMFDQCFSQIDYLRRKGTGAGSGSSVKVAHLLERLRQTVGRLKLLTDIQTGAGNSNRLTIALMNSLIYAAVEQYSTRHLRRSSIRMLARSITENKSHHGEHYITRNRKEYFKMFYSAAGGGGIIALMALLKIRIGTLDLSPFLASLSAGFNYGIGFMIIHMLHCTVATKQPAMTAASFAEQVDLNEGGKAVDNKLSKLLIDVCRSQSVAVFGNVSIAILLACAISFGYAHLYRLPILDAHTAAYQFKSIDIINHPTLWYAAIAGLWLFCSGIIAGFFDNRADYLNLRQRLPFNPLLRKIMRPGPRRVLAAYIHKHYGSLVGNFIFGMLLGMTGYFGHLLGLPLDIRHVAFSSANLGYAAVSGNVGFGTFVLGIFSVLAIGLVNLCVSFSLALFVALRSRGTKIGSIRNLIKSFWNQIKSNPCILFLPPAKGQGHPPSDKP

SEQ ID NO: 4239 - DNA, 651 bp, Neisseria gonorrhoeae; identical to SEQ ID NO: 985

SEQ ID NO: 4240 - protein, 217 aa, Neisseria gonorrhoeae; identical to SEQ ID NO: 986

SEQ ID NO: 4241 - DNA, 2748 bp, Neisseria gonorrhoeae
atgaccgacgcaaccatccgccacgaccacaaattcgccctcgaaaccctgcccgtcagccttgaagacgaaatgcgcaaaagctatctcgactacgccatgagcgtcattgtcgggcgcgcgctgccggacgttcgcgacggcctaaagccggtgcaccggcgcgtactgtacgcgatgcacgagctgaaaaataactggaatgccgcctacaaaaaatcggcgcgcatcgtcggcgacgtcatcggtaaataccacccccacggcgattccgcagtttacgacaccatcgtccgtatggcgcaaaatttcgctatgcgttatgtgctgatagacggacagggcaacttcggatcggtggacgggcttgccgccgcagccatgcgctataccgaaatccgcatggcgaaaatctcacatgaaatgctggcagacattgaggaagaaaccgttaatttcggcccgaactacgacggtagcgaacacgagccgcttgtactgccgacccgtttccccacactgctcgtcaacggctcgtccggtatcgccgtcggtatggcgaccaacatcccgccgcacaacctcaccgacaccatcaacgcctgtctgcgtcttttggacgaacccaaaaccgaaatcgacgaactgatcgacattatccaagcccccgacttcccgaccggggcaaccatctacggcttgggcggcgtgcgcgaaggctataaaacaggccgcggccgcgtcgttatacgcggtaagacccatatcgaacccataggcaaaaacggcgaacgcgaagccatcgttatcgacgaaatcccctatcaggtcaacaaagccaagttggtcgagaaaatcggcgatttggttcgggaaaaaacgctggaaggcatttccgagctccgcgacgaatccgacaaatccgggatgcgcgtcgttatcgagctgaaacgcaacgaaaatgccgaagtcgtcttaaaccaactctacaaactgactccgctgcaagacagtttcggcatcaatatggttgttttggtcgacggacaaccgcgcctgttaaacctgaaacagattctctccgaattcctgcgccaccgccgcgaagtcgttacccgacgtacgcttttccggctgaagaaggcacgccatgaagggcatatcgccgaaggcaaagccgtcgcactgtccaatatcgatgaaatcatcaagctcatcaaagaatcgcccaacgcggccgaggccaaagaaaaactgcttgcgcgcccttggcgcagcagcctcgttgaagaaatgctgacgcgttccggtctggatttggaaatgatgcgtccggaaggattggctgcaaacattggtctgaaaaaacaaggttattacctgagcgagattcaggcagatgctattttacgcatgagcctgcgaaacctgaccggcctcgatcagaaagaaattatcgaaagctacaaaaacctgatgggtaaaatcatcgactttgtggatatcctctccaaacccgaacgcattacccaaatcatccgtgacgaactggaagaaatcaaaaccaactatggcgacgaacgccgcagcgaaatcaacccgttcggcggcgacattgccgatgaagacctgattccgcaacgcgaaatggtcgtgaccctgacccacggcggctatataaaaacccagccgaccaccgactatcaggctcagcgtcgcggcgggcgcggcaaacaggcggctgccaccaaagacgaagactttatcgaaaccctgtttgttgccaacacgcatgactatttgatgtgttttaccaacctcggcaagtgccactggattaaggtttacaaactgcccgaaggcggacgcaacagccgcggccgtccgattaacaacgtcatccagctggaagaaggcgaaaaagtcagcgcgattctggcagtacgcgagtttcccgaagaccaatacgtcttcttcgccaccgcgcagggaatggtgaaaaaagtccaactttccgcctttaaaaacgtccgcgcccaaggcattaaagccatcgcactcaaagaaggcgactacctcgtcggcgctgcgcaaacaggcggtgcggacgacattatgttgttctccaacttgggcaaagccatccgcttcaacgaatactgggaaaaatccggcaacgacgaagcggaagatgccgacatcgaaaccgagatttcagacgacctcgaagacgaaaccgccgacaacgaaaacaccctgccaagcggcaaaaacggcgtgcgtccgtccggtcgcggcagcggcggtttgcgcggtatgcgcctgcctgccgacggcaaaatcgtcagcctgattaccttcgcccctgaaaccgaagaaagcggtttgcaagttttaaccgccaccgccaacggatacggaaaacgcaccccgattgccgattacagccgcaaaaacaaaggcgggcaaggcagtattgccattaacaccggcgagcgcaacggcgatttggtcgccgcaaccttggtcggcgaaaccgacgatttgatgctgattaccagcggcggcgtgcttatccgtaccaaagtcgaacaaatccgcgaaaccggccgcgccgcagcaggcgtgaaactgattaacttggacgaaggcgaaaccttggtatcgctggaacgtgttgccgaagacgaatccgaactctccggcgcttctgtaatttccaatgtaaccgaaccggaagccgagaac

SEQ ID NO: 4242 - protein, 916 aa, Neisseria gonorrhoeae
MTDATIRHDHKFALETLPVSLEDEMRKSYLDYAMSVIVGRALPDVRDGLKPVHRRVLYAMHELKNNWNAAYKKSARIVGDVIGKYHPHGDSAVYDTIVRMAQNFAMRYVLIDGQGNFGSVDGLAAAAMRYTEIRMAKISHEMLADIEEETVNFGPNYDGSEHEPLVLPTRFPTLLVNGSSGIAVGMATNIPPHNLTDTINACLRLLDEPKTEIDELIDIIQAPDFPTGATIYGLGGVREGYKTGRGRVVIRGKTHIEPIGKNGEREAIVIDEIPYQVNKAKLVEKIGDLVREKTLEGISELRDESDKSGMRVVIELKRNENAEVVLNQLYKLTPLQDSFGINMVVLVDGQPRLLNLKQILSEFLRHRREVVTRRTLFRLKKARHEGHIAEGKAVALSNIDEIIKLIKESPNAAEAKEKLLARPWRSSLVEEMLTRSGLDLEMMRPEGLAANIGLKKQGYYLSEIQADAILRMSLRNLTGLDQKEIIESYKNLMGKIIDFVDILSKPERITQIIRDELEEIKTNYGDERRSEINPFGGDIADEDLIPQREMVVTLTHGGYIKTQPTTDYQAQRRGGRGKQAAATKDEDFIETLFVANTHDYLMCFTNLGKCHWIKVYKLPEGGRNSRGRPINNVIQLEEGEKVSAILAVREFPEDQYVFFATAQGMVKKVQLSAFKNVRAQGIKAIALKEGDYLVGAAQTGGADDIMLFSNLGKAIRFNEYWEKSGNDEAEDADIETEISDDLEDETADNENTLPSGKNGVRPSGRGSGGLRGMRLPADGKIVSLITFAPETEESGLQVLTATANGYGKRTPIADYSRKNKGGQGSIAINTGERNGDLVAATLVGETDDLMLITSGGVLIRTKVEQIRETGRAAAGVKLINLDEGETLVSLERVAEDESELSGASVISNVTEPEAEN

SEQ ID NO: 4243 - DNA, 105 bp, Neisseria gonorrhoeae
gtggcggatggttgcgtcggtcatggtttcaatgtttcgtatggcaaaaaattgttgcttattttagcatatttcgacatgaaacggtgcggcggttatgccgtc

SEQ ID NO: 4244 - protein, 35 aa, Neisseria gonorrhoeae
VADGCVGHGFNVSYGKKLLLILAYFDMKRCGGYAV

SEQ ID NO: 4245 - DNA, 435 bp, Neisseria gonorrhoeae
ttgcgtcggtcatggtttcaatgtttcgtatggcaaaaaattgttgcttattttagcatatttcgacatgaaacggtgcggcggttatgccgtctgaaacacggtgcggattataatgcggaggaaatttcgtggcggagtttgtcgagaaacctgccttggcggacttgttgtgcggcggtgtcgcagtcttggcgcgcgaatgactgtttcagaccgcagaacagtttttcttgttcggcgcggatttcgttatcgagatttttcaaggattcaaggttgttgcctgcccgtgcctccatcagcgtttcgcgccattccatttgctgcatgaggaagtcgggggcgaaagaggtatgttccggcgcatcggcatcgatacccgatgttttcagcaggtacgcggcgcggtcgatgggatttttcaaggtgcgg

SEQ ID NO: 4246 - protein, 145 aa, Neisseria gonorrhoeae
LRRSWFQCFVWQKIVAYFSIFRHETVRRLCRLKHGADYNAEEISWRSLSRNLPWRTCCAAVSQSWRANDCFRPQNSFSCSARISLSRFFKDSRLLPARASISVSRHSICCMRKSGAKEVCSGASASIPDVFSRYAARSMGFFKVR

SEQ ID NO: 4247 - DNA, 351 bp, Neisseria gonorrhoeae
atgatgtcttccaccatcaacgatgcctaccgcaccttgaaaaatcccatcgaccgcgccgcgtacctgctgaaaacatcgggtatcgatgccgatgcgccggaacatacctctttcgcccccgacttcctcatgcagcaaatggaatggcgcgaaacgctgatggaggcacgggcaggcaacaaccttgaatccttgaaaaatctcgataacgaaatccgcgccgaacaagaaaaactgttctgcggtctgaaacagtcattcgcgcgccaagactgcgacaccgccgcacaacaagtccgccaaggcaggtttctcgacaaactccgccacgaaatttcctccgcatta

SEQ ID NO: 4248 - protein, 117 aa, Neisseria gonorrhoeae
MMSSTINDAYRTLKNPIDRAAYLLKTSGIDADAPEHTSFAPDFLMQQMEWRETLMEARAGNNLESLKNLDNEIRAEQEKLFCGLKQSFARQDCDTAAQQVRQGRFLDKLRHEISSAL

SEQ ID NO: 4249 - DNA, 147 bp, Neisseria gonorrhoeae
atggaaacgggcggccaaggcgcggtaggtttgttccaagttttcggtgccgatatcgaaagcgggttcaatccggaagagggtgaaatattgggacatagtaggatgataaatgtaagattttggcagaaaactgtttttgcctta

SEQ ID NO: 4250 - protein, 49 aa, Neisseria gonorrhoeae
METGGQGAVGLFQVFGADIESGFNPEEGEILGHSRMINVRFWQKTVFAL

SEQ ID NO: 4251 - DNA, 447 bp, Neisseria gonorrhoeae
ttgatactgtcccgccgtttttatgccttaaacgtggaagctctcgccgcagccgcaggagtctttgacattggggttttcaaatttgaaaccttcctgcaaatcttctttggtgtaatcgacttgtgtgccgtccagataaaccaagcttttcgggtcgatataaatgcgcgcgccgtgtccttcgaaaatcaggtcgtcgccgttggcttcatcgacaaattcaaggttgtacgccatccccgagcagccgctggtttttacacccaagcgtacgcccaagcctttgccgcgtttggcgagatagtcattgatgtgttttgcggcattctcggtaagggtaatcatatttcttccttgttgtaccgccccggacggatccgaagcggcgggcggttcggacggcattgtgggacgatgccgtctgaagggctttatctgttttcc

SEQ ID NO: 4252 - protein, 149 aa, Neisseria gonorrhoeae
LILSRRFYALNVEALAAAAGVFDIGVFKFETFLQIFFGVIDLCAVQINQAFRVDINARAVSFENQVVAVGFIDKFKVVRHPRAAAGFYTQAYAQAFAAFGEIVIDVFCGILGKGNHISSLLYRPGRIRSGGRFGRHCGTMPSEGLYLFS

SEQ ID NO: 4253 - DNA, 222 bp, Neisseria gonorrhoeae
atgacgggatgcaggtttccgcgcggacggattcggcattcccgctttcgcagaaatgtcggcttttggtttgttgtctttataagattattcggtaattattctgcggttttgcgtttgtgtgctgccggaatctcaagggattctctgtatttggcaacggtgcggcgggaaacctctataccgcggaaagccagcaggttggcgagtgcctcgtcagaa

SEQ ID NO: 4254 - protein, 74 aa, Neisseria gonorrhoeae
MTGCRFPRGRIRHSRFRRNVGFWFVVFIRLFGNYSAVLRLCAAGISRDSLYLATVRRETSIPRKASRLASASSE

SEQ ID NO: 4255 - DNA, 918 bp, Neisseria gonorrhoeae
gtgaatatcggaatagttgacatagttgagcatgatgccctaatcgcggctgccgacggcgatattgtcgaacactttgagccgttcggaaaacatcagcacatagcccatattgttgcccacggaaatattgccgctgacttcgctgtcgttggtgtacatatagtggacggcgaaacgcaggtcgctgaagcggttgtttttataggtgttgtgcgtgctggtattggaaaaaatgccgtcccgccctttggaaatgtcgttgccgacgacctgcgcgccgggcgcgttccaaacggtaacgccattgccgcgctcattcacgcgcaaggtcgcatcgccgacgattttattctcgcgcaccatcgcatcggcagaaccatgaaggtatacgccgaacgaattatcaaaaatattgttgtgttcaaccagggcgcgcggggcggctttttcgagataaataccggcatccattgctggcaggctcataccggaacgggtaacggtcaggttgcggagcgttacgtccggcgcgtgtacggctatggtacgcccgctcttgtccccttcgatggttgcggaacggtcggcaggcccttcaatcgtaatcggtttgtcgatataaagtttggtttgatatacgccggaagccagtttgatcgtatcgcccgcccgggcgcgggcaaaaatttcggcaaggttgtcttgcggggaaacgtggacgacggctgccgatgccgtctgaaaaatgctgccggcggcaagtatcagcacggccttcagccatatacggagcgcggatgtgtgcatagtgtccctctgtttcgttcggtatggccgaacaaaataaagcatcattcaaatgtgcctgtttttatagcgaaaccgcctgaaacggtacggcaagcggtttggcta

SEQ ID NO: 4256 - protein, 306 aa, Neisseria gonorrhoeae
VNIGIVDIVEHDALIAAADGDIVEHFEPFGKHQHIAHIVAHGNIAADFAVVGVHIVDGETQVAEAVVFIGVVRAGIGKNAVPPFGNVVADDLRAGRVPNGNAIAALIHAQGRIADDFILAHHRIGRTMKVYAERIIKNIVVFNQGARGGFFEINTGIHCWQAHTGTGNGQVAERYVRRVYGYGTPALVPFDGCGTVGRPFNRNRFVDIKFGLIYAGSQFDRIARPGAGKNFGKVVLRGNVDDGCRCRLKNAAGGKYQHGLQPYTERGCVHSVPLFRSVWPNKIKHHSNVPVFIAKPPETVRQAVWL

SEQ ID NO: 4257 - DNA, 1674 bp, Neisseria gonorrhoeae
atgagcgtaggtttgctgaggattctggttcaaaaccaggtggttactgttgagcgggccgagcattactacaatgagtcgcaggcgggtaaggaagtgttgccgatgctgttttcagacggtgtcatttcgcccaagtcgcttgcggcattgattgcgagggtgttcagttattcgattcttgatttgcgtcattatccgcgccacagggtgctgatgggggtgttgacggaggagcagatggtggagttccactgtgtgccggttttccgtcggggcgacaaagtattttttgcggtttccgatccgacccagatgccgcaaattcagaaaaccgtttctgccgcagggattgcggttgagttggtcattgtcgaggatgaccagttggcgggtttgctcgattgggtgggttcgcgttcgacatcgctgcttcaggagcttggggaggggcaagaggaagaggaaagccacaccctgtatatcgacaacgaggaggcagaagacggccctgttccgaggtttatccataaaactttgtcggatgccttgcgtagcggggcatccgacatccatttcgagttttacgaacacaatgcgcgtatccgtttccgtgtggacgggcagctccgcgaggtggttcagccgcccattgcggtaagggggcagcttgcttcccggattaaggtaatgtcgcgtttggacatttccgaaaaacggataccgcaggacggtaggatgcagctgacctttcaaaagggcggcaagcctgtcgatttccgtgtcagcacattgccgacgctgtttggcgaaaaggtcgtgatgcggattttgaattccgatgccgcgtctttgaacatcgaccagctcggttttgagccgttccagaaaaaattgttgttggaagcgattcaccgtccttacgggatggtgctggtaaccggtccgacgggttcgggtaagacggtgtcgctctatacctgtttgaatattttgaatacggagtcggtaaatattgcaacggcggaagaccctgccgagattaacctgccgggcatcaatcaggttaacgtcaatgataagcagggtctgacttttgccgctgctttgaagtctttcctgcgtcaggacccggacatcattatggtcggtgagattcgtgatttggaaactgccgatattgcgattaaggcggcacaaacagggcatatggtgttttccacactgcacacgaataatgcgccggcgacgttgtcgcgtatgctgaatatgggtgtcgcgccgtttaatattgccagttcggtcagcctgattatggcgcagcgtcttttacgcaggctgtgttcgagctgcaaacaggaagtggaacgcccgtctgcctctgctttgaaggaagtcggtttcaccgatgaggatcttgcaaaagattggaaactttaccgcgccgtcggttgcgaccgttgccgggggcagggttataaggggcgtgcgggcgtgtatgaggttatgcccatcagcgaagaaatgcagcgtgtgattatgaacaacggtacggaagtgggtattttggacgttgcctataaggagggtatggtggatttgcgccgggccggtattttgaaaattatgcagggcattacttcattggaagaggtaacggcaaataccaacgat

SEQ ID NO: 4258 - protein, 558 aa, Neisseria gonorrhoeae
MSVGLLRILVQNQVVTVERAEHYYNESQAGKEVLPMLFSDGVISPKSLAALIARVFSYSILDLRHYPRHRVLMGVLTEEQMVEFHCVPVFRRGDKVFFAVSDPTQMPQIQKTVSAAGIAVELVIVEDDQLAGLLDWVGSRSTSLLQELGEGQEEEESHTLYIDNEEAEDGPVPRFIHKTLSDALRSGASDIHFEFYEHNARIRFRVDGQLREVVQPPIAVRGQLASRIKVMSRLDISEKRIPQDGRMQLTFQKGGKPVDFRVSTLPTLFGEKVVMRILNSDAASLNIDQLGFEPFQKKLLLEAIHRPYGMVLVTGPTGSGKTVSLYTCLNILNTESVNIATAEDPAEINLPGINQVNVNDKQGLTFAAALKSFLRQDPDIIMVGEIRDLETADIAIKAAQTGHMVFSTLHTNNAPATLSRMLNMGVAPFNIASSVSLIMAQRLLRRLCSSCKQEVERPSASALKEVGFTDEDLAKDWKLYRAVGCDRCRGQGYKGRAGVYEVMPISEEMQRVIMNNGTEVGILDVAYKEGMVDLRRAGILKIMQGITSLEEVTANTND

SEQ ID NO: 4259 - DNA, 378 bp, Neisseria gonorrhoeae
atgccgtccgaaccgcccgccgcttcggatccgtccggggcggtacaacaaggaagaaatatgattacccttaccgagaatgccgcaaaacacatcaatgactatctcgccaaacgcggcaaaggcttgggcgtacgcttgggtgtaaaaaccagcggctgctcggggatggcgtacaaccttgaatttgtcgatgaagccaacggcgacgacctgattttcgaaggacacggcgcgcgcatttatatcgacccgaaaagcttggtttatctggacggcacacaagtcgattacaccaaagaagatttgcaggaaggtttcaaatttgaaaaccccaatgtcaaagactcctgcggctgcggcgagagcttccacgtt

SEQ ID NO: 4260 - protein, 126 aa, Neisseria gonorrhoeae
MPSEPPAASDPSGAVQQGRNMITLTENAAKHINDYLAKRGKGLGVRLGVKTSGCSGMAYNLEFVDEANGDDLIFEGHGARIYIDPKSLVYLDGTQVDYTKEDLQEGFKFENPNVKDSCGCGESFHV

SEQ ID NO: 4261 - DNA, 384 bp, Neisseria gonorrhoeae
atggcatacagcgataaagtaatcgaccactacgaaaatccccgcaacgtcggcactttcgacaaaaacgacgagtccgtcggcaccggcatggtcggcgcgcccgcctgcggcgacgtgatgcgcctgcaaatcaaagtgaacgatgaaggcatcatcgaagatgcgaaattcaaaacttacggctgcggttccgccatcgcttcgtccagcctgattaccgagtgggtcaaaggcaaaagtctggatgacgcgctggcaatcaaaaacagcgaaatcgccgaagaactggaattgccgccggtaaaaatccactgctccatcttggctgaagatgcggtaaaagcggccgttgccgactaccgcaaacgtcaggaaaacaga

SEQ ID NO: 4262 - protein, 128 aa, Neisseria gonorrhoeae
MAYSDKVIDHYENPRNVGTFDKNDESVGTGMVGAPACGDVMRLQIKVNDEGIIEDAKFKTYGCGSAIASSSLITEWVKGKSLDDALAIKNSEIAEELELPPVKIHCSILAEDAVKAAVADYRKRQENR

SEQ ID NO: 4263 - DNA, 354 bp, Neisseria gonorrhoeae
gtggatttttaccggcggcaattccagttcttcggcgatttcgctgtttttgattgccagcgcgtcatccagacttttgcctttgacccactcggtaatcaggctggacgaagcgatggcggaaccgcagccgtaagttttgaatttcgcatcttcgatgatgccttcatcgttcactttgatttgcaggcgcatcacgtcgccgcaggcgggcgcgccgaccatgccggtgccgacggactcgtcgtttttgtcgaaagtgccgacgttgcggggattttcgtagtggtcgattactttatcgctgtatgccatgatgtggtttccttaaaatatcgtggtttgttgatgttt

SEQ ID NO: 4264 - protein, 118 aa, Neisseria gonorrhoeae
VDFYRRQFQFFGDFAVFDCQRVIQTFAFDPLGNQAGRSDGGTAAVSFEFRIFDDAFIVHFDLQAHHVAAGGRADHAGADGLVVFVESADVAGIFVVVDYFIAVCHDVVSLKYRGLLMF

SEQ ID NO: 4265 - DNA, 324 bp, Neisseria gonorrhoeae
ttggagaagctgaaaaacgaaaactatttgcgggtgttggataaagataaattcgccgagcgtgcagcctattatttggacgagttgaacgtcctacatccttttcgtgaaggaaacggcagaacattgcgcctgtttatgacacaattggcaataaaaaacggttttcagatacattggcaaaatatctctgccgaacaaatgattcaagcctgtattcaggcataccatgccgatagcagcttattggcacgcctaattattagacaatttagaacaatcgtctttttcagacgactaaaacatcaacaaaccacgatattt

SEQ ID NO: 4266 - protein, 108 aa, Neisseria gonorrhoeae
LEKLKNENYLRVLDKDKFAERAAYYLDELNVLHPFREGNGRTLRLFMTQLAIKNGFQIHWQNISAEQMIQACIQAYHADSSLLARLIIRQFRTIVFFRRLKHQQTTIF

SEQ ID NO: 4267 - DNA, 210 bp, Neisseria gonorrhoeae
atgagtaaatacggtggtgaagacgtaatctatatgaatgatggtgtatttagaaataaattagccattcaagatccacttaaatttaaaaaaggtcgaaagagacatttctgctatttccgcccaaaatctgcttttgcaacccattacaggcaatttcgatttggcgcatttacagaccattcatcgcgaactgtttggcaatgttta

SEQ ID NO: 4268 - protein, 70 aa, Neisseria gonorrhoeae
MSKYGGEDVIYMNDGVFRNKLAIQDPLKFKKGRKRHFCYFRPKSAFATHYRQFRFGAFTDHSSRTVWQCL

SEQ ID NO: 4269 - DNA, 105 bp, Neisseria gonorrhoeae
atggagaatttagaaattagccgacaaactcaatatgcaatgcaacttctaaagattggtaaaacaaatattgagaaagaaataagaaaaattaaacaaaggttc

SEQ ID NO: 4270 - protein, 35 aa, Neisseria gonorrhoeae
MENLEISRQTQYAMQLLKIGKTNIEKEIRKIKQRF

SEQ ID NO: 4271 - DNA, 309 bp, Neisseria gonorrhoeae
atgggcggcgcattaagattgatgtcaaacaaaggctgtctgagaaagaataccatgaaagttaaaattattaatttgccaaatggttataaacgtattatttatggaaaatattttgaacaatttgacttagattatgaacaagatttagacgtattaaaaaaagatattgaatttgctttatctgttattgaatacaatcgatctatattcaaaaaattctcttccttatttgagaataaaatcatttttgtttatcaaggaggacatcatcttgatattattgatcgtgataaaggaagtttgaaa

SEQ ID NO: 4272 - protein, 103 aa, Neisseria gonorrhoeae
MGGALRLMSNKGCLRKNTMKVKIINLPNGYKRIIYGKYFEQFDLDYEQDLDVLKKDIEFALSVIEYNRSIFKKFSSLFENKIIFVYQGGHHLDIIDRDKGSLK

SEQ ID NO: 4273 - DNA, 1212 bp, Neisseria gonorrhoeae
atgaccgtcaaaacccccgtttacctcgactacgccgccaccacacccgttgacaaacgcgttgccgaaaaaatgattccctatctgactgaaaccttcggcaaccccgcctccaacagccacgcattcggctggacggcagaagaagccgtcgaaaaagcccgcgccgacatcgccgccctgattaacgccgaccccaaagaaatcgtcttcaccagcggcgcgaccgagtccgacaacctcgccatcaaaggtgcggcaaacttctacaaaaccaaaggcaaacacctcatcaccgtcaaaaccgaacacaaagccgtgctcgacacgatgcgcgaactcgaacgccaaggctttgaagttacctacctcggcgtgcaggaaaacggtttgattgatttggaagaactcaaagccgccatccgcgacgacaccatcctgatttccataatgtgggtgaacaacgaaatcggcgtggtgcaaaacattcccgccatcggcgaaatctgccgcgaacgcaaaatcgccttccacgtcgatgccgcccaagcctgcggcaaagtgcctgtcgatgtcgaagccgccaaaatcgacttgctctcgatgtccgcgcacaaagtgtacggccccaaaggcatcggcgcgctgtacgtccgccgcaaaccgcgcgtccgcctcgaagcccaaatgcacggtggcggtcacgagcgcggtttccgttccggcacattgccgacccatcaaatcgtcggcatgggcgaggccttccgcatcgccaaagaagaattggcacaagacacagcgcactacctgaaactgcgcgacatcttcctcaaaggcatcgaaggcatcgaagaagtctatatcaacggcgacctcgaacaccgcgccccgaacaacctgaacgtcagcttcaacttcgtcgaaggcgaaagcctgattatggcggtgaaagaactcgccgtatccagcggatccgcctgcacctccgcctcgctcgaacccagctacgtcctgcgcgcgcttggccgcaacgacgaactggcgcactcatccctgcgcatcaccttcggccgcatgaccaccgaagaagaagtgcaattcgcggcagaactgatcaaatccaaaatcggcaaactgcgcgaactgtcgccgctgtgggaaatgttcaaagacggtattgatctgaactcgattgaatgggcggcgcat

SEQ ID NO: 4274 - protein, 404 aa, Neisseria gonorrhoeae
MTVKTPVYLDYAATTPVDKRVAEKMIPYLTETFGNPASNSHAFGWTAEEAVEKARADIAALINADPKEIVFTSGATESDNLAIKGAANFYKTKGKHLITVKTEHKAVLDTMRELERQGFEVTYLGVQENGLIDLEELKAAIRDDTILISIMWVNNEIGVVQNIPAIGEICRERKIAFHVDAAQACGKVPVDVEAAKIDLLSMSAHKVYGPKGIGALYVRRKPRVRLEAQMHGGGHERGFRSGTLPTHQIVGMGEAFRIAKEELAQDTAHYLKLRDIFLKGIEGIEEVYINGDLEHRAPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 4275 - DNA, 93 bp, Neisseria gonorrhoeae
atgcaaaccgtcaaacctcgccaacaggaatcgaacctgtattttacgcttaggaggcatacgttctatccgttgaactatggcgagccgaaa

SEQ ID NO: 4276 - protein, 31 aa, Neisseria gonorrhoeae
MQTVKPRQQESNLYFTLRRHTFYPLNYGEPK

SEQ ID NO: 4277 - DNA, 99 bp, Neisseria gonorrhoeae
atggcgtctgaaggcaacaggtcttcagacggcatttatagccaaaccgcttgccgtaccgtttcaggcggtttcgctataaaaacaggcacatttgaa

SEQ ID NO: 4278 - protein, 33 aa, Neisseria gonorrhoeae
MASEGNRSSDGIYSQTACRTVSGGFAIKTGTFE

SEQ ID NO: 4279 - DNA, 144 bp, Neisseria gonorrhoeae
gtgtcggataagggttggaaaagacatccggaatccggattattgaaaaagattcttaattataaggcaacggagcaaagcagggcaagaaaacgagtaggcggcgcgggggtttccgcccgccattcaaacgtccggcagaca

SEQ ID NO: 4280 - protein, 48 aa, Neisseria gonorrhoeae
VSDKGWKRHPESGLLKKILNYKATEQSRARKRVGGAGVSARHSNVRQT

SEQ ID NO: 4281 - DNA, 783 bp, Neisseria gonorrhoeae
cggtttgacaccgttttcttccaaaagggcatcgattttcaagcgggctttttcctgcctcaaaccttgttccaactggtttctgaccaactcgaaaggctgcgcgtcggggtttttcccgaccgcgccgagtttgaacaggtaatagcgttcgcccaatttgaccggattgcgggtaacgtcgccacggttcataccggcaaactgcgaagccagcggctcgggaagctgctgcgccataatgaaaccgtcgaacgcctgctcgtcgttcggataacgcttcatcagcccttcaaaagacagccctttgagcaggagctgctgcgcctgacgcgcctcctcttcggttgcgaagctgacctgctgcaatttgatcatgcggatttgccgctcataaaactgacgcagtgcgctttcggaaaccgtttccgaacgttccagaaaacggacgtactcctcggcataaaaagacgcttcggcgattttaaagcggttttggacatccttatccttatccaaaccttccttcaatgccctgtttttcaaaacttccaaagtttgcagccggcggacggcatcgtttcggattgcctgcccgtccggtctttgggactgctccgcatgccggtctgcctgctgcatgatctgcgccaccagcgtatccaccaaagccgggtcgatttcgggtgctttggctgccgcaaaacctgccaacattgcagcaataactgcggcagcggtctttttctgtttcatggtattccctgtcctgcgcggcggcaa

SEQ ID NO: 4282 - protein, 261 aa, Neisseria gonorrhoeae
RFDTVFFQKGIDFQAGFFLPQTLFQLVSDQLERLRVGVFPDRAEFEQVIAFAQFDRIAGNVATVHTGKLRSQRLGKLLRHNETVERLLVVRITLHQPFKRQPFEQELLRLTRLLFGCEADLLQFDHADLPLIKLTQCAFGNRFRTFQKTDVLLGIKRRFGDFKAVLDILILIQTFLQCPVFQNFQSLQPADGIVSDCLPVRSLGLLRMPVCLLHDLRHQRIHQSRVDFGCFGCRKTCQHCSNNCGSGLFLFHGIPCPARRQ

SEQ ID NO: 4283 - DNA, 396 bp, Neisseria gonorrhoeae
ttggcgatgaacgcgcaaaccggcgccgtcaaactcagtgccatcagcgaacgccaaaatatatccctctcctatctcgagcaattgttcggcaaactccgccgcgccggactggttgaaagcctgcgcgggcccggcggcggctacatcctcgccgcccctcccgcacaaatcaacatcgcccaaatcatttccgccgccgaagaccggctggacgcgacccaatgcggcagcaaagccaactgccaccacggcgcgccctgcctgacgcacgacctttgggagaatttaaacaaaaccatcaacgactatctcggcagcgttaccctgcaaagcatcatcgaacagaaaaacaacggcgacggcagccgcgtcgtccaatttacacacatccat

SEQ ID NO: 4284 - protein, 132 aa, Neisseria gonorrhoeae
LAMNAQTGAVKLSAISERQNISLSYLEQLFGKLRRAGLVESLRGPGGGYILAAPPAQINIAQIISAAEDRLDATQCGSKANCHHGAPCLTHDLWENLNKTINDYLGSVTLQSIIEQKNNGDGSRVVQFTHIH

SEQ ID NO: 4285 - DNA, 243 bp, Neisseria gonorrhoeae
ttggtggtcagtctcatggtggtggttgcccgtgtcggcttttttatagtgggcggaattgtccaatatctgagtgtttcagtcaagtatgggggagctgttgccgattgtttgtttaaatggcggtatagtctgattttgctttatttgtttggttttttgaatcagttagttatgttttttgaggagcggcggttggggcgttttgccggcaagcggtttcaaaacgatttgatttatttt

SEQ ID NO: 4286 - protein, 81 aa, Neisseria gonorrhoeae
LVVSLMVVVARVGFFIVGGIVQYLSVSVKYGGAVADCLFKWRYSLILLYLFGFLNQLVMFFEERRLGRFAGKRFQNDLIYF

SEQ ID NO: 4287 - DNA, 1170 bp, Neisseria gonorrhoeae
atgaaacgtgatttgagcaaaatgacctgcattgaagacttgcaccgcgttgccaagcgcaaaatgccgcgtatgttttacgattacatcgattcgggttcgtggacggaaacgacttatagggagaatacttcggatttcaaagatatccgcttccgacaaaaggtattggtcaatatggagggacgcagcctcgaaaccaaaatgatcgggggggatgtgaaaatgccggtggcgattgcgccgacgggttttaccggcatggcacacgcagacggcgaaattttggcggcgcgtgcggcggagaagttcggtattccgtttacgttgtccaccatgtccatctgctcgattgaagacgttgccgagaacaccagcgcgccgttttggtttcagctttatgtgatgcgcgaccgcgaatttatggaaaacctgattaagcgtgcgaaagatgccaaatgttcggcattggtattgactgccgatttgcaggttttgggtcaacgccacaaagacatcaaaaacggcctgtccgcgccgccgaaaccgaccatcgccaatttaatcaatctggcgaccaagcccgaatggtgcatgaaaatgctgaacacggaacgccgcacgttccgcaatatcgtcggacacgccaaaaacgtcggcgatttgtcttcactttcttcgtggacggcggaacagttcgacccgcgcttaagctgggacgacgtggcgcggattaaagatttgtggggcggcaagctgattatcaaaggcattatggaacccgaagacgcggaaaaggcggcgaaaagcggtgcggatgcattggtcgtttccaaccacggcggccgccagctcgacgatactgtgtccgccatcaaggccttgcccgatattgtttccgcagtcggcagcgacatcgaagtttggatggacagcggtatccgcagcggtcaggatattttgaaggcgtgggctttgggtgcgaaaggcacgatgataggtcgggcgttcctgtatggtttgggtgcgtatggcgaagaaggcgtaacgcgcgcgctggagattttgtacaaggaaatggatgtgtcgatggcgtttacgggacaccgcgatattcaagatgtcgatgcctcgattttgaggagtaaggattggggcagggaaacggtt

SEQ ID NO: 4288 - protein, 390 aa, Neisseria gonorrhoeae
MKRDLSKMTCIEDLHRVAKRKMPRMFYDYIDSGSWTETTYRENTSDFKDIRFRQKVLVNMEGRSLETKMIGGDVKMPVAIAPTGFTGMAHADGEILAARAAEKFGIPFTLSTMSICSIEDVAENTSAPFWFQLYVMRDREFMENLIKRAKDAKCSALVLTADLQVLGQRHKDIKNGLSAPPKPTIANLINLATKPEWCMKMLNTERRTFRNIVGHAKNVGDLSSLSSWTAEQFDPRLSWDDVARIKDLWGGKLIIKGIMEPEDAEKAAKSGADALVVSNHGGRQLDDTVSAIKALPDIVSAVGSDIEVWMDSGIRSGQDILKAWALGAKGTMIGRAFLYGLGAYGEEGVTRALEILYKEMDVSMAFTGHRDIQDVDASILRSKDWGRETV

SEQ ID NO: 4289 - DNA, 2772 bp, Neisseria gonorrhoeae
atggcgaataataaaacgttgtttgattgggtggaagaccgcaaatcaatgctggaagaaatggaacagacggattttttcgcgctgcctgaatttgtttccaataatttaaaatatccgttttttgaatggcaaaaatcggctttagaaaattttgtgatttttgaccgcacttcaaaattaaaggatttccccgacatcaaaaaccgccctacccatttgctgttcaatatggcaacaggtgcaggcaaaacgatgatgatagcggcattgattctgtattattttgagaaagggtatcggcattttttatttttcgtcaataaaaacaatatagtatataaaacggaaaataattttatcgacccgacgcatccaaaatttttatttaccgagaaaattttgcaaggtgatacggtaattcccattcgcaaagtggagacatttagccaatattcagacggcattgaaattaaatttaccagcattcaaaaactatataacgatattcacaccgagcgagaaaatcaaaccacattggcggatttgcacgaattaaatcttgtgattctgggcgatgaagcacaccatttaaacgcgcaaaccaaaggcaaaaaacaaggcgaattagatttagaaaaggaaatgaacgagcgtaccagcgatgccgaaattgaacgcaaaggctgggagcatatggttttggagttgttactcaataaaaatggcaatcccggccaaaatgtgctgttggaatttaccgccacactgcctgaaaatgctgaagtgcaacaaaaatatgcggataaaatcatcacaaaatttgggttaaaagaatttttgcaaaaaggttataccaaagaaatcaatttggtatccggtacgctgaataagaaagagcgggtgttgcacgctttattgtttgcctggtaccgccatcaaatcgcgttgaaatacggcattgccaatttcaagcctgtgatgttgtttagaagtaagacgattgatgaatcaaaagcggattattcggcgtttttaaattgggtagaaaatgtgcaagcggatgatttttcgtttttaactacattttcaacaagcttaagcgatagcaataacgccaacgaacaaggcaaaacccgtaccgaacaagccctaaaatttatgcaggaaaataaatttgagtttgtgcatttggcaaattgggtgaaacaaaattatcaaaaacataatgtcattattaccaactccgaaaccaacaaaaccaaaactgaaaaaaccgacagcgaaaccgaaaaattgctaaacaatttggaagcggctgataatccgatccgtgccatttttacggtggatagattaaccgaaggttgggacgttttaaatttgtttgatattgtgcgtttgtatgaagggcaaaacggtggcggttcgaataaaaaatcgggcaaaacggctgccgccaccgtatcggaaaagcagttgattggtcgcggcgtgcgttattttccatttgcgtttgaaggtaaacagccgaataaacgcaaatttgacaacgatatgcaacatgaattgcgtatcttggaagaattgttttattacacgcacgatgagcaatcccgctatattacagaactgaaaaacgagttacgaaaagacggttatttgcctgaaaaagacgatgataaggtattgacaacatttaagctcaaatctgaatttgcagataataaggattttagagagttgttaatttgggcgaataaaaaaatccccaacccaaacgccaaaagcaataatgcagacagcctgcaagccaatccgcaaacgctttcattccaagttcacggtaatcaactgttgcaggaaacgcaatttacagccgatgaaaatgatgaaacagcccgacaaatcggcacacaaaataattttactcaaaccataaaaatgagtgaaatggagcggcatattttcaataaagcattacatatcaaagggaaaaatagtcaatctttattccattttgaccgcctgcaaagcaaactcgacattcaaaatcgcaatgaattgcaaaataaattgttgaaagactggcagattgaatttttgggattagagcaagataaacaggttcgcccggatgataaacttgcaggctgcctgaaaatcttggaaatggttgaaaaacatctgaatgaaagtgatataccgtttatcggtacaaaagaatttacacctaaaaaattgtgggaaattttcggcacgccaaaacaaaaatgggtcaaaaaagatgatataaaaactgctattgccacgcaaaatgattggtatgtgatggataattttgccggaacgggtttggaagaagcgttaattcaatttatttcagcgcgcttgggcgatttgaaatctcaatatgacgttcatttaatccgcaatgaagaagtgtttaaattgaataactttgccgatggcgaaggatttatgccggactttgttttattgctgaaagataaacaaaaatcttcttccgacagcgtggacgactttttgcattaccaaattttcattgaaccgaaaggcgggcatttagtggaaaatgattcgtggaaagaagcttttttaaaatcaatcacagtggaatatgggagggataagatcctgcaaaaaaatacaccgcattatcgtttgatcggtttgccgttttttactgatcatcagaaaaatggacaatttacagagttattccctttaggtgcggcatcgcttgaaaaa

SEQ ID NO: 4290 - protein, 924 aa, Neisseria gonorrhoeae
MANNKTLFDWVEDRKSMLEEMEQTDFFALPEFVSNNLKYPFFEWQKSALENFVIFDRTSKLKDFPDIKNRPTHLLFNMATGAGKTMMIAALILYYFEKGYRHFLFFVNKNNIVYKTENNFIDPTHPKFLFTEKILQGDTVIPIRKVETFSQYSDGIEIKFTSIQKLYNDIHTERENQTTLADLHELNLVILGDEAHHLNAQTKGKKQGELDLEKEMNERTSDAEIERKGWEHMVLELLLNKNGNPGQNVLLEFTATLPENAEVQQKYADKIITKFGLKEFLQKGYTKEINLVSGTLNKKERVLHALLFAWYRHQIALKYGIANFKPVMLFRSKTIDESKADYSAFLNWVENVQADDFSFLTTFSTSLSDSNNANEQGKTRTEQALKFMQENKFEFVHLANWVKQNYQKHNVIITNSETNKTKTEKTDSETEKLLNNLEAADNPIRAIFTVDRLTEGWDVLNLFDIVRLYEGQNGGGSNKKSGKTAAATVSEKQLIGRGVRYFPFAFEGKQPNKRKFDNDMQHELRILEELFYYTHDEQSRYITELKNELRKDGYLPEKDDDKVLTTFKLKSEFADNKDFRELLIWANKKIPNPNAKSNNADSLQANPQTLSFQVHGNQLLQETQFTADENDETARQIGTQNNFTQTIKMSEMERHIFNKALHIKGKNSQSLFHFDRLQSKLDIQNRNELQNKLLKDWQIEFLGLEQDKQVRPDDKLAGCLKILEMVEKHLNESDIPFIGTKEFTPKKLWEIFGTPKQKWVKKDDIKTAIATQNDWYVMDNFAGTGLEEALIQFISARLGDLKSQYDVHLIRNEEVFKLNNFADGEGFMPDFVLLLKDKQKSSSDSVDDFLHYQIFIEPKGGHLVENDSWKEAFLKSITVEYGRDKILQKNTPHYRLIGLPFFTDHQKNGQFTELFPLGAASLEK

SEQ ID NO: 4291 - DNA, 2130 bp, Neisseria gonorrhoeae
ttgttattgaataatgatgagttaaaacgccatttctttgtggaagtgaatggtgttttggtgtttaaattgcaggattttcgttttttcttggacaaacacagcatcaataattcctacacaaaatacgccaaccgcattggtttgacggacggcaaccgctttttgaaagacaattcggatattgtgttggattttccgtttaaagattgcgtattgaatggcggacaaagcaccgaagaaggcgaagaaatttattttaaacgcaataatagccagccagccagccagccagccagccagccagccagccagccagccagccagccagccagccagccagccagccagccagccagccagccagccagccagccagccagccagccagccagccagccagccagccagccagccagccaattatacaccaaattaaccagaaaaagacaagaaatcttttttaatcaaacgcttgcttttgatgaaattgaccggctttttgacgcaaaagcattctcaaaattctcccgccacaccgcagacggcaaacaacccgttggcgaaatcaaacgccgttcagacggtacgccagccgaaaatctcattatcaaaggcaataatctgattgccatgcattcgcttgccaagcagtttaaaggcaaagtaaagttgatttatattgatccaccgtataatacagaaaccgatagctttgcatataacgataaattttcacattccacttggctaacatttatgaaaaatcgcttggaaattgcgaaagagttattaaaagatgatgggctaatctttgttcaatgcgatgataaggaacaggcttatttaaaagttttattagatgaaacttttacaagagaaaattttataaactgcattgctgtaaaaatgtcagagccatcaggtaacaaaatggcacatacatcgcatagactaccaaagataaaggaatatattcttatctataagaataaaaatataaaattaaaccctattagagagcaaaaatcagaatgggacaatgagtacaatatttttttagaaaattttacacaagaagataaaaaatttattgatttaatagtaaatagccaaacagaaaataaagaaataaatggtaatactttaaaagaaattgatattcttttaaagaaaatatctcctatttcagttaatcaaaaattagcccaattaaatattaaagataatgaagttataaaatggaaactagataatgcgtatagaattgtaagaacagcagctagtagtagcgtaaaaaaattagcagatgaaaaaaaagaaatttgccaacaacaatttttttcagttatttctaaacgagataaattattgtatatcgtcaagtcagattactcaaaagatgcaaaagcaccacgagtgcaggttttgtttgcagaagattatttgagtattagtttatgcgatttatggacaaatataaataccacaggactagaagcagaaggaaatgtagagttaaaaaatggtaaaaagccagaaagtttaattgaaaccatcattaaactagcaaccaacgaaaacgacatcgttctagactaccacttgggcagtggcacaaccgccgccgtcgcccataaaatgaaccgccaatacatcggcattgaacaaatggattatattgaaacgcttgccgttgaacgcatgaaaaaagtaattgacggcgagcaaggcggtatctcaaaagctgtgaattggcaaggtggtggcgagtttgtttatgccgaactttccccatttaacgaaaccgcaaaacaacaaattttggcgtgcgaaaattcagacggcatcaaaacgctgtttgaaggtttatgcgaacgccatttcttgaaatacaacgtcagcgtaaatgaatttagccaaattattgaagagcctgaatttcaatccttggcattagacgaacaaaaacaaatgatgcttgaaatgttggatttaaatcaaatgtatatttcattatccgaaatggacgatgaacaatttgcaggctgcctgaatgatgatgataaagcgttaagccgtgcgttctatcaatcagtaaaacatcaagcggagaaaaaagatggcgaa

SEQ ID NO: 4292 - protein, 710 aa, Neisseria gonorrhoeae
LLLNNDELKRHFFVEVNGVLVFKLQDFRFFLDKHSINNSYTKYANRIGLTDGNRFLKDNSDIVLDFPFKDCVLNGGQSTEEGEEIYFKRNNSQPASQPASQPASQPASQPASQPASQPASQPASQPASQPASQPASQPASQLYTKLTRKRQEIFFNQTLAFDEIDRLFDAKAFSKFSRHTADGKQPVGEIKRRSDGTPAENLIIKGNNLIAMHSLAKQFKGKVKLIYIDPPYNTETDSFAYNDKFSHSTWLTFMKNRLEIAKELLKDDGLIFVQCDDKEQAYLKVLLDETFTRENFINCIAVKMSEPSGNKMAHTSHRLPKIKEYILIYKNKNIKLNPIREQKSEWDNEYNIFLENFTQEDKKFIDLIVNSQTENKEINGNTLKEIDILLKKISPISVNQKLAQLNIKDNEVIKWKLDNAYRIVRTAASSSVKKLADEKKEICQQQFFSVISKRDKLLYIVKSDYSKDAKAPRVQVLFAEDYLSISLCDLWTNINTTGLEAEGNVELKNGKKPESLIETIIKLATNENDIVLDYHLGSGTTAAVAHKMNRQYIGIEQMDYIETLAVERMKKVIDGEQGGISKAVNWQGGGEFVYAELSPFNETAKQQILACENSDGIKTLFEGLCERHFLKYNVSVNEFSQIIEEPEFQSLALDEQKQMMLEMLDLNQMYISLSEMDDEQFAGCLNDDDKALSRAFYQSVKHQAEKKDGE

SEQ ID NO: 4293 - DNA, 888 bp, Neisseria gonorrhoeae
taccgcggaaagccagcaggttggcgagtgcctcgtcagaataggacttgggcgtggacgaggcaaaaccggcggcgggaaaggggttgagcgaagcaatgaggccgagtgcggcttcgagtgtgccgctgtcggtttggggcaggcgttttttattcgcgccggggtttggctgcggttgccgtcaatgctgtcgagggcgtttcggacgatatgcagggcggcgggtttggcagcacattcgcccgatctttctatctgcaatatcaacgattcggtcacatcggcggcggccatgcctgccggatcgaattttttcaatgcggtcagggcttgtttcagcattgcttcatccaacatccactccaagggcgtatggtccaggatgtcttcgatgctgtcggtcaggtagccctgctcgtcaaggaaatcgataaggatgtggacgcaggcggcttcttggtcggaaagggggtgttcgcacgcttgcgcgtgcaggtattgcttgaaatcttcttcgccggcgatgttggacagcatatcttcgccttcgtctccgccgatttgacgcgcgggcgcggtgtaatggctgaattcggcatcggaaaattcatccgtttctttgcgttcgagcagggggttgtccgacggccagttttcgacctcgcgttcaagttcgatacccggcatctgcaatacgcgcaaagattgttgcagccgctggtcgagctgctgggtctgtttgagctttattccgattaaggtaatgataatgcggtaaaaattgttattttcagcctgtcggcgcaaaaaaatgccgcaaagcgtcattgcattataaatggttttaatgagcgggttcggattccgtccgataacaaaaaacaa

SEQ ID NO: 4294 - protein, 29 aa, Neisseria gonorrhoeae
YRGKPAGWRVPRQNRTWAWTRQNRRRERG

SEQ ID NO: 4295 - DNA, 354 bp, Neisseria gonorrhoeae
ttggaacaggcgaaaaaagacggtgtcgagctggaaaaagccgccaaagccgtacgcgaaggcaacaaagtacgcgtgtatatgacggccgtcgcgcctgcttacagtatcccgcagtttgaagtgaaccaaggcgacgaagtaaccgtttacgttaccaacgtcgaaaccatcgaggacctgacccacggcttcactttggaaggctgcggcatcgctatggaaatcggcccgcaagccacttcttccgtaaccttcaaagccgtccgcccgggtgtgcactggtactactgccaatggttctgccacgcattgcatatggaaatgtccggtcagatgattgttcatcccaaa

SEQ ID NO: 4296 - protein, 118 aa, Neisseria gonorrhoeae
LEQAKKDGVELEKAAKAVREGNKVRVYMTAVAPAYSIPQFEVNQGDEVTVYVTNVETIEDLTHGFTLEGCGIAMEIGPQATSSVTFKAVRPGVHWYYCQWFCHALHMEMSGQMIVHPK

SEQ ID NO: 4297 - DNA, 165 bp, Neisseria gonorrhoeae
atgaggatttataacgatgaagacaggcattcaaaccgaattagcccaagccctgctatcacacgaaaaaatatgggcgaacgaagaaaaaaccattttggccaaaaacatcctgttggatttggtggaaaaaaccgacccgtccattatcggtttgttattgaa

SEQ ID NO: 4298 - protein, 55 aa, Neisseria gonorrhoeae
MRIYNDEDRHSNRISPSPAITRKNMGERRKNHFGQKHPVGFGGKNRPVHYRFVIE

SEQ ID NO: 4299 - DNA, 129 bp, Neisseria gonorrhoeae
ttgaataatatgttgatatttccgcaaaatcccgatgcattcggacacccgccccgcttatcgcaacgttgcgaacgcccccggaaacagcaaagacagcaaagaattgattttattataatttatttg

SEQ ID NO: 4300 - protein, 43 aa, Neisseria gonorrhoeae
LNNMLIFPQNPDAFGHPPRLSQRCERPRKQQRQQRIDFIIIYL

SEQ ID NO: 4301 - DNA, 114 bp, Neisseria gonorrhoeae
ttgcggaaatatcaacatattattcaaacgcagcccgtatttttaaccgccgctcaggcggaggatgccgccgtgttcatcaggcgcaaggctttcatacggcatatttccttt

SEQ ID NO: 4302 - protein, 38 aa, Neisseria gonorrhoeae
LRKYQHIIQTQPVFLTAAQAEDAAVFIRRKAFIRHISF

SEQ ID NO: 4303 - DNA, 918 bp, Neisseria gonorrhoeae
atgaccaataaacccgccaaacgcccggtcaacggcgttcttcttctcgacaaacccgaaggcctttccagcaacaccgccctgcaaaaagcgcggcgtttgtttcatgccgaaaaagcagggcataccggcgtgctcgatcctttggcaaccggacttttgcccgtctgcttcggcgaagcggccaagttcgcccaatacctgctggatgccgacaaagcctacaccgccacgctgaaactcggcgaagccagcagcacgggcgatgccgaaggagaaatcattgccgccgcccgcgccgatatttccttagccgaatttcagacggcctgccaagcactgacaggcaacatccgccaagtgccgccgatgttttccgccctcaagcacgaaggcaaaccgttgtacgaatacgcgcgcaaaggcattgttatcgaacgcaaaccgcgcgacattaccgtttactctatcgatattgccgagtttgacgcgcccaaagccgtgataagcgtgcgttgcagcaaaggcacctacatccgcaccctcagcgaaggcatcgccaaacacatcggcacattcgcccacctgaccgccctacgccgcaccgaaaccgccggctttaccatcgcccaaagccacacgctcgaagctttggcaaatttaaacgaaacagaacgcgacggtctgctgctgccctgcgacgtattggtttcacactttccccaaaccgttttaaacgattatgccgtccatatgctccaatgcgggcaacggccgcgtttcgaggaagacctgccttccgatacgccggtacgcgtttacacggaaaacggccgctttgtcggtttggcggaatatcaaaaggaaatatgccgtatgaaagccttgcgcctgatgaacacggcggcatcctccgcc

SEQ ID NO: 4304 - protein, 306 aa, Neisseria gonorrhoeae
MTNKPAKRPVNGVLLLDKPEGLSSNTALQKARRLFHAEKAGHTGVLDPLATGLLPVCFGEAAKFAQYLLDADKAYTATLKLGEASSTGDAEGEIIAAARADISLAEFQTACQALTGNIRQVPPMFSALKHEGKPLYEYARKGIVIERKPRDITVYSIDIAEFDAPKAVISVRCSKGTYIRTLSEGIAKHIGTFAHLTALRRTETAGFTIAQSHTLEALANLNETERDGLLLPCDVLVSHFPQTVLNDYAVHMLQCGQRPRFEEDLPSDTPVRVYTENGRFVGLAEYQKEICRMKALRLMNTAASSA

SEQ ID NO: 4305 - DNA, 543 bp, Neisseria gonorrhoeae; identical to SEQ ID NO: 277

SEQ ID NO: 4306 - protein, 181 aa, Neisseria gonorrhoeae; identical to SEQ ID NO: 278

SEQ ID NO: 4307 - DNA, 369 bp, Neisseria gonorrhoeae
atgaaaaaaccccaacgcggctacgcccgccaagaccgtgtcaaagaacaaattatgcgcgagcttgccgaactcgtccgtaccggactgaaagacccgcgcgccggcttcatcactatcaacgaagtcgaaattacccgcgattacagccacgccaccgtgttctacaccgttttgaaccaagatacgcgcgaaattacggaagaagtgctggaacacgcgcgcggacacctccgcagcgaattgtccaaacgcatcaagctgttcaaaatccccgaactgcatttcaaatacgacgaatctttggaacgcggtatgagcctgtccgcccttatcgatcaagtggcggcggaaaaaccggttgaagac

SEQ ID NO: 4308 - protein, 123 aa, Neisseria gonorrhoeae
MKKPQRGYARQDRVKEQIMRELAELVRTGLKDPRAGFITINEVEITRDYSHATVFYTVLNQDTREITEEVLEHARGHLRSELSKRIKLFKIPELHFKYDESLERGMSLSALIDQVAAEKPVED

SEQ ID NO: 4309 - DNA, 456 bp, Neisseria gonorrhoeae
ttgttcattctggcagtatcagtcttcaaccggtttttccgccgccacttgatcgataagggcggacaggctcataccgcgttccaaagattcgtcgtatttgaaatgcagttcggggattttgaacagcttgatgcgtttggacaattcgctgcggaggtgtccgcgcgcgtgttccagcacttcttccgtaatttcgcgcgtatcttggttcaaaacggtgtagaacacggtggcgtggctgtaatcgcgggtaatttcgacttcgttgatagtgatgaagccggcgcgcgggtctttcagtccggtacggacgagttcggcaagctcgcgcataatttgttctttgacacggtcttggcgggcgtagccgcgttggggttttttcatgaatatcctcagatttggtgtcagacggcatttctgccgccggggcggttgcgaaagggcgtatta

SEQ ID NO: 4310 - protein, 152 aa, Neisseria gonorrhoeae
LFILAVSVFNRFFRRHLIDKGGQAHTAFQRFVVFEMQFGDFEQLDAFGQFAAEVSARVFQHFFRNFARILVQNGVEHGGVAVIAGNFDFVDSDEAGARVFQSGTDEFGKLAHNLFFDTVLAGVAALGFFHEYPQIWCQTAFLPPGRLRKGVL

SEQ ID NO: 4311 - DNA, 231 bp, Neisseria gonorrhoeae
aatcaatttcatagttttaataacgaaaatcttggcgtataatcgcatccatagtttttgcaaaaggaaaataaaatgtcgattcaagaaatttattacaatcaagaaaccggttacgaatacgctttccgccaaatcgtactgtaagccgtttgccccccatttgaccaacctgagaaaaggaacaagagcgatgactacctccaaatgccccgtaacccatctgaccat

SEQ ID NO: 4312 - protein, 13 aa, Neisseria gonorrhoeae
NQFHSFNNENLGV

SEQ ID NO: 4313 - DNA, 144 bp, Neisseria gonorrhoeae
gtgtgcgttgcagaaacggcatgcgccgttcgggttgccaagtataataactatatccgtgcttatcaacgtattaccttaaaatcccgccgattcggctataatacgccctttcgcaaccgccccggcggcagaaatgccgtc

SEQ ID NO: 4314 - protein, 48 aa, Neisseria gonorrhoeae
VCVAETACAVRVAKYNNYIRAYQRITLKSRRFGYNTPFRNRPGGRNAV

SEQ ID NO: 4315 - DNA, 1242 bp, Neisseria gonorrhoeae
atgtccaacgaaaaccgtacctgttccttttgcggaaaatccaaatcacacgccaaacacctgattgagggcaaaaacgcctatatctgcgacgaatgcgtcgcaaactgcctcgaaatattgtacgaaggcgacaacggcggcacgcctccggaaaatgccggaggggagccggaagaatccggcaaactgcccacgcccgccgaaatcgttgccaacctcgacgattatgtcatcgggcaggggcaggcgaaaaaggcgctggcggttgcggtttacaaccattacaaacgcctgcgccacccgaaagccgacggcggtgtcgaattgtcgaaatccaacatcctgcttatcggcccgaccggatcgggtaaaacgctgttggcgcaatctttggcacgcaaactggacgtgccgttcgtgatggcggatgcgaccacgctgaccgaagccggctatgtcggcgaagatgtcgaacaaatcattaccaaactgttgggcaaatgcgatttcgatgtcgaaaaagcccggcacggcattgtctatattgacgaaattgacaaaatttcgcgtaaaagcgacaacccgtccatcacgcgcgacgtgtccggcgaaggcgtgcagcaagccttgctgaaactgattgaaggtacggtggcaagcgttccgccccaaggcggacgcaagcatccgaatcaggaatttatcaacgttgataccgccaacatcctgtttatctgcggcggcgcgtttgcaggcttggaaaaagtgattcgccagcgcaccgagaaaggtggtatcggtttcggcgcgtccgttcacagcaaggacgaaaatgccggcattaccaagctgttcggcatcgtcgaaccggaagatttaatcaaattcggcctgattccggaattaatcggacgtttgcccgtgattgcaactttagaagaactggatgaggacgcgctgattaatattttaaccgagccgaaaaacgctttggtcaagcagtatcaagccttgttcggcatagaaaacgtcgggttggaatttgaagaaggcgcattgcgttccatcgcgcggcaggcaatggaacgcaaaaccggcgcgcgcggcctgcgttccatcgtcgaacgctgcctgctcgatacgatgtaccgcctgcccgatttgcaaggcttgaaaaaagtggtggtcggcaaggcagtcatcgaagagggcagggaaccggaattggtgttcgagtcc

SEQ ID NO: 4316 - protein, 414 aa, Neisseria gonorrhoeae
MSNENRTCSFCGKSKSHAKHLIEGKNAYICDECVANCLEILYEGDNGGTPPENAGGEPEESGKLPTPAEIVANLDDYVIGQGQAKKALAVAVYNHYKRLRHPKADGGVELSKSNILLIGPTGSGKTLLAQSLARKLDVPFVMADATTLTEAGYVGEDVEQIITKLLGKCDFDVEKARHGIVYIDEIDKISRKSDNPSITRDVSGEGVQQALLKLIEGTVASVPPQGGRKHPNQEFINVDTANILFICGGAFAGLEKVIRQRTEKGGIGFGASVHSKDENAGITKLFGIVEPEDLIKFGLIPELIGRLPVIATLEELDEDALINILTEPKNALVKQYQALFGIENVGLEFEEGALRSIARQAMERKTGARGLRSIVERCLLDTMYRLPDLQGLKKVVVGKAVIEEGREPELVFES

SEQ ID NO: 4317 - DNA, 1017 bp, Neisseria gonorrhoeae
atgcacaagctgtggcacatttccaatatctatacgacgcggccggcgcaggaattggcgcaaaaattggtgaaacacagttttgccgacaaggtttttttctgcaactcgggcgcggaagcgaatgaggcggcgttaaagctggcaaggaaatatgcgcgcgaccgtttcggcggaggcaaaagcgaaatcgtcgcctgtatcaacagtttccacggacgcacgctgtttaccgtgtccgtcggcggacagccgaaatacagtaaggattatgcaccgctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaggcggcgcgccgtctgtgcgaccggcacaatgcgttgttgattttggacgaagttcaaaccgggatggggcatacgggcaggctgtttgcctatgaacattacggcgttgttcccgatattttgagttcggcaaaagccttgggctgcggctttccgatcggcacgatgctggcgacagaaaagattgccgccgccttccaaccgggcacgcacggctcgactttcggcggcaacccgatggcgtgtgcggtcggcagccgcgccttcgacatcatcaacgcgccggaaaccttgcacaacgtccgcagtcaggggcagaaacttcagacggcattgctggatttgggcaggaaaacaggcttgttctcacaggttcgcgggatggggctgctgctcggctgcgcgttggacacgccttatcgcggacgctcatccgaaatcgccgctacctccttgaaacacggcgtgatgatcttagttgcgggtgcggacgtattgcgtttcgcgccttcgctgctgttgaacgatgaggatattgcggaaggtttgcggcgtttggaacacgtgctgacggaatttgccgccgcaaaccgcccc

SEQ ID NO: 4318 - protein, 339 aa, Neisseria gonorrhoeae
MHKLWHISNIYTTRPAQELAQKLVKHSFADKVFFCNSGAEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQAARRLCDRHNALLILDEVQTGMGHTGRLFAYEHYGVVPDILSSAKALGCGFPIGTMLATEKIAAAFQPGTHGSTFGGNPMACAVGSRAFDIINAPETLHNVRSQGQKLQTALLDLGRKTGLFSQVRGMGLLLGCALDTPYRGRSSEIAATSLKHGVMILVAGADVLRFAPSLLLNDEDIAEGLRRLEHVLTEFAAANRP

SEQ ID NO: 4319 - DNA, 201 bp, Neisseria gonorrhoeae
ttgaaaatatttaggtttatttttaccactgcccgatattgtcggcaatttccctttatccgccttgaaaaacggtgcataatcccgaacaaaaccgcaatcaggagcaattatgcaaaactatctgacccccaatttcgcctttgccccgatgattcccgaacgcgcttcaggcagccgcgtttgggatacggaagggcg

SEQ ID NO: 4320 - protein, 67 aa, Neisseria gonorrhoeae
LKIFRFIFTTARYCRQFPFIRLEKRCIIPNKTAIRSNYAKLSDPQFRLCPDDSRTRFRQPRLGYGRA

SEQ ID NO: 4321 - DNA, 144 bp, Neisseria gonorrhoeae
atgcttgaggcgcggcagcgttttgatttagaatctccccaatatttttatcttcggacggcatttcatcatgcaaggcaaaacgtttacaaccgcttactgctattggtaccacacagacgtgcggtgctttttgcgcttgct

SEQ ID NO: 4322 - protein, 48 aa, Neisseria gonorrhoeae
MLEARQRFDLESPQYFYLRTAFHHARQNVYNRLLLLVPHRRAVLFALA

SEQ ID NO: 4323 - DNA, 162 bp, Neisseria gonorrhoeae
gtggtaccaatagcagtaagcggttgtaaacgttttgccttgcatgatgaaatgccgtccgaagataaaaatattggggagattctaaatcaaaacgctgccgcgcctcaagcattatatcgaaatttttttgtttttttcagctatccggttgaaaatatt

SEQ ID NO: 4324 - protein, 54 aa, Neisseria gonorrhoeae
VVPIAVSGCKRFALHDEMPSEDKNIGEILNQNAAAPQALYRNFFVFFSYPVENI

SEQ ID NO: 4325 - DNA, 1476 bp, Neisseria gonorrhoeae
atgaacaacggcgcgcccgttgccgacaatcaaaacagcctgaccgccggcccgcgcggccccctgctgacgcaagatttgtggctgaatgaaaaactcgccgacttcgtgcgcgaagtcatccccgaacgccgtatgcacgccaaaggttcgggcgcgttcggtacgtttaccgtaacacacgacatcaccaaatacacccgcgccaaaattttcagcgaagtcggcaaaaaaaccgagatgttcgcccgtttcaccaccgtggcaggcgagcgcggcgcagccgatgcggaacgcgacatccgcggttttgcgttgaaattctataccgaagaaggcaactgggatgtggtcggcaacaacacgcccgtgttcttcctgcgcgacccgcgcaaattccccgacctgaacaaagccgtcaaacgcgatccgcgcaccaatatgcgttccgccacaaacaactgggacttctggacgctgctgcccgaagccctgcaccaagttaccatcgtgatgagcgaccgcggtattcccgccagctaccgccatatgcacggcttcggttcgcatacctacagcttctggaacgaagcgggcgaacgtttttgggtgaaattccatttccgcagccagcaagggattaaaaacctgaccaacgaagaagctgcaaaaatcatcgccgacgaccgcgaaagccatcagcgcgacctgtacgaagccatcgagcgcggcgagttcccgaaatggacgatgtacatccaagtcatgcctgaagccgatgccgaaaaagtgccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtatcggcgcgagcccggataaaatgttgcaagcccgtttgttcaattacgccgacgcgcaacgttaccgcttgggtgtgaacttccgccaaatccccgtcaatcgtccgcgttgccctgttcacagcaaccagcgcgacggacaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactacttcagccaaccgcgcgccttgttcaacctgatgaacgacgcgcagaaacaggctttgtttgacaacaccgccgcagccatgggcgatgcgcccgacttcatcaaataccgccatatccgcaactgctaccgttgcgacccggcatacggtgaaggcgtagccaaagccctcggactgaccgtcgaagacgcacaagccgtccgcgcgaccgatcccgcactgggtcaggccggtttgctg

SEQ ID NO: 4326 - protein, 492 aa, Neisseria gonorrhoeae
MNNGAPVADNQNSLTAGPRGPLLTQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPASYRHMHGFGSHTYSFWNEAGERFWVKFHFRSQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGIGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFDNTAAAMGDAPDFIKYRHIRNCYRCDPAYGEGVAKALGLTVEDAQAVRATDPALGQAGLL

SEQ ID NO: 4327 - DNA, 1701 bp, Neisseria gonorrhoeae
gtgtcaggcaggcagggtttccccggaaggataataaaatttttttcccatcggcttgccgtccgaaaaccggtttgccgtattttatccaaggagtgttgtatgtcagacgaaaaattagaacaaaacggcttgagccgtcgttcgttcttaggtacggccgccgcttccggtgcaggtattgccggtgcgggcctgttgggtttggcgggttgctctaaagacggcgaacaggctgccgctaacgcttccggcgcggctcccgtcgccaaggcgcaaggggaatccaaacccggccaactgtcttccgaagtcggtccgggcgaactcgatcaatattacggtttcctttccggcggccagtccggcgagatgcgcctgatcggtctgccttctatgcgcgaactgatgcgtatccccgtgttcaatatggacagcgcgaccggttggggacgcaccaatgagagcttgaaagtcctcaacggcaatattaccgaagaaacccgtaaattcttaaaagacagcggcctgcgctgctaccccaacggcgacttgcaccacccgcacctgtcgtttaccgaccaaacttatgacggccgctatgcctatgccaacgacaaggcaaacaaccgcgtctgccgcgtgcgtttggatgtgatgaaggccgacaaaatcatcgacatccctaatgattcaggtattcacggtctgcgtccgcaacgttatccgaaaaccggttatgtttttgccaacggcgaacacattacccctgtcagcggtgtaggcaaactggatgatgcgaaaacctggaatgcagtgtacaccgccatcgacggcgaaaccatggagatcgcatggcaagtattggttgacggtaacctggacaacggcgatgccgactatcaaggcaaatattcttttgccacctgctacaactccgagcgcgcgctgaccgtacaaggtgcgtcttccaacgagcaggactggtgcgtcgttttcgacctgaaagccatcgaagaaggcatcaaagcgggcgacttcaaagaagttaacggtgtgaaaatgctggacggccgcgctgaggccaaatccaaatacacgcgttatatccctgtgccgaactctcctcacggctgtaacgcaagccctgacggtaaatacatcatgcccaacggtaaactgcctccaaccgttaccgtattggatgtcagcaaactggacgatttgttcgccggcaaaatcaaagagcgcgatgtggtcgtagccgaaccgcaactgggtctcggcccgttacacactgcattcgacggtcgcggcaatgcttatacgacattgtttatcgacagccaaatggtgaaatggaatattgacgatgcgatcaaagcctacaaaggcgagaaaatcgatccgatcaaacaaaaactcgacgttcactatcaaccgggtcacaaccatacgaccatgggcgaaaccaaagaagccgacggtcaatggctggtgtccttgaacaaattctccaaagaccgcttcttgaatgccggtcctttgaaacccgagtgcgaccaattgatcggcatctccggcgacgaaatgcgtctggtacacgacaacccgacttttgccgaaccgcacgacttgtgtttggttgccgcgtccaaactgaacccgggcaaaacttgggaccgcaaagacccgtggttc

SEQ ID NO: 4328 - protein, 567 aa, Neisseria gonorrhoeae
VSGRQGFPGRIIKFFSHRLAVRKPVCRILSKECCMSDEKLEQNGLSRRSFLGTAAASGAGIAGAGLLGLAGCSKDGEQAAANASGAAPVAKAQGESKPGQLSSEVGPGELDQYYGFLSGGQSGEMRLIGLPSMRELMRIPVFNMDSATGWGRTNESLKVLNGNITEETRKFLKDSGLRCYPNGDLHHPHLSFTDQTYDGRYAYANDKANNRVCRVRLDVMKADKIIDIPNDSGIHGLRPQRYPKTGYVFANGEHITPVSGVGKLDDAKTWNAVYTAIDGETMEIAWQVLVDGNLDNGDADYQGKYSFATCYNSERALTVQGASSNEQDWCVVFDLKAIEEGIKAGDFKEVNGVKMLDGRAEAKSKYTRYIPVPNSPHGCNASPDGKYIMPNGKLPPTVTVLDVSKLDDLFAGKIKERDVVVAEPQLGLGPLHTAFDGRGNAYTTLFIDSQMVKWNIDDAIKAYKGEKIDPIKQKLDVHYQPGHNHTTMGETKEADGQWLVSLNKFSKDRFLNAGPLKPECDQLIGISGDEMRLVHDNPTFAEPHDLCLVAASKLNPGKTWDRKDPWF

SEQ ID NO: 4329 - DNA, 444 bp, Neisseria gonorrhoeae
atgaatttcagttttgttcccctgtttctggttacgctgattctgttgggggtggtcagcaacaacaattcgattaccgtctcggcaaccatattgctgctgatgcagcagacggcattggtacagtttgtcccgttggtcgagaagcacgggttgaacctcggtatcattcttttgaccataggggttttgagtccgttggtttcaggaaaggcgcaggttcctcctgttgccgaatttttgaattttaaaatgatatccgccgtttttatcggtattttcgtggcttggctggcgggatgcggcgtgcctttgatgggacggcagccggtattggtaacgggcttgctgatcggtacggtcatcggggtggcatttatgggcggtatccctgtcgggccgctgattgcggccgacatcttgtcttttgttgccggaaaggtt

SEQ ID NO: 4330 - protein, 148 aa, Neisseria gonorrhoeae
MNFSFVPLFLVTLILLGVVSNNNSITVSATILLLMQQTALVQFVPLVEKHGLNLGIILLTIGVLSPLVSGKAQVPPVAEFLNFKMISAVFIGIFVAWLAGCGVPLMGRQPVLVTGLLIGTVIGVAFMGGIPVGPLIAADILSFVAGKV

SEQ ID NO: 4331 - DNA, 168 bp, Neisseria gonorrhoeae
atggtcattttcctgattctgtcgtgtgttgccgaatcgggcgacctgtgtgaaggtaacaaaaaagccgccccgttttcgagcggcctgttttgcgtatgggatggatttcaagcaagcgcaaaaagcaccgcacgtctgtgtggtaccaatagcagtaagcggttg

SEQ ID NO: 4332 - protein, 56 aa, Neisseria gonorrhoeae
MVIFLILSCVAESGDLCEGNKKAAPFSSGLFCVWDGFQASAKSTARLCGTNSSKRL

SEQ ID NO: 4333 - DNA, 504 bp, Neisseria gonorrhoeae
atgaccatggatgcaatgccccaaaccgccgtacaaaacgaaaacctgcacacttgcagcattattgtcgatgatgcgcaggatttttcccccatgcttctcgatgcagggcgggacgacacgctcatcagcgaatcgatgattccgcaaatccgcaccgttgccgccctgatagccgccgaacggcacgacttcagccgcagcagccccgccgagtttaccgatgccgccgatttttttgccgcacggattctcgtattgggcgtgcgacgcttccatctggacgtatcgctgcttcagattttgaaaaccgcaaacaagcgcgcctgccgctttgccgaaaaacaccgcctgtttttcacacccgcacaagccgaattgagcctgaacaaacacaaaaaccgccgcctgctgaccatagaaaccgaacacgaagtcgaaaacaaaggcaaccctgtcgccaacagcctcgcatttgtccgcaaactgcacaccctacccctg

SEQ ID NO: 4334 - protein, 168 aa, Neisseria gonorrhoeae
MTMDAMPQTAVQNENLHTCSIIVDDAQDFSPMLLDAGRDDTLISESMIPQIRTVAALIAAERHDFSRSSPAEFTDAADFFAARILVLGVRRFHLDVSLLQILKTANKRACRFAEKHRLFFTPAQAELSLNKHKNRRLLTIETEHEVENKGNPVANSLAFVRKLHTLPL

SEQ ID NO: 4335 - DNA, 615 bp, Neisseria gonorrhoeae
atgcttgccaaaattcccgacggcgatacaatacaaccgattttccacccgaacaggacacacatgaaaaaaatcatcgcctccgcgcttatcgcaacattcgcactcaccgcctgccaagacgacacgcaggcgcggctcgaacggcagcagaaacagattgaagccctgcaacagcagctcgcacagcaggcagacgatacggtttaccaactgactcccgaagcagtcaaagacaccattcctgcccaggcgcaggcaaacggcaacaacggtcagcccgttaccggcaaagacgggcagcagtatatttacgaccaatcgacaggaagctggctgctgcaaagcctgattggcgcggcggcaggcgcgtttatcggcaacgcgctggcaaacaaattcacacgggcgggcaaccaagacagccccgtcgcccgtcgcgcgcgtgctgcctaccatcagtccgcacgccccaatgcgcgcaccagcagggatttgaacacgcgcagcctccgtgcaaaacaacaggcggcgcaggcgcagcgttaccgcccgacaacgcgcccgcccgtcaattaccgccgtcccgctatgcgcggtttcggcagaaggcgg

SEQ ID NO: 4336 - protein, 205 aa, Neisseria gonorrhoeae
MLAKIPDGDTIQPIFHPNRTHMKKIIASALIATFALTACQDDTQARLERQQKQIEALQQQLAQQADDTVYQLTPEAVKDTIPAQAQANGNNGQPVTGKDGQQYIYDQSTGSWLLQSLIGAAAGAFIGNALANKFTRAGNQDSPVARRARAAYHQSARPNARTSRDLNTRSLRAKQQAAQAQRYRPTTRPPVNYRRPAMRGFGRRR

SEQ ID NO: 4337 - DNA, 696 bp, Neisseria gonorrhoeae
atgcccctaacaaatacaaaaatgccgtctgaaagcccttcagacggcattgacgcgccgggtttaccgccttctgccgaaaccgcgcatagcgggacggcggtaattgacgggcgggcgcgttgtcgggcggtaacgctgcgcctgcgccgcctgttgttttgcacggaggctgcgcgtgttcaaatccctgctggtgcgcgcattggggcgtgcggactgatggtaggcagcacgcgcgcgacgggcgacggggctgtcttggttgcccgcccgtgtgaatttgtttgccagcgcgttgccgataaacgcgcctgccgccgcgccaatcaggctttgcagcagccagcttcctgtcgattggtcgtaaatatactgctgcccgtctttgccggtaacgggctgaccgttgttgccgtttgcctgcgcctgggcaggaatggtgtctttgactgcttcgggagtcagttggtaaaccgtatcgtctgcctgctgtgcgagctgctgttgcagggcttcaatctgtttctgctgccgttcgagccgcgcctgcgtgtcgtcttggcaggcggtgagtgcgaatgttgcgataagcgcggaggcgatgatttttttcatgtgtgtcctgttcgggtggaaaatcggttgtattgtatcgccgtcgggaattttggcaagcattctgccggcaaatcg

SEQ ID NO: 4338 - protein, 232 aa, Neisseria gonorrhoeae
MPLTNTKMPSESPSDGIDAPGLPPSAETAHSGTAVIDGRARCRAVTLRLRRLLFCTEAARVQIPAGARIGACGLMVGSTRATGDGAVLVARPCEFVCQRVADKRACRRANQALQQPASCRLVVNILLPVFAGNGLTVVAVCLRLGRNGVFDCFGSQLVNRIVCLLCELLLQGFNLFLLPFEPRLRVVLAGGECECCDKRGGDDFFHVCPVRVENRLYCIAVGNFGKHSAGKS

SEQ ID NO: 4339 - DNA, 315 bp, Neisseria gonorrhoeae
gtgcaaaacaacaggcggcgcaggcgcagcgttaccgcccgacaacgcgcccgcccgtcaattaccgccgtcccgctatgcgcggtttcggcagaaggcggtaaacccggcgcgtcaatgccgtctgaagggctttcagacggcatttttgtatttgttaggggcattgttatgttgccgtttgattttcagacggcattttgtttccaagcgtttgatgtcgggatggcaattctgatctacgtgcgttggcagggcggcattgtcataccgccgttgggttttcagacggcatcatatcgaaccgtcaagccg

SEQ ID NO: 4340 - protein, 105 aa, Neisseria gonorrhoeae
VQNNRRRRRSVTARQRARPSITAVPLCAVSAEGGKPGASMPSEGLSDGIFVFVRGIVMLPFDFQTAFCFQAFDVGMAILIYVRWQGGIVIPPLGFQTASYRTVKP

SEQ ID NO: 4341 - DNA, 135 bp, Neisseria gonorrhoeae
ttggcaacgattgaaaatttccgtaaattcaaatatctagattccttcctgcgtgggaatgacgcagaagggtttcagatgcaggatggacattcctgcctacccaatctcgccctacggcttgacggttcgata

SEQ ID NO: 4342 - protein, 45 aa, Neisseria gonorrhoeae
LATIENFRKFKYLDSFLRGNDAEGFQMQDGHSCLPNLALRLDGSI

SEQ ID NO: 4343 - DNA, 456 bp, Neisseria gonorrhoeae
atgtcggccgcaatcagcggcccgacagggataccgcccataaatgccaccccgatgaccgtaccgatcagcaagcccgttaccaataccggctgccgtcccatcaaaggcacgccgcatcccgccagccaagccacgaaaataccgataaaaacggcggatatcattttaaaattcaaaaattcggcaacaggaggaacctgcgcctttcctgaaaccaacggactcaaaacccctatggtcaaaagaatgataccgaggttcaacccgtgcttctcgaccaacgggacaaactgtaccaatgccgtctgctgcatcagcagcaatatggttgccgagacggtaatcgaattgttgttgctgaccacccccaacagaatcagcgtaaccagaaacaggggaacaaaactgaaattcatcggttacgacaccctgaccaaagattccttcgccagc

SEQ ID NO: 4344 - protein, 152 aa, Neisseria gonorrhoeae
MSAAISGPTGIPPINATPMTVPISKPVTNTGCRPIKGTPHPASQATKIPIKTADIILKFKNSATGGTCAFPETNGLKTPMVKRMIPRFNPCFSTNGTNCTNAVCCISSNMVAETVIELLLLTTPNRISVTRNRGTKLKFIGYDTLTKDSFAS

SEQ ID NO: 4345 - DNA, 1803 bp, Neisseria gonorrhoeae
ataacgaaaatcttggcgtataatcgcatccatagtttttgcaaaaggaaaataaaatgtcgattcaagaaatttattacaatcaagaaaccggttacgaatacgctttccgccaaatcgtactgtaagccgtttgccccccatttgaccaacctgagaaaaggaacaagagcgatgactacctccaaatgccccgtaacccatctgaccatgaacaacggcgcgcccgttgccgacaatcaaaacagcctgaccgccggcccgcgcggccccctgctgacgcaagatttgtggctgaatgaaaaactcgccgacttcgtgcgcgaagtcatccccgaacgccgtatgcacgccaaaggttcgggcgcgttcggtacgtttaccgtaacacacgacatcaccaaatacacccgcgccaaaattttcagcgaagtcggcaaaaaaaccgagatgttcgcccgtttcaccaccgtggcaggcgagcgcggcgcagccgatgcggaacgcgacatccgcggttttgcgttgaaattctataccgaagaaggcaactgggatgtggtcggcaacaacacgcccgtgttcttcctgcgcgacccgcgcaaattccccgacctgaacaaagccgtcaaacgcgatccgcgcaccaatatgcgttccgccacaaacaactgggacttctggacgctgctgcccgaagccctgcaccaagttaccatcgtgatgagcgaccgcggtattcccgccagctaccgccatatgcacggcttcggttcgcatacctacagcttctggaacgaagcgggcgaacgtttttgggtgaaattccatttccgcagccagcaagggattaaaaacctgaccaacgaagaagctgcaaaaatcatcgccgacgaccgcgaaagccatcagcgcgacctgtacgaagccatcgagcgcggcgagttcccgaaatggacgatgtacatccaagtcatgcctgaagccgatgccgaaaaagtgccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtatcggcgcgagcccggataaaatgttgcaagcccgtttgttcaattacgccgacgcgcaacgttaccgcttgggtgtgaacttccgccaaatccccgtcaatcgtccgcgttgccctgttcacagcaaccagcgcgacggacaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactacttcagccaaccgcgcgccttgttcaacctgatgaacgacgcgcagaaacaggctttgtttgacaacaccgccgcagccatgggcgatgcgcccgacttcatcaaataccgccatatccgcaactgctaccgttgcgacccggcatacggtgaaggcgtagccaaagccctcggactgaccgtcgaagacgcacaagccgtccgcgcgaccgatcccgcactgggtcaggccggtttgctgtaagggggcattatgtggatggaaattgaagaaatcctgtcccgcgccgtccgataccggaaataaccgggcataaaaatgccgtctgaaacgtcgtttgaccgtttcagacggcat

SEQ ID NO: 4346 - protein, 562 aa, Neisseria gonorrhoeae
ITKILAYNRIHSFCKRKIKCRFKKFITIKKPVTNTLSAKSYCKPFAPHLTNLRKGTRAMTTSKCPVTHLTMNNGAPVADNQNSLTAGPRGPLLTQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPASYRHMHGFGSHTYSFWNEAGERFWVKFHFRSQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGIGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFDNTAAAMGDAPDFIKYRHIRNCYRCDPAYGEGVAKALGLTVEDAQAVRATDPALGQAGLL

SEQ ID NO: 4347 - DNA, 1386 bp, Neisseria gonorrhoeae
atgtctattaaatttgccgatttgaaccttgataaaaacattttgtccgccgtcagcagcgagggttacgaaagcccgacgccgattcaggcgcaagctattccgtttgctttggaaggctgcgacatcatggcttcggcgcaaaccggctccggaaaaaccgcagcctttctgttaccgactttgcagcgactgaccaaacgcagcgaaaaaccgggcaaaggcccgcgcgcgctggtgttggcaccgacccgcgaactggcggcgcaagtcgagaaaaacgcactggcgtatgccaaaaatatgcgctggttccgcaccgtcagcatcgtcggcggcacatcgttcggctaccaaacccgcgccctgagcaaaccggtcgatttgattgtcgccactccgggccgtctgacggacctgatgcaaagcggcaaagttgattttgaacgtttggaagtgctgattttggacgaagccgaccgtatgttggatatgggctttatcgacgacatcgaaaccatcgtggaagccaccccggccgaccgtcagactttattgttctccgccacttgggacggcgcagtcggcaaactggcgcgcaaactgaccaaagactctgaaattatcgaagtcgaacgcgtggacggccaaggcaaaatcgaagagcagttgttgtactgcgacgatatgcgccacaaaaaccgcctgctcgaccacatcctgcgcgatgccaacatcgaccaatgtgtgattttcacgtccaccaaagcgatgaccgaagtcatcgcggatgaattgtacgaaaaaggtttcgccgccaactgcctgcacggcgatatgccgcagggctggcgcaaccgcacgctgacggatttgcgtaaaggccgctgcaaaattttggttgccaccgacgttgccgcacgcggtattgacgtaccgaccattacccacgtcataaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgcaaactgcccgaactgaccatcgaaggcatggagccggcccgcaaacgcaaatccgcaggcggcaagccgaaaggcaaaggcggctggggcgataggaaatccggcggccggcgcggcgatcataaaccgggcaaagaaggcttcggcggcaaaacgcgcggcgaaggtttcaagaaagaaggctttaagaaagacagtttcaaaaaaaccggcgaaggcttcaaaggcaaacgcaaagccggcgactcttttgcaggcaaaagcgaacgccgttacaaagaccgc

SEQ ID NO: 4348 - protein, 462 aa, Neisseria gonorrhoeae
MSIKFADLNLDKNILSAVSSEGYESPTPIQAQAIPFALEGCDIMASAQTGSGKTAAFLLPTLQRLTKRSEKPGKGPRALVLAPTRELAAQVEKNALAYAKNMRWFRTVSIVGGTSFGYQTRALSKPVDLIVATPGRLTDLMQSGKVDFERLEVLILDEADRMLDMGFIDDIETIVEATPADRQTLLFSATWDGAVGKLARKLTKDSEIIEVERVDGQGKIEEQLLYCDDMRHKNRLLDHILRDANIDQCVIFTSTKAMTEVIADELYEKGFAANCLHGDMPQGWRNRTLTDLRKGRCKILVATDVAARGIDVPTITHVINYDLPKQAEDYVHRIGRTGRAGRTGIAITFAEVNEYVKVHKIEKYINRKLPELTIEGMEPARKRKSAGGKPKGKGGWGDRKSGGRRGDHKPGKEGFGGKTRGEGFKKEGFKKDSFKKTGEGFKGKRKAGDSFAGKSERRYKDR

SEQ ID NO: 4349 - DNA, 120 bp, Neisseria gonorrhoeae
ttgatcttgcaaagcgtatctgtgcaggttgccgtcgatgtaaaccacaagcaagccgcttgcgacaaccctgtaacttcacattccccgtatcgttacccttccctgcttcaggccgtc

SEQ ID NO: 4350 - protein, 40 aa, Neisseria gonorrhoeae
LILQSVSVQVAVDVNHKQAACDNPVTSHSPYRYPSLLQAV

SEQ ID NO: 4351 - DNA, 1062 bp, Neisseria gonorrhoeae
atggcttcgtatgacgatataagcggagaatggtatagggtttgcccgaaaaggtcaagcaatcgggcgttaattacagtaaaatttccgttttccactttattctgcctgaaatcaatgaccgacatcacaccgtttgccaaccgcttgggcaaaaacatcaaacaccttatgaaatgggcgaaacgcaacggcatcgaagcctggcgcatttacgaccgcgacatcccccaattcccttttgccgctgatgtttacggcgatcgaatccaccttcaggaatacgataccggctggctgatgcggcccggagaatacgaagcgtggcttgccgaagtattggaagccgtcgctttcgttaccggttttgaacccgaacaaatccgtctcaaacgccgcgaacgccaaaaaggtttgcagcagtacgagaaaaccggcaaggcgggcgacgatttcgtcattgccgaaaacggccgcaagttttgggtcaacctcgacaaatacctcgacaccggcttcttcctcgatcaccgcaacacgcgcaaaaaagtcggcgaaacggcggcgggcaaacgttttttgaacctgttttcctacaccggcagcttcaccgtctatgccgccaccggcggcgcggcatccagcgaaaccgtcgatttgtccaacacttatctcgattgggcgaggcgcaattttgaattgaacggcatcgatatggaacggcacaaaatcgtccgcgccgacgtgttccaataccttcagacggcatatggggaaggcaggcagttcgacctcattgtgatggacccgcccagtttttccaacagcaagaaaatgcccggcatcctcgacatccagcgcgaccatcaaaaactcatagacggcgcggtgaacctgctcgcttcagacggcattttgtatttttccaacaacctgcgcagcttcgttttggacgattcggtatcggaacaatacgccgtgaaagacatttccaaacaatccgttcccgaagatttccgcaacaaaaaaatccaccggtgttgggaaatccgccacaaatct

SEQ ID NO: 4352 - protein, 354 aa, Neisseria gonorrhoeae
MASYDDISGEWYRVCPKRSSNRALITVKFPFSTLFCLKSMTDITPFANRLGKNIKHLMKWAKRNGIEAWRIYDRDIPQFPFAADVYGDRIHLQEYDTGWLMRPGEYEAWLAEVLEAVAFVTGFEPEQIRLKRRERQKGLQQYEKTGKAGDDFVIAENGRKFWVNLDKYLDTGFFLDHRNTRKKVGETAAGKRFLNLFSYTGSFTVYAATGGAASSETVDLSNTYLDWARRNFELNGIDMERHKIVRADVFQYLQTAYGEGRQFDLIVMDPPSFSNSKKMPGILDIQRDHQKLIDGAVNLLASDGILYFSNNLRSFVLDDSVSEQYAVKDISKQSVPEDFRNKKIHRCWEIRHKS

SEQ ID NO: 4353 - DNA, 387 bp, Neisseria gonorrhoeae
atgcccaagccctatcctgcacgctatcgtgcgaatcccaaccgaaaaggaaaaataatgagcagcgaattaatcgtacacaccggcgatgccgccttcgagcaagatgttttgaaatccgacctccccgtcctgctggacttttgggctccgtggtgcggcccctgcaaaatgattgccccgattttggacgacattgccgccgaatttgaaggccgtctgaaagtagtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaggcctccatcgcc

SEQ ID NO: 4354 - protein, 129 aa, Neisseria gonorrhoeae
MPKPYPARYRANPNRKGKIMSSELIVHTGDAAFEQDVLKSDLPVLLDFWAPWCGPCKMIAPILDDIAAEFEGRLKVVKINIDDNEATPSRFGVRGIPTLMVFKNGEVVATKVGALAKGQLTAFVEASIA

SEQ ID NO: 4355 - DNA, 111 bp, Neisseria gonorrhoeae
gtgggcgggcgggataatagtttttctgtaccgccccaatcgcctttgcaaattctaaaaaacggttcggacagtattttatttttgaaaattacttttattatcaaagta

SEQ ID NO: 4356 - protein, 37 aa, Neisseria gonorrhoeae
VGGRDNSFSVPPQSPLQILKNGSDSILFLKITFIIKV

SEQ ID NO: 4357 - DNA, 201 bp, Neisseria gonorrhoeae
ttggttttgaacattcatactttaagaatctatttaaacggagcatacaccgcccgcgcgtttctgtacagcctcaaaaacattccttatactttgataataaaagtaattttcaaaaataaaatactgtccgaaccgttttttagaatttgcaaaggcgattggggcggtacagaaaaactattatcccgcccgcccact

SEQ ID NO: 4358 - protein, 67 aa, Neisseria gonorrhoeae
LVLNIHTLRIYLNGAYTARAFLYSLKNIPYTLIIKVIFKNKILSEPFFRICKGDWGGTEKLLSRPPT

SEQ ID NO: 4359 - DNA, 471 bp, Neisseria gonorrhoeae
atgactgatttttccgtttgggaagctgctccctttggcgcaaccgttgatcatatcctgcaacgctaccacaatgtccaccgcgcacaatttgaagaattggtgccgctggcgcagaaagtggcccaagtccatgccgatacctttccggcggaaattgccgggctgcttgccgatatgcgggacgagctgctgatgcatatgatgaaggaagagcggatgctgtttccgatgattaatcagggtgtcggacgcggtgcggcgatgcccatcagcgtgatgatgcacgaacatgaagaacacgaccgcgccatcgcacggctcaaagagctgaccggtaatttccacgcacccgaaggggcttgcggaagttggacgcgcctttacgcgctggcaaaagaaatggcggacgatttgaacgaccacattcatttggaaaacgatattctgtttgcccgcgtactcgattct

SEQ ID NO: 4360 - protein, 157 aa, Neisseria gonorrhoeae
MTDFSVWEAAPFGATVDHILQRYHNVHRAQFEELVPLAQKVAQVHADTFPAEIAGLLADMRDELLMHMMKEERMLFPMINQGVGRGAAMPISVMMHEHEEHDRAIARLKELTGNFHAPEGACGSWTRLYALAKEMADDLNDHIHLENDILFARVLDS

SEQ ID NO: 4361 - DNA, 894 bp, Neisseria gonorrhoeae
atgccgtctgaaatacggtttttccgtttcagacggcattttcatgtttcagcccagcaattcgggcggaatgcggcacacaggaatcgggttgattttgtgctgcatcgcgcggtgaagccgcgtatagatttccagaacttcgcgccgccgtccttcaaaatcttcgggtttgcgcgtgccgtacacgcccattgcccactccagttcgggatagcttgcgcccatctgttcctcgtcggtgcgttccgtatcccacaggccgtcggtcggcggggctttttgaatcgcctcgtccacgcccaatgcttcggcaagccggtaaacctgcgttttggtcaggtcggcaatcgggctgatgtccacgccgccgtcgccgtatttggtaaaaaaacccacgccgaaatcttcaaccttattacctgtccccgtaaccagcagtccgtgtatctgcccgtagtagtacagggtcagcatacgcaggcggcttctggcgttggcgagcgaaagcggctgattggcaaatgccgtctgatgaacgccgacggtttgttcaaaggtctggaaggtgtcggtcagattggccgtttgcgcgcttacattggcatattgcccttgcagattgcggatgtgccgccttgcccgctcaagctggccggggtgttggcgtatcggcatatccagaagcagcgtggtgcggccggtgcgggcggcgagcgtggagacgacggcggaatcgatgccgccggaaacgcctacgacgaatccttttgcatttgcctgagcggcgtattcgtccaaccatcggacaatatgtgtgataactgcctgcgtatccatttttcctcctgtcgaaaatatccgcatcatagcctgccggcggtgcaatttgaa

SEQ ID NO: 4362 - protein, 298 aa, Neisseria gonorrhoeae
MPSEIRFFRFRRHFHVSAQQFGRNAAHRNRVDFVLHRAVKPRIDFQNFAPPSFKIFGFARAVHAHCPLQFGIACAHLFLVGAFRIPQAVGRRGFLNRLVHAQCFGKPVNLRFGQVGNRADVHAAVAVFGKKTHAEIFNLITCPRNQQSVYLPVVVQGQHTQAASGVGERKRLIGKCRLMNADGLFKGLEGVGQIGRLRAYIGILPLQIADVPPCPLKLAGVLAYRHIQKQRGAAGAGGERGDDGGIDAAGNAYDESFCICLSGVFVQPSDNMCDNCLRIHFSSCRKYPHHSLPAVQFE

SEQ ID NO: 4363 - DNA, 789 bp, Neisseria gonorrhoeae
atggatacgcaggcagttatcacacatattgtccgatggttggacgaatacgccgctcaggcaaatgcaaaaggattcgtcgtaggcgtttccggcggcatcgattccgccgtcgtctccacgctcgccgcccgcaccggccgcaccacgctgcttctggatatgccgatacgccaacaccccggccagcttgagcgggcaaggcggcacatccgcaatctgcaagggcaatatgccaatgtaagcgcgcaaacggccaatctgaccgacaccttccagacctttgaacaaaccgtcggcgttcatcagacggcatttgccaatcagccgctttcgctcgccaacgccagaagccgcctgcgtatgctgaccctgtactactacgggcagatacacggactgctggttacggggacaggtaataaggttgaagatttcggcgtgggtttttttaccaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaggaacagatgggcgcaagctatcccgaactggagtgggcaatgggcgtgtacggcacgcgcaaacccgaagattttgaaggacggcggcgcgaagttctggaaatctatacgcggcttcaccgcgcgatgcagcacaaaatcaacccgattcctgtgtgccgcattccgcccgaattgctgggc

SEQ ID NO: 4364 - protein, 263 aa, Neisseria gonorrhoeae
MDTQAVITHIVRWLDEYAAQANAKGFVVGVSGGIDSAVVSTLAARTGRTTLLLDMPIRQHPGQLERARRHIRNLQGQYANVSAQTANLTDTFQTFEQTVGVHQTAFANQPLSLANARSRLRMLTLYYYGQIHGLLVTGTGNKVEDFGVGFFTKYGDGGVDISPIADLTKTQVYRLAEALGVDEAIQKAPPTDGLWDTERTDEEQMGASYPELEWAMGVYGTRKPEDFEGRRREVLEIYTRLHRAMQHKINPIPVCRIPPELLG

SEQ ID NO: 4365 - DNA, 114 bp, Neisseria gonorrhoeae
ttgttaatccactataaacgcaaaatatcccgtcattcccgcaccatccccaccggttcaaaccggcacgaaaacttttccgcgtcattcccgcgaaagtgggaatccggaacg

SEQ ID NO: 4366 - protein, 38 aa, Neisseria gonorrhoeae
LLIHYKRKISRHSRTIPTGSNRHENFSASFPRKWESGT

SEQ ID NO: 4367 - DNA, 162 bp, Neisseria gonorrhoeae
ttgaagcccaaggcggcatcgtgccgcctaaattgtcaacaatattataacacgcgccatcttgccgccagccttttcctatatgacttttttaagcggggaatgggaaaaatattcatcaacccgccctcaatctattcaaattgcaccgccggcaggcta

SEQ ID NO: 4368 - protein, 54 aa, Neisseria gonorrhoeae
LKPKAASCRLNCQQYYNTRHLAASLFLYDFFKRGMGKIFINPPSIYSNCTAGRL

SEQ ID NO: 4369 - DNA, 1407 bp, Neisseria gonorrhoeae
atgccgccttgggcttcaaaacatattcatattttttattatttgattgattcgatgtctgatttttttcattctgacgtgttgtccgtttccgagttgaacgcatttgccaaaagtattttggaaaaccaccttgccggcctgtggattgcgggcgaagtgtccaatctgacccgcgccgccagcgggcattattatttctcactcaaagacagccgcgcgcaggtgcgttgcgcgatgttcaagggtgcggcggcgcgtttggcgcaacctttgaaagaaggcgaccatatcgaagtggcgggcaaaatcagtatttacgaggcgcggggcgaatttcagattaccgtaaacgaagtacggctcaaaggtttggggcagctttacgaagcctacgagcggttgaaggcgcagttgcaggcggaaggcgcgtttgcggcggaacgcaaaaaacctttgcccgtccgtccgcaatgtatcggcatcgttaccagtctggcggcggcggctttgcgcgatgtcgtaaccaccttgaaacgccgcgcgcccgaaatccccgtcatcgtttatccggccgccgttcagggcgcgggcagcgggtttcagattgcccaagcgattaaaaccgcatcgcaacgcgccgaatgcgatgtgctgattgtctgtcgcggcggcggcagcatcgaagacttgcgggcgtttaacgaagaaccggtcgtgcgcgccatcgaagcctgcacgattcccgtcgtcagcggcgtgggacacgaaaccgatttcacgctcgccgatttcgttgccgacgtgcgcgcgcccacgccgaccggcgcggcggaactggtcagccccaaccgccaagaatcactgcaccgcctcgtccaagcccaaggccgtctgaaaaccgttttggagcaacgctatttcgatgccagccaaaaactcgactggctcgcgcggcaaatccgccacccgcgccaaaaacttgacgagcagcgcgcttcaatcggcaagctggcgcaaacgctgtcttactcgatgacgcaaaacctccgcgcccacaccgcccgttttgaacgccaaacccaagccctgcaacattgccgtcctgatgtttccgtttaccggcaagatatcgtccgccttcagacggcattgcccgccgccttcagccggctgctcgcccgtcgccgtcaaagcctgaccgcccaagccgcattgctcgaagccgtttcgccgcagcacattctggaacgcggcttctccgttgtcaaaaatacacgcggacaagtcatccgtaacgctgatgttttgaagcaggggcagaagctgcacattaccttctccgacggcgaaaccgacgtgcgcgtaagcaaagaacaagggcagcaggatttgttcgattgcatt

SEQ ID NO: 4370 - protein, 469 aa, Neisseria gonorrhoeae
MPPWASKHIHIFYYLIDSMSDFFHSDVLSVSELNAFAKSILENHLAGLWIAGEVSNLTRAASGHYYFSLKDSRAQVRCAMFKGAAARLAQPLKEGDHIEVAGKISIYEARGEFQITVNEVRLKGLGQLYEAYERLKAQLQAEGAFAAERKKPLPVRPQCIGIVTSLAAAALRDVVTTLKRRAPEIPVIVYPAAVQGAGSGFQIAQAIKTASQRAECDVLIVCRGGGSIEDLRAFNEEPVVRAIEACTIPVVSGVGHETDFTLADFVADVRAPTPTGAAELVSPNRQESLHRLVQAQGRLKTVLEQRYFDASQKLDWLARQIRHPRQKLDEQRASIGKLAQTLSYSMTQNLRAHTARFERQTQALQHCRPDVSVYRQDIVRLQTALPAAFSRLLARRRQSLTAQAALLEAVSPQHILERGFSVVKNTRGQVIRNADVLKQGQKLHITFSDGETDVRVSKEQGQQDLFDCI

SEQ ID NO: 4371 - DNA, 114 bp, Neisseria gonorrhoeae
ttgtttataaatttctgtaactttgaatttcagccatcttcaataaattatcgaaacgtatcaatcgtcattcccgcgcaggcgggaatccgttttttgagtttcagtcatttc

SEQ ID NO: 4372 - protein, 38 aa, Neisseria gonorrhoeae
LFINFCNFEFQPSSINYRNVSIVIPAQAGIRFLSFSHF

SEQ ID NO: 4373 - DNA, 270 bp, Neisseria gonorrhoeae
ttgaaacccggcttggcaatgcttgcctcacggtctaaaaacttcataacatcctctttctgtcagttgaaaaataaaatttcatttgcccaatggaaacttattaaaaattataaaaaaatatcgggttgggtttttatccgccccaagatgcgccgtctgaaacatttcgggtgtgcggagaggtttctgttttttccgacaaattcctgcggctttccgcttccggattcccgctttttagggactggattcccgttttcgcgggaa

SEQ ID NO: 4374 - protein, 90 aa, Neisseria gonorrhoeae
LKPGLAMLASRSKNFITSSFCQLKNKISFAQWKLIKNYKKISGWVFIRPKMRRLKHFGCAERFLFFPTNSCGFPLPDSRFLGTGFPFSRE

SEQ ID NO: 4375 - DNA, 1482 bp, Neisseria gonorrhoeae
gtgccgcccgcagcattagcggtgcaccttgccatcgggcagatttacgcctattccgtattcaacgcgccgctgaccaaacttatcggcataaccgaatcggcggccggagattggaagctgacgaccgtaggttggattttcagtatcgcactcgcgatgctgggcgcgtcggccgccctgttcggcacatggatggaacgggtagggccgcgcaaagccatatttgccgccgcctgctgtttcagcctgggcttcttcgtatccgcattcggcgtgcgtacgcacaacctcttcctgctttatttgggcaacggcgtcatcggcggcgtaggcttaggcttaggctacatcgggccggtttccacgctgatgaaatggtttcccgacaagccgggtatggcgaccggtttggcgattatgggtttcggcggcggcgcaatgctggcctcgccgctttccgtatcactgatgaacgccttttcaaacgccgcttcggtcggggttgccgaaacctttgccgtattgggcctgttttacctcgcactgatgatgttcggcgcgtttaccatccgcgtacctgccgacggctggaaacctgaaggctataccgtgccgaaaacgcaaaacaagccggtcagcagcaatcatgtcaacgtgtcccaagccatgaaaacgccgcagttttggctgttgttctgggtattgtgcctgaacgtaaccgccggcatcggcgtattgggccaggcatccgtgatgattcaggaactcttttccgaaacctccgcaggcaggcaggcggcagtcggcgcaggtgcggcggcaggcttcgtcagcctcctgagcctgtttaatatgggcggacgctttttgtggtcgagcgtttccgacaaaatcggacgcaaaaacacctacaccatcttcttcgtactcggttcgctgctgtatttcgccgttccctccatcggcgaaggcggcagcaaagccctgttcatcatcggcttctgcgtgattatttccatgtacggcggcggatttgccgccattcccgcctacctgaaagacctgttcggcacctatcaggtcggcgcgattcacgggcgcatcctgctggcctggtcaaccgccgccgtcatcggcccggtactggtcaattacatacgccaaagccaaatcgacagcggcataccggcggcacaggcatacagcgtaaccatgtacattatggcgggattgttgattgtcggactgttgtgcaacctcgccgtcaaatccgtacacgaaaaacaccacgaaaaagacatcaaaaccgccgcacgcagcggcaaccccgacgacgaaaccgccatatccgacgcttaccttgtgggcgaaaaagtttccggcgacggcatatcggtctggtggcgttgggcattggccgtcataccgctcgcctacggcgtggtgatggtctttgtcaaagcactcgaccttttctcc

SEQ ID NO: 4376 - protein, 494 aa, Neisseria gonorrhoeae
VPPAALAVHLAIGQIYAYSVFNAPLTKLIGITESAAGDWKLTTVGWIFSIALAMLGASAALFGTWMERVGPRKAIFAAACCFSLGFFVSAFGVRTHNLFLLYLGNGVIGGVGLGLGYIGPVSTLMKWFPDKPGMATGLAIMGFGGGAMLASPLSVSLMNAFSNAASVGVAETFAVLGLFYLALMMFGAFTIRVPADGWKPEGYTVPKTQNKPVSSNHVNVSQAMKTPQFWLLFWVLCLNVTAGIGVLGQASVMIQELFSETSAGRQAAVGAGAAAGFVSLLSLFNMGGRFLWSSVSDKIGRKNTYTIFFVLGSLLYFAVPSIGEGGSKALFIIGFCVIISMYGGGFAAIPAYLKDLFGTYQVGAIHGRILLAWSTAAVIGPVLVNYIRQSQIDSGIPAAQAYSVTMYIMAGLLIVGLLCNLAVKSVHEKHHEKDIKTAARSGNPDDETAISDAYLVGEKVSGDGISVWWRWALAVIPLAYGVVMVFVKALDLFS

SEQ ID NO: 4377 - DNA, 150 bp, Neisseria gonorrhoeae
ttgcacaaactttgtccccaaagccgcagcgacgatttcatccgcaaaaccgccgcatcaggtacaatatcgaaccgtccgaccgaggacggcattttatcaacccgtcctgccgcacacgccgcagaagaaccgccttatcaggcgagt

SEQ ID NO: 4378 - protein, 50 aa, Neisseria gonorrhoeae
LHKLCPQSRSDDFIRKTAASGTISNRPTEDGILSTRPAAHAAEEPPYQAS

SEQ ID NO: 4379 - DNA, 1188 bp, Neisseria gonorrhoeae
ttgatggttcagcgcgtcttgagtgtgaacgataaagccttcgttaccgccgatttggattacgaactgccccaagcttattacgtcgatgatcctaaagcgccgcccgtagaaatcagcgcgcctgtcgaagcagtacctgccgcagcatccgataccgcttcagacggcattgccgaagatgcgtcagctgaaaacggtgtatccaaccaattatggaaacagatttggaaagcgaaacaggggcagattgtcgtcgtcggcattgcgctgaccatcctgcttttggtattcctgttccaagattggattgtgcgttacgaaaaatggtacgaccgcttccgctttgctttcctaacttttacgctcttctatatcggctggtatgcacaggcgcagctttcggtcgtcaatacgctgacgctgttttccgccatccttaccgaatttcattgggaattcttcctgatggatccgattgtgttcatcctgtggctgttcacggctgcaaccatgctgctgtggaacagggggacgttttgcggttggttgtgtccgttcggctcattacaggaattgactaaccgcattgccaaaaaactgggtgtgaaacagattaccgtaccgcatatgctgcatacccgtttgaacgtcataaaatacctgattttattcggttttttggcaatttcgctgtatgatttgggtacggcggaaaaatttgccgaagtcgaaccgttcaaaactgcgattatcttgaaattcatgtgcgattggtggtttgtcgcctttgccgtggcacttttgattgcggggctgtttatcgaacgcttcttctgccgttatctgtgtcctttgggtgcgggcatcgcgctgccgggcagattccgcgtgttcgactggctgcgccgctacaaaatgtgcggcaacccctgccaaatctgtacgcacgaatgccccgttcaggcaatcgcgcccgagggcgacatccatccgaacgaatgtatccagtgcctgcactgccaagtgatgtaccaccacgatacgcgctgtccgcaagttgtggcggaaaataagaaaaaacaaaaacaggctgctgccaaatcaggggaattggaaaatgtctctaagcagccgcaggaacaggtcgtccgttttgtcaaacccgaaacggcgcaatctgaaaaa

SEQ ID NO: 4380 - protein, 396 aa, Neisseria gonorrhoeae; identical to SEQ ID NO: 280

SEQ ID NO: 4381 - DNA, 972 bp, Neisseria gonorrhoeae; identical to SEQ ID NO: 279

SEQ ID NO: 4382 - protein, 324 aa, Neisseria gonorrhoeae
MLENLPYFQRHLPEDLAKVNEVINRAVQSDVALISQIGTYIISAGGKRLRPIMTILAGKAVGYDDEKLYSLAAMVEFIHTSTLLHDDVVDESDLRRGRATANNLFGNAAAVLVGDFLYTRAFQLMVASGSMRVLEVMADATNIIAEGEVMQLMNIGNTDITEEQYIRVIQYKTAKLFEAAAQVGAILGKASPGHEQALKDYGMYVGTAFQIIDDVLDYSGETEETGKNVGDDLAEGKPTLPLIYLMRQGSEQVANDVRTALENADRGYFEKIRDYVVRSDALAYSIGEARKAVDCAVAALDALSDSEVKDAMIQLAKESLVRVS

SEQ ID NO: 4383 - DNA, 1281 bp, Neisseria gonorrhoeae
ttgtgcaaatccatttaccgctcctcttatcatttgaaagattctactcccgcacgcaaaccgatttcaaccgttgcacaaactttgtccccaaagccgcagcgacgatttcatccgcaaaaccgccgcatcaggtacaatatcgaaccgtccgaccgaggacggcattttatcaacccgtcctgccgcacacgccgcagaagaaccgccttatcaggcgagttaggaaaaatgatgtccaagcaacccaccagcaaacgccaatggcgcgacggcgcagccccgtctgccaagaaaaccgccaaacctttcaaaagcaaagcccgtcccaaagacgaaacgcgcaaaaccgccgcccaagcttacggacaaaaagcttcagacggcatcaagctgcaaaacgcccccaaacagcgcgccgccaaagccaaaaaactcgtcgtccgcaatcccaaccaaaaaattatggaacacgcgcgcgatttgaaagaacgccgcagcgacctgtcgcgtatggaacccgaacgcctgcaaaaagtgcttgcagcctccggcgtcggctcgcgccgcgaaatggaagaatggatcaacaacggctgggtaacggtcaacggcaaaaccgcgcaactgggcgacaaagttacccccgacgaccacgttaccgtcaaaggcagcatcatcaaactcaaatgggccgaccgcctgccgcgcatcatcctgtattacaaacaagaaggcgaaatcgtttcccgcgacgacccgcaaggccgcgtcagcatattcgaccgcctgccgcaggccgccagcagccgctgggtcgccatcggacgcttggacatcaacaccagcggacttctgattctcactacctccggcgaactcgtccaacgtttcgcccaccccagcttcgaagtcgaacgcgaatacgccgtgcgcgtactgggcgggctgactaccgaacaaatgcgcagtctcaccgaagaaggcgtgatgctcgaagacggcttggcaaaagtcgaacgcatctacgaacaaggcggcgaaggcgcaaacaaatggtacaacatcgtgattaaagaaggccgcaaccgcgaagtgcgccgcatattcgaaagccaaggcctcacagtcagccgcctcgtgcgcgtcgccttcggccccatcggactgcccaaccgcctcaaacgcggacagttctacgaactcaaccccgccgaagtcgccaacatcctcaaatgggcggatatgctgctgccgggcgaacgccgccgcaaaaaagcc

SEQ ID NO: 4384 - protein, 427 aa, Neisseria gonorrhoeae
LCKSIYRSSYHLKDSTPARKPISTVAQTLSPKPQRRFHPQNRRIRYNIEPSDRGRHFINPSCRTRRRRTALSGELGKMMSKQPTSKRQWRDGAAPSAKKTAKPFKSKARPKDETRKTAAQAYGQKASDGIKLQNAPKQRAAKAKKLVVRNPNQKIMEHARDLKERRSDLSRMEPERLQKVLAASGVGSRREMEEWINNGWVTVNGKTAQLGDKVTPDDHVTVKGSIIKLKWADRLPRIILYYKQEGEIVSRDDPQGRVSIFDRLPQAASSRWVAIGRLDINTSGLLILTTSGELVQRFAHPSFEVEREYAVRVLGGLTTEQMRSLTEEGVMLEDGLAKVERIYEQGGEGANKWYNIVIKEGRNREVRRIFESQGLTVSRLVRVAFGPIGLPNRLKRGQFYELNPAEVANILKWADMLLPGERRRKKA

SEQ ID NO: 4385 - DNA, 630 bp, Neisseria gonorrhoeae
atggatttgcacaatattcgggaagattacagcaaacgggaattgtcggaagccgattgcgccgataatccgatcgagcagttcgagcggtggttggacgaggcggtacgcgccgaggtcaacgagccgacggcggtcaatgtggcggcggtcgacgggcgcgggaggcccaacagccgtatggtgcttttgaaggaggttaattcagaaggttttgttttctttacgaattaccacagccgcaaggggcgttcgctggaactcaatccgtttgcggcgatgacgtttttttggccggagctggagcgtcaggtgcgcgtggaagggcgtgtcggaaggctggcggagaagttgtcggacgaatattttgagagtcgcccgtatcagagccgtttgggtgcgtgggcaagcgcgcagagcgaggtgattccgaacaaggcggtattggtggcaaaggcggcggcggtcggactcaaacatcctttgcacgtgccgcgtccgccgcattggggcggctatattgtgattcccgatttgattgagttttggcagggcaggccgagcaggctgcacgaccgcatccaataccgtttgctggatggcggctggatacgcgagcggttgtcgcct

SEQ ID NO: 4386 - protein, 210 aa, Neisseria gonorrhoeae
MDLHNIREDYSKRELSEADCADNPIEQFERWLDEAVRAEVNEPTAVNVAAVDGRGRPNSRMVLLKEVNSEGFVFFTNYHSRKGRSLELNPFAAMTFFWPELERQVRVEGRVGRLAEKLSDEYFESRPYQSRLGAWASAQSEVIPNKAVLVAKAAAVGLKHPLHVPRPPHWGGYIVIPDLIEFWQGRPSRLHDRIQYRLLDGGWIRERLSP

SEQ ID NO: 4387 - DNA, 150 bp, Neisseria gonorrhoeae
ttgaacaggaaaaaacatatgccgtctgaaaaccggaatcaggtttcagacggcattttttcacggggaaaatacggacgggaagttttttgtgttccgaacggaaagcccgaatcctctttataccgaggaattatgatgcggacggcg

SEQ ID NO: 4388 - protein, 50 aa, Neisseria gonorrhoeae
LNRKKHMPSENRNQVSDGIFSRGKYGREVFCVPNGKPESSLYRGIMMRTA

SEQ ID NO: 4389 - DNA, 1008 bp, Neisseria gonorrhoeae
atgaaccacaccgttaccctgcccgaccaaaccacctttgccgccggcgacggcgaaaccgttttgtccgctgccgcccgtcaaaacctcaatctgccccattcctgcaaaaacggtgtctgcggacaatgcaaagccgaactggccagcggcgatattcaaatgggcggacactcggaacaggctttatccgaagcagaaaaagcgcaaggcaagattttgatgtgccgcaccaccgcgcaaagcgatatcaacatcaacatccccggctgcaaagccgatgccctacccgtccgcaccctgcccgcacgcatcgaaagtatggttttcaaacacgatgtcgccttcctgaaacttgccctgcccaaagccccgccgtttgccttctacgccgggcaatacattgatttactgctgccgggcaacgtcagccgcagctactccatcgccaattcgcccgaccaagaaggcattttggaactacacatccgcaggcgcgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgccggcaaccgacacaggctacgcccccatccgcagcatcctgctcgaccttatccgccaaaacagcagccgcgctgcccatttctactggggcgcgcgtcatcaagatgatttgtatgccctcgaagaagcacaagggttggcatgccgtctgaaaaacacctgcttcacccccgtattgtcccgtcccggagagggctggcagggaagaaaaggccacgtacaagacatcgcggcacaagaccaccccgacctgtcggaatacgaagtgtttgcctgcggctctccggctatgaccgaacaagcaaaaaatctgtttgtgcaacagcataagctgccggaaaacttgtttttctccgacgcattcacgccgtccgcatca

SEQ ID NO: 4390 - protein, 336 aa, Neisseria gonorrhoeae
MNHTVTLPDQTTFAAGDGETVLSAAARQNLNLPHSCKNGVCGQCKAELASGDIQMGGHSEQALSEAEKAQGKILMCRTTAQSDININIPGCKADALPVRTLPARIESMVFKHDVAFLKLALPKAPPFAFYAGQYIDLLLPGNVSRSYSIANSPDQEGILELHIRRRENGVCSEMIFGSEPKVKEKGIVRVKGPLGSFTLQEDSGKPVILPATDTGYAPIRSILLDLIRQNSSRAAHFYWGARHQDDLYALEEAQGLACRLKNTCFTPVLSRPGEGWQGRKGHVQDIAAQDHPDLSEYEVFACGSPAMTEQAKNLFVQQHKLPENLFFSDAFTPSAS

SEQ ID NO: 4391 - DNA, 1428 bp, Neisseria gonorrhoeae
atgacttgggaaactgtaatcggcttggaaatccacgtccaattgaacaccaaatccaaaatcttcagcggtgcatcgaccgcattcggcgcagaacccaacgcgcacgccagcgtagtggaatgcgcgctgccgggcgtactgccggtaatgaaccgcgaagtcgttgaaaaagccatcaaattaggtttggctttggatgcaaaaatcaaccggaaaaacgtgttcgaccgcaaaaactacttctatcccgacttgccgaaaggctatcaaatcagccagttggatttgccgattgtcgaacacggcaaattggaaatcgtggtcggcggcgatgtgaaaaccatcaacgtaacccgcgcccatatggaagaagacgcaggcaaatccgtgcacgagggcttgaacggcgcgaccggcatcgacctgaaccgcgccggcacgccgctgttggaagtggtatccgaacccgaaatgcgctccgccgccgaagccgttgcctacgccaaagccttacacagcttggtaacctggctggacatttgcgacggcaatatggcggaaggttcgttccgcatcgatgccaacgtatccgttcgcccgaaaggccaagcggaattcggcacgcgccgcgaaattaaaaacctcaattccttccgtttcttggatcaggcgattaattacgaagccgaagcgcaaatcgagattttggaagacggcggcacagttcagcaggcgacgatgctgttcgacccggaaaaaggcgaaacccgcgtgatgcgcctgaaagaagacgcgcacgactacggctacttccccgatcccgatttgctgcccgtcatcatttcagatgcccaaatgcaaaaagccaaagcagaaatgcccgagctgccgaaagaaatggcggcgcgtttcgtggcggattacggcgtgtccgaatacgacgcgcgcctgctcaccgccagccgcgtgcaggctgcctattttgaagaagccgccaaagagagcggacaaggcaagccgactgccaactggatgaacggcgaacttgccgctacgctgaacaaagaaggcatggaacttgccgacagcccgattaccgccccacgccttgccgcgctggtgggcaaaattgccgatggcacattaagcggcaaactggcgaaaaaagcctttgaagccatgtgggcggaaccggaaaccagcattgccgaaatcatcgaaaaacacagtttgcaacagatgaccgataccggcgcggttgaagcgatggtggacgaagtgctggcaaacaacgccaaagccgtggaacagtttaaatccggcaacgaaaaagccctgaatgcgattgtggggcaagtgatgaagaccagcaaaggcaaagccaatcccgctcaggtgcaggagttgattaaagccaaacttgcc

SEQ ID NO: 4392 - protein, 476 aa, Neisseria gonorrhoeae
MTWETVIGLEIHVQLNTKSKIFSGASTAFGAEPNAHASVVECALPGVLPVMNREVVEKAIKLGLALDAKINRKNVFDRKNYFYPDLPKGYQISQLDLPIVEHGKLEIVVGGDVKTINVTRAHMEEDAGKSVHEGLNGATGIDLNRAGTPLLEVVSEPEMRSAAEAVAYAKALHSLVTWLDICDGNMAEGSFRIDANVSVRPKGQAEFGTRREIKNLNSFRFLDQAINYEAEAQIEILEDGGTVQQATMLFDPEKGETRVMRLKEDAHDYGYFPDPDLLPVIISDAQMQKAKAEMPELPKEMAARFVADYGVSEYDARLLTASRVQAAYFEEAAKESGQGKPTANWMNGELAATLNKEGMELADSPITAPRLAALVGKIADGTLSGKLAKKAFEAMWAEPETSIAEIIEKHSLQQMTDTGAVEAMVDEVLANNAKAVEQFKSGNEKALNAIVGQVMKTSKGKANPAQVQELIKAKLA

SEQ ID NO: 4393 - DNA, 930 bp, Neisseria gonorrhoeae
atgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcctcccctatccgtcaggggctgttcctccactgcccgcaggatgcctatccgctgctgcgcgaatttgttgacaggcgttttaactgcaaacgccgtttagatgcgatgacggcagattttctcatggcggaaaaactcttcggcacagacgttctgtgccaaatggaagactgccgcttccatctggtcttggcgcacctttcagacggcatcagcttgtggctcaaccgcaacgacaactgcgtcgaagaaggcgcgtggtctttatctttgcgcgatgaagcaggcaaccggctgtatatggcgaccttcgcctttgtcggcacacacctgctgacagcctccgtacaagggccgtcaggtgaagaagccaaagacaccgtccgccgcataaccaaacaacttcacggcttacgtccccaacaactgatggtaaccgcactgcaatatttcgccgccgcattaaaattagacggcgcgataggcattgcacaaaaacatcaagtcaaattacgctggaaacttaaaaagcgcgtcaaaatgaattacgacgcattctggcaggaatacggcgcaagtttggaacgggacggctactggcatcttccccaaacccccgcccgcaaagaccttgccgacatcgaaagcaaaaagcgttcgatgtaccgcaagcgttatgaaatgctggacgatatggttgcaaagatgaaggacagtctgaaaacagaagcacgcggcatttcagacggcatccaaacggaaaaaccgctccgccggacagtc

SEQ ID NO: 4394 - protein, 310 aa, Neisseria gonorrhoeae
MKQNRTFTFPDFRTVYSYAPLYRLQHLKYTLRKFFGKKEIYAFEQFVNASPIRQGLFLHCPQDAYPLLREFVDRRFNCKRRLDAMTADFLMAEKLFGTDVLCQMEDCRFHLVLAHLSDGISLWLNRNDNCVEEGAWSLSLRDEAGNRLYMATFAFVGTHLLTASVQGPSGEEAKDTVRRITKQLHGLRPQQLMVTALQYFAAALKLDGAIGIAQKHQVKLRWKLKKRVKMNYDAFWQEYGASLERDGYWHLPQTPARKDLADIESKKRSMYRKRYEMLDDMVAKMKDSLKTEARGISDGIQTEKPLRRTV

SEQ ID NO: 4395 - DNA, 1443 bp, Neisseria gonorrhoeae
atgacccaatacacattgaaacaggcaggcagcctgttgcagtccaaacagatttccgccgtcgaactggcaagcgcataccttgccgccattgccgaaaaaaatcccgccctcaacggctatatcaccatcgaccaagataaaacccttgcagaagcccgtgccgccgacgaacgcatcgcgcagggcaacgcttcggcacttaccggcgttcccgtcgcctacaaagacattttctgccaaaccggctggcgcagcgcgtgcgcttccaaaatgctcgacaacttcatcttcccctacaccgccaccgtcgtccaaaacctgctcgacgaaggtatggtaacgctcggccgcaccaacatggacgagttcgctatgggttcgaccaatgaaaactcattctacggcgcggccaaaaacccgtggaatccggaacacgtacccggcggttcgtcaggcggttccgccgccgtcgttgccgcgcgcctcgcccctgccgcgctcggttcggacacgggcggctctatccgccaacccgcatcgcactgcggcattaccggcatcaaacctacctacggcacggtttcccgcttcggtatggtcgcctacgcctccagcttcgatcaagccggcccgatggcgcaaaccgccgaagactgcgcgattctgttgaatgcaatggcaggtttcgaccccaaagactccaccagcttcgaacgcgaaaaagaagactacacccgcgatttggacaaaccgctcaaaggcgtgaaaatcggcctgcccaaagaatacttcagcgaaggcaacagcaccgatgttcagacggcattgcaaaacaccattgatttgctgaaagcacaaggcgcggaactggtcgaagtttccctgccgcaaaccaagctgtccatccccgcctactacgtcctcgcctccgcagaagccggcaccaacctttcacgttacgacggcgtacgttacggacaccgtgccgcccaattcggcgatttggaagaaatgtacggcaaaacccgcgccgaaggttttggcagcgaagtcaaacgccgcatcatgatcggcacttacgtactgtcgcacggctactacgatgcctattatctcaaagcccaaaaactgcgccgcctcgttgccgatgactttcagacggcatttgcacggtgcgacctcatcctcgcgccgaccgcaccctccgccgcacccaaaatcggagcggatacttctccggttgaaacctacttgagcgacatttacaccatcgccgtcaacctcgccggactgcccgcattgaccctgcccgcaggcttcagcggcggcggactgcccgtcggtgtacagcttgtcggcaactacttcgccgaagccaaaatcctcggtgcggcgcatcaaatccaactcaacagcgattggcacggcaaacgacccgaa

SEQ ID NO: 4396 - protein, 481 aa, Neisseria gonorrhoeae
MTQYTLKQAGSLLQSKQISAVELASAYLAAIAEKNPALNGYITIDQDKTLAEARAADERIAQGNASALTGVPVAYKDIFCQTGWRSACASKMLDNFIFPYTATVVQNLLDEGMVTLGRTNMDEFAMGSTNENSFYGAAKNPWNPEHVPGGSSGGSAAVVAARLAPAALGSDTGGSIRQPASHCGITGIKPTYGTVSRFGMVAYASSFDQAGPMAQTAEDCAILLNAMAGFDPKDSTSFEREKEDYTRDLDKPLKGVKIGLPKEYFSEGNSTDVQTALQNTIDLLKAQGAELVEVSLPQTKLSIPAYYVLASAEAGTNLSRYDGVRYGHRAAQFGDLEEMYGKTRAEGFGSEVKRRIMIGTYVLSHGYYDAYYLKAQKLRRLVADDFQTAFARCDLILAPTAPSAAPKIGADTSPVETYLSDIYTIAVNLAGLPALTLPAGFSGGGLPVGVQLVGNYFAEAKILGAAHQIQLNSDWHGKRPE

SEQ ID NO: 4397 - DNA, 276 bp, Neisseria gonorrhoeae
ttgggtcataaatcttccatccttaaagggcttcgggcggtattgctgatgccgtctgaagcgtattcggattattcttcgataacttgcggtacgatgtacaggcggttgcgtacttccggcgcaacggcttggtattcggcggcgcggtcggtttcggttacttcgtcttcacgcaggcggagggcgacctcgtgcgggtgcgccatcggctcgatgccgtctgtgttgatgttctgcatctgttcgaccatagtgaaaatgtcgtttaattct

SEQ ID NO: 4398 - protein, 92 aa, Neisseria gonorrhoeae
LGHKSSILKGLRAVLLMPSEAYSDYSSITCGTMYRRLRTSGATAWYSAARSVSVTSSSRRRRATSCGCAIGSMPSVLMFCICSTIVKMSFNS

SEQ ID NO: 4399 - DNA, 564 bp, Neisseria gonorrhoeae
atgagtctttacgctttgctcttggttgcgctgggaatgtcgatggatgcgtttgccgtcgcgctggcaaagggcgcggcggtcaggatgcccccgcgcaaaattgcagcaacggctttggtgttcggtacggttgaagcgttcatgccgctggcgggctgggtaggcggtttttatgccaagccgtttatcagcgaatgggaccattgggtggcttttgtcctgttgggcggactgggtctgaaaatgatgcgcgaagggttgtccggcgaggcggaagatgtgcgcgaaagcaaacaggaaagcctatggatgacggttttgactgcttttggaaccagtattgattccatgatcgtcggggtgggcttggcgtttatggaggtaaacatcgcctttgccgccgccgtaatcggtatggcggctacggtaatggttaccatcgggctgacggcgggaaaggcttttggcgtattgttcggcaggcgtgcggaatttgccggaggtttggtgttgattgccatcggtacatggacgctcttatcgcatttgggtttgattcaa

SEQ ID NO: 4400 - protein, 188 aa, Neisseria gonorrhoeae
MSLYALLLVALGMSMDAFAVALAKGAAVRMPPRKIAATALVFGTVEAFMPLAGWVGGFYAKPFISEWDHWVAFVLLGGLGLKMMREGLSGEAEDVRESKQESLWMTVLTAFGTSIDSMIVGVGLAFMEVNIAFAAAVIGMAATVMVTIGLTAGKAFGVLFGRRAEFAGGLVLIAIGTWTLLSHLGLIQ

SEQ ID NO: 4401 - DNA, 297 bp, Neisseria gonorrhoeae
atgcttttcatggcactgacacttgccgacgtagacaaaatcgcccgactctcccgactgcagctgactgcggaagaaaaagaaaaatcgcttcaagaattaaacgacattttcactatggtcgaacagatgcagaacatcaacacagacggcatcgagccgatggcgcacccgcacgaggtcgccctccgcctgcgtgaagacgaagtaaccgaaaccgaccgcgccgccgaataccaagccgttgcgccggaagtacgcaaccgcctgtacatcgtaccgcaagttatcgaagaa

SEQ ID NO: 4402 - protein, 99 aa, Neisseria gonorrhoeae
MLFMALTLADVDKIARLSRLQLTAEEKEKSLQELNDIFTMVEQMQNINTDGIEPMAHPHEVALRLREDEVTETDRAAEYQAVAPEVRNRLYIVPQVIEE

SEQ ID NO: 4403 - DNA, 744 bp, Neisseria gonorrhoeae
ttgcttggatttttaattataacggaaaaatccgttgcggcggcaatttgcagcatcggatgcctgccgcacgggtttgaaagaggggaaataatgggattgggtatggaaatcggcaagctgattgtggcttttttggtgctgatcaatccgtttagcgcgttgtcgctttaccttgacctgaccaacggacacagcacgaaggagcgcaggaaggtcgcgcggacggccgccgtcgccgtgtttgccgtgattgcggtatttgcgctgatcggcggtgcgctattgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaagcgcgccccgcccgcaatgcaggggcgattgccgtcgtgcccatcgccataccgatcaccatcggtccgggcggtatttcgactgtgattatttatgcttcggcagccaaaacgtacagcgatatcgcgctgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggt

SEQ ID NO: 4404 - protein, 248 aa, Neisseria gonorrhoeae
LLGFLIITEKSVAAAICSIGCLPHGFERGEIMGLGMEIGKLIVAFLVLINPFSALSLYLDLTNGHSTKERRKVARTAAVAVFAVIAVFALIGGALLKVLGISVGSFQVGGGILVLLIAISMMNGNDNPAKQNLGAQPETGQARPARNAGAIAVVPIAIPITIGPGGISTVIIYASAAKTYSDIALIIAAGLVVSAICYAILIVAGKVSRLLGATGLTILNRIMGMMLAAVSVEIIVSGLKTIFPQLAG

SEQ ID NO: 4405 - DNA, 1341 bp, Neisseria gonorrhoeae
atgtttcacagtgtcaatgtatttacgggcgaaacgctttaccgccgccccgatcaagattatgcggagtttgaacggcggctggcggatttgaaaatgcacggcagggcgttcgcgcaattgggcgtaaccgaacgtgccgcgcgtctgcaaaaatttgccggccgtttggaggcggaaaaagagcgttttgcggaaatggtgtgcgaagaagtcggacgctgcctgcacgaatgccgtgccgaaatcgtcaagtctatcgaactgatacgctattacgcccgccttgcccccgaactgcttgcccacaaaaccattgcgacgcaggcgagtttgagtcaggtgcgcttcgagcctttgggcgtggtgtttgccgtcatgccttggaactatcccgtctggcaggtattgcgtttcgccgttcccgctatgtgcgcgggcaacgcgtgcgccgtcaaacccgcgcccagcgtggcacgcgtcagtcgggcgttgttcgatttggcttcagacggtattcctctggcaggcgcgtggctggatgaggcggacacgctcaaggcagtcgaagataccgatgcgatggcgtttaccggttcgacgcatacggggcgcattcttgcggcacatgcgggcgcaaacctcaagaaaaccgtgttggagctcggcggcagcaacgcctttatcgtgatgcccgatgccgatttggaacgcgccgccgcagaagcctgttattcccgtttccgcgatgcggggcaatcgtgtaacgccgccaagcgcatcatcgtaaccgaagccgcagccgaccgctttattcagctgtttctcgccgaatgcgccaaattgaaaatgggagacccgaaacatcccgataccacgcttgcaccgctgcaccgcgaagatttgcgggaccgggttcacgggcaggttgaagatgccgtttcaaacggcgcggtgtgcctgaccggaggcaaagttccacaggggtcggggtggttttaccctgcgacggttttagacagggtaaatcctgcctgccgcgtctggagagaagaagtattcggccccgtcgccctgattttgcgcgccgaaaacgaagaacacgccatctgccttgccaatgattccccgttcgggctcggtgcctgcatttataccgccgatactgaacgcgcctggcggtttgccgaaaaaatacaggccggatcggtgtttatcaaccgccataccagcagcgatttgcgcctgcctttcggcggagtcaaagattccggttacgggcgcgaactgtccgaattcgggttgtacgagttcgtcaacgtcaaaacctactggcagaaa

SEQ ID NO: 4406 - protein, 447 aa, Neisseria gonorrhoeae
MFHSVNVFTGETLYRRPDQDYAEFERRLADLKMHGRAFAQLGVTERAARLQKFAGRLEAEKERFAEMVCEEVGRCLHECRAEIVKSIELIRYYARLAPELLAHKTIATQASLSQVRFEPLGVVFAVMPWNYPVWQVLRFAVPAMCAGNACAVKPAPSVARVSRALFDLASDGIPLAGAWLDEADTLKAVEDTDAMAFTGSTHTGRILAAHAGANLKKTVLELGGSNAFIVMPDADLERAAAEACYSRFRDAGQSCNAAKRIIVTEAAADRFIQLFLAECAKLKMGDPKHPDTTLAPLHREDLRDRVHGQVEDAVSNGAVCLTGGKVPQGSGWFYPATVLDRVNPACRVWREEVFGPVALILRAENEEHAICLANDSPFGLGACIYTADTERAWRFAEKIQAGSVFINRHTSSDLRLPFGGVKDSGYGRELSEFGLYEFVNVKTYWQK

SEQ ID NO: 4407 - DNA, 426 bp, Neisseria gonorrhoeae
atgaactttgctttatccgtcatcacatttaccctcgcctctttcctgcccgtcccgcctgccggaaccgccgtctttacttggaaagacggcggcggcaacagctattcggatgtgccgaaacagcttcatcccgaccagagccaaatcctcaacctgcggacgctccaaaccaaaccggcggtcaagcccaaacctgccgtcgatacgaatgcggacagtgcgaaggaaaacgaaaaggatatcgccgagaaaaacgggcagcttgaggaagaaaagaaaaaaattgccgaaaccgaacggcagaacaaagaagaaaactgccggatttcaaaaatgaacctgaaggcggtgggaaactcaaatgcgaaaaacaaggatgatttgatccgtaaatacaataacgccgtaaacaaatactgccgt

SEQ ID NO: 4408 - protein, 142 aa, Neisseria gonorrhoeae
MNFALSVITFTLASFLPVPPAGTAVFTWKDGGGNSYSDVPKQLHPDQSQILNLRTLQTKPAVKPKPAVDTNADSAKENEKDIAEKNGQLEEEKKKIAETERQNKEENCRISKMNLKAVGNSNAKNKDDLIRKYNNAVNKYCR

SEQ ID NO: 4409 - DNA, 237 bp, Neisseria gonorrhoeae
gtgatgacggataaagcaaagttcattagggtttccttgatggctgactgcccgggcagaatcgggattggttcgggcggtgtcttttccgggttcgggtcaaggcagggaagacactccgccttaatatggtgctttatatattggggtaaaacagattcccaaaaatatcattggaatatggttatgctaccgtatattttggcaaagaaaaagaaaattgcaggcaggcgcgta

SEQ ID NO: 4410 - protein, 79 aa, Neisseria gonorrhoeae
VMTDKAKFIRVSLMADCPGRIGIGSGGVFSGFGSRQGRHSALIWCFIYWGKTDSQKYHWNMVMLPYILAKKKKIAGRRV

SEQ ID NO: 4411 - DNA, 111 bp, Neisseria gonorrhoeae
atgatgtcggaaaataaaatgccgtctgaagctttaccggtttcagacggcattttgttaaacttgattctctatcggtattattgtgtaaagctattgaaaataaaatat

SEQ ID NO: 4412 - protein, 37 aa, Neisseria gonorrhoeae
MMSENKMPSEALPVSDGILLNLILYRYYCVKLLKIKY

SEQ ID NO: 4413 - DNA, 948 bp, Neisseria gonorrhoeae
atggttgcccgcgtttacaaaggcgatgagcagctcggtttggtttatatcacgaccgatgcggtcaatacgcgcggttattcgagcaaaccgatcgatacgctgatggctttggcaaacgacggcacgatagccggggcgaaactggtcgatcatcacgaaccgattatgctgatcggtatcccgcaatcgcgtgtcgataagttcatcgacaaatatatcggtctgaattttattaaaaatccgccgaccccgagcgtggcgccgggcgacatcatcagcggtgcgactgttacactgatggtggttaacgacagcatccagcgttcgtacaaggtcattgccaaccaataccgtctgggttcggacaaggcccttcagacggcatccgcttccgatgttcgggaagccgcgcctgcgtcagaaacccgtccgcgccgtatggcaaatcccgacaagcaggatattttgtcttgggacgaacttttgaaacaaaaggccgtcggccatctgcatatcacgctcgatcaaatcaacaaactgtttgagaaaggcggcaaggccggcgtggccgatcacgccgaacagggcgatcctgacgatacctttattgatttgtatgttgccttggtcagccagccttccatcggtaaaagcctgctgggtgaggacggctgggcgcatctgcaaaaacggctgaaacccgggcagcaggcggttttggttgccggagagggccgttattcttggaaaggttcgggctatgtgcgcggcggtattttcgaccgtatcgagatgattcagggggagaacagcttccgttttaccgatgcccaacacgaacgcgtcgtcgagctgtctgccgccgatgcgccgcgttttaaagaagtttcttggtttaccatccctgaaggcgtagcgtttgacggtgcggagccgtggcggctg

SEQ ID NO: 4414 - protein, 316 aa, Neisseria gonorrhoeae
MVARVYKGDEQLGLVYITTDAVNTRGYSSKPIDTLMALANDGTIAGAKLVDHHEPIMLIGIPQSRVDKFIDKYIGLNFIKNPPTPSVAPGDIISGATVTLMVVNDSIQRSYKVIANQYRLGSDKALQTASASDVREAAPASETRPRRMANPDKQDILSWDELLKQKAVGHLHITLDQINKLFEKGGKAGVADHAEQGDPDDTFIDLYVALVSQPSIGKSLLGEDGWAHLQKRLKPGQQAVLVAGEGRYSWKGSGYVRGGIFDRIEMIQGENSFRFTDAQHERVVELSAADAPRFKEVSWFTIPEGVAFDGAEPWRL

SEQ ID NO: 4415 - DNA, 1344 bp, Neisseria gonorrhoeae
atgtcggccggacggcttttggcacgaaatcgaacgtattatgaaggccgtctgaaaccctttaccaactttaagagaacccattacattatgaacgccgcacaactcgaccataccgccaaagttttggctgaaatgctgactttcaaacagcctgccgatgccgtcctctccgcctatttccgcaaacacaaaaagctcggccgccaagaccgccacgaaatcgccgaaaccgcctttgccgcgttgcgacactatcaaaaaatcagtaccgccctgcgccgtccgcacgcgcagccgcgcaaagccgcactcgccgcgctggttctcggcagaagtaccaacatcagccaaatcaaagacctgcttgatgaagaagaaacagagtttttcggcaatttgaaagcccgtaaaaccgagttttcagacggcctgaataccgccgcagaattgccgcaatggctggtggaacaactgcagcagcattggagcgaagaagaaatcctcgctttcggccgcagcatcaaccaagctgcgccgctcgacatccgcgtcaataccttgaaaggcaaacgcgacaaagtattgccattgttgcaagccgaaagccccgatgcagaggcaacgccttattctccttggggcatccgcctgaaaaacaaaatcgcgcttaacaaacacgaactgtttttggacggcacgctggaagtccaaggcgaaggcagccagctgcttgccttattggtgggcgcaaaacgcggcgaaatcattgtggatttctgtgccggagccggcggtaaaaccttggctgtcggcgcccaaatggccaacaaaggcagaatctacgccttcgacatcgccgaaaaacgccttgccaacctcaaaccgcgcatgacccgtgccggactgaccaacatccaccccgaacgtatcggcagcgaacacgatacccgtatcgcacgactggcaggcaaagccgaccgcgtgttggtcgatgcgccctgctccggcttaggcacactgcgccgcaatcccgacctcaaataccgccaatccgccgagaccgtcgccaaacttttggaacagcaacacagtatcctcgatgccgcctccaaactggtgaaaccgcaaggctgtttggtttacgccacctgcagcgtgttgccggaagaaaacgaactgcaaatcaaacgtttcctgtccgaacatcccgaatttgaacccgtcaactgcgccgaactgctgcaaaacctgaaggtcgatttggataccggcaaatacctgcgcctcgattccgcccgacaccaaaccgacggcttcttcgccgccgtattgcaacgcaaa

SEQ ID NO: 4416 - protein, 448 aa, Neisseria gonorrhoeae
MSAGRLLARNRTYYEGRLKPFTNFKRTHYIMNAAQLDHTAKVLAEMLTFKQPADAVLSAYFRKHKKLGRQDRHEIAETAFAALRHYQKISTALRRPHAQPRKAALAALVLGRSTNISQIKDLLDEEETEFFGNLKARKTEFSDGLNTAAELPQWLVEQLQQHWSEEEILAFGRSINQAAPLDIRVNTLKGKRDKVLPLLQAESPDAEATPYSPWGIRLKNKIALNKHELFLDGTLEVQGEGSQLLALLVGAKRGEIIVDFCAGAGGKTLAVGAQMANKGRIYAFDIAEKRLANLKPRMTRAGLTNIHPERIGSEHDTRIARLAGKADRVLVDAPCSGLGTLRRNPDLKYRQSAETVAKLLEQQHSILDAASKLVKPQGCLVYATCSVLPEENELQIKRFLSEHPEFEPVNCAELLQNLKVDLDTGKYLRLDSARHQTDGFFAAVLQRK

SEQ ID NO: 4417 - DNA, 846 bp, Neisseria gonorrhoeae
atgaattacgccctagacgcattatggtggaaactcaccagccaacccgtccgcgacctcgcctcgctgctgactgcgccgcctttgtggcaaagcggttgcgaattgagcgtgcgcgaactactgggggaacgcggtttccgctaccttttagcattggatgccgatcccgcgccgctgacggattaccttgcacaacgcgccccgttcgaccaccgtctcggcatttatgccgaagagctgctggctttttggtttaccaacgcaccgcacaccaaactgcacgcatataatctgaccgttttttcagacggccaaactttaggcgccgcggattttgtcgtttccctcaaccaacagccctatcatatcgagctggcgtgtaaatactacggcggagaccaagtgcagaacctgcgcggtctcaatcccaaagacacgctgacggacaaagccgccaaattggtgcagcaattccagctggtgcatacgtcgcaaggcaaagcaaccttagccgcacaagacctgccggaaaatccacttcctgcttccatcgtgcgcggcatcggattttttccacaaggtttccatgcttttgagccgccgcttaatccatacggctggcgcggcatctatattcaagattgggcggaatacgggtttgaacgccaagaagcgcgctatcacctgctcgaccgcatggtctatctcgcgcctgcgcgtgtcgccgaaaccgaaacattaaacgcaaccgaaatccgccgcatcgaccaaggcttgattgccgttttggaatgtcggccggacggcttttggcacgaaatcgaacgtattatgaaggccgtc

SEQ ID NO: 4418 - protein, 282 aa, Neisseria gonorrhoeae
MNYALDALWWKLTSQPVRDLASLLTAPPLWQSGCELSVRELLGERGFRYLLALDADPAPLTDYLAQRAPFDHRLGIYAEELLAFWFTNAPHTKLHAYNLTVFSDGQTLGAADFVVSLNQQPYHIELACKYYGGDQVQNLRGLNPKDTLTDKAAKLVQQFQLVHTSQGKATLAAQDLPENPLPASIVRGIGFFPQGFHAFEPPLNPYGWRGIYIQDWAEYGFERQEARYHLLDRMVYLAPARVAETETLNATEIRRIDQGLIAVLECRPDGFWHEIERIMKAV

SEQ ID NO: 4419 - DNA, 813 bp, Neisseria gonorrhoeae
atgactgctctcaaacccgccctgcccgactacctcggcaacatccgcatcatcctcacacgcaccagccaccccgccaacatcggctctgccgcacgcgcgatgaaaacgatgggtctgcacaggctgaccatcgtcacccccaatctgatggcaacgccgatgacggaaaatccgcccgtttttaatcccgatgacgtgcaaagttttgcactgcctgaagaaagtttcatcctcgcttccggcgcggcggacgtattgcacaacgccgaaatcgtcgccacactggacgaagcccttgccgacaccaccatcgcctgcgccctgaccagccgccgccgcgaaatcaccgcgccgctgcaaaccccgcgcgatttggtgcccgaattactgcaggccgccaaccgcggcgagaaagtggcgctggtcttcggcaacgagactttcggcttgagcatcgaagaagtccgagcgtgcaaccgactgatgaccatcaacggcaaccccgactatttctcgctcaacctcgcccaagccgtgcaggtcgtgtgctacgaaattttcagccaaaccgattcgcccatgacccatcttcaacaggaagaccacgccgcaacccacgagcaaatcaaaggcatgctcgcccacatggaaagcgtgatggacgacatcggctttttcaaccgccgcaacggcgagcgtctgatgcgccgtatgcagagcctgttcggacgcgccaacacgcaaaccgaagacatcgacatcctgcgcggttttttcaataccgtcagccaccgtatccataaaaaagac

SEQ ID NO: 4420 - protein, 271 aa, Neisseria gonorrhoeae
MTALKPALPDYLGNIRIILTRTSHPANIGSAARAMKTMGLHRLTIVTPNLMATPMTENPPVFNPDDVQSFALPEESFILASGAADVLHNAEIVATLDEALADTTIACALTSRRREITAPLQTPRDLVPELLQAANRGEKVALVFGNETFGLSIEEVRACNRLMTINGNPDYFSLNLAQAVQVVCYEIFSQTDSPMTHLQQEDHAATHEQIKGMLAHMESVMDDIGFFNRRNGERLMRRMQSLFGRANTQTEDIDILRGFFNTVSHRIHKKD

SEQ ID NO: 4421 - DNA, 207 bp, Neisseria gonorrhoeae
gtgcagtccttcggagcggcaaaatcggagtttatctggttggggcaaaccctgccaaatcgggtaaaataccgcctgacgcgtgtctgcttcaggcgcaacgttaaatttccgacgttgttaaagaacagttcagacggcatttcaccgtccgaacgaaaaagacggcgcattataccctattccattccgaccgaaaaccgaaca

SEQ ID NO: 4422 - protein, 69 aa, Neisseria gonorrhoeae
VQSFGAAKSEFIWLGQTLPNRVKYRLTRVCFRRNVKFPTLLKNSSDGISPSERKRRRIIPYSIPTENRT

SEQ ID NO: 4423 - DNA, 897 bp, Neisseria gonorrhoeae
ttgcgccagtactttgggattggcagccacaatatcgccgctttccaaccaagcgtcctcacccgacatatcggtaacgatgccgcctgcttcttggacaatcaatgcaccggcggcaatgtcccacggtttgaggttgaactcgaaaaagccgtcaaaacgtcctgttgctacggcgcacaaatccaaagaagccgcgccttcgcggcggcctccggcggtttttgccaaaaagtctttcaaaatcgccagatatttgtccatcatgctttgatcgacaacagggaagccggtaccgatcaggcagcggttcaattcgatgcggttggagacacggatgcggcggtcgttaagcaacgcgcctttaccgcgcgaagccatgtacacgtcgttacgttcgggggcgtacaccaaagcttcctgcaacacgcctttgtgcagcagtgccatagagatggcgtattggggatggccgtgaaggaaattggtcgtcccgtcgagcggatcgataatccattcgtactcggctgtagctttgccgtggaagccgctttcttcgcaagtgattttgtgatgcggataagcttctttcaaagcctcaaccaggatgatttcggaattgcggtcaacatcggaaacaaaatcgttgaaggctttgctgtcggttttgacggcatcgaggttacctgcggcgcgaatcatcatctgaccggcacggcgggcggctttaaaggctgtattcaaaaacggattcatcagatttccttaagggtggcataccgccggttcggacgtgcagtccttcggagcggcaaaatcggagtttatctggttggggcaaaccctgccaaatcgggtaaaataccgcctgacgcgtgtctgcttcaggcgcaacgt

SEQ ID NO: 4424 - protein, 299 aa, Neisseria gonorrhoeae
LRQYFGIGSHNIAAFQPSVLTRHIGNDAACFLDNQCTGGNVPRFEVELEKAVKTSCCYGAQIQRSRAFAAASGGFCQKVFQNRQIFVHHALIDNREAGTDQAAVQFDAVGDTDAAVVKQRAFTARSHVHVVTFGGVHQSFLQHAFVQQCHRDGVLGMAVKEIGRPVERIDNPFVLGCSFAVEAAFFASDFVMRISFFQSLNQDDFGIAVNIGNKIVEGFAVGFDGIEVTCGANHHLTGTAGGFKGCIQKRIHQISLRVAYRRFGRAVLRSGKIGVYLVGANPAKSGKIPPDACLLQAQR

SEQ ID NO: 4425 - DNA, 783 bp, Neisseria gonorrhoeae
atgaatccgtttttgaatacagcctttaaagccgcccgccgtgccggtcagatgatgattcgcgccgcaggtaacctcgatgccgtcaaaaccgacagcaaagccttcaacgattttgtttccgatgttgaccgcaattccgaaatcatcctggttgaggctttgaaagaagcttatccgcatcacaaaatcacttgcgaagaaagcggcttccacggcaaagctacagccgagtacgaatggattatcgatccgctcgacgggacgaccaatttccttcacggccatccccaatacgccatctctatggcactgctgcacaaaggcgtgttgcaggaagctttggtgtacgcccccgaacgtaacgacgtgtacatggcttcgcgcggtaaaggcgcgttgcttaacgaccgccgcatccgtgtctccaaccgcatcgaattgaaccgctgcctgatcggtaccggcttccctgttgtcgatcaaagcatgatggacaaatatctggcgattttgaaagactttttggcaaaaaccgccggaggccgccgcgaaggcgcggcttctttggatttgtgcgccgtagcaacaggacgttttgacggctttttcgagttcaacctcaaaccgtgggacattgccgccggtgcattgattgtccaagaagcaggcggcatcgttaccgatatgtcgggtgaggacgcttggttggaaagcggcgatattgtggctgccaatcccaaagtactggcgcaaatgttaaaaatcatttccgcacacgtt

SEQ ID NO: 4426 - protein, 261 aa, Neisseria gonorrhoeae
MNPFLNTAFKAARRAGQMMIRAAGNLDAVKTDSKAFNDFVSDVDRNSEIILVEALKEAYPHHKITCEESGFHGKATAEYEWIIDPLDGTTNFLHGHPQYAISMALLHKGVLQEALVYAPERNDVYMASRGKGALLNDRRIRVSNRIELNRCLIGTGFPVVDQSMMDKYLAILKDFLAKTAGGRREGAASLDLCAVATGRFDGFFEFNLKPWDIAAGALIVQEAGGIVTDMSGEDAWLESGDIVAANPKVLAQMLKIISAHV

SEQ ID NO: 4427 - DNA, 249 bp, Neisseria gonorrhoeae
gtgccgatatttcagacggcatttttattggcggcggggcaggaaggcggaaacggtcaaatgcccgaaattgccgggaatggaaatccgtatctggttaaacggagaaccctgtgcaatttgtcccttttctttcaattgtttaaaggcggtttgctggaatctaaatcggctgtggcagaaaacagacaccggggaataaaaaacaagggtctgtaccagattagcagatatgttaccctcgaaata

SEQ ID NO: 4428 - protein, 83 aa, Neisseria gonorrhoeae
VPIFQTAFLLAAGQEGGNGQMPEIAGNGNPYLVKRRTLCNLSLFFQLFKGGLLESKSAVAENRHRGIKNKGLYQISRYVTLEI

SEQ ID NO: 4429 - DNA, 144 bp, Neisseria gonorrhoeae
tcgcatttgggtttgattcaatgatgtcggaaaataaaatgccgtctgaagctttaccggtttcagacggcattttgttaaacttgattctctatcggtattattgtgtaaagctattgaaaataaaatattgattttccgcaa

SEQ ID NO: 4430 - protein, 7 aa, Neisseria gonorrhoeae
SHLGLIQ

SEQ ID NO: 4431 - DNA, 219 bp, Neisseria gonorrhoeae
atgcggattggttttaagatttgtaaatttgatttgcatcaaaaatcgccgatagatgattcatataatatcaatattaaagagtatcggtatatcggggatagctatgtcctgtttttcaatccggcgtatgtctgcgtttcgggcgcggataacggcgttttttaccgcctttgtctttttgacggcggcactgcccgcttatgcggagcgtctgcc

SEQ ID NO: 4432 - protein, 73 aa, Neisseria gonorrhoeae
MRIGFKICKFDLHQKSPIDDSYNINIKEYRYIGDSYVLFFNPAYVCVSGADNGVFYRLCLFDGGTARLCGASA

SEQ ID NO: 4433 - DNA, 186 bp, Neisseria gonorrhoeae
atggttaatatccgcacaccattgtgcgaaattgggcattgtattgttatttgcctgttttgtcaaagtttgcgcggttcgggcaatcatatgccgtctgaaaagatgtaccctgatggctttgctgatataattgcccgctatttgaatcagctttcaagcggtatctgccgtttgacggaaacg

SEQ ID NO: 4434 - protein, 62 aa, Neisseria gonorrhoeae
MVNIRTPLCEIGHCIVICLFCQSLRGSGNHMPSEKMYPDGFADIIARYLNQLSSGICRLTET

SEQ ID NO: 4435 - DNA, 234 bp, Neisseria gonorrhoeae
gtgttatcttcatatttcgagggtaacatatctgctaatctggtacagacccttgttttttattccccggtgtctgttttctgccacagccgatttagattccagcaaaccgcctttaaacaattgaaagaaaagggacaaattgcacagggttctccgtttaaccagatacggatttccattcccggcaatttcgggcatttgaccgtttccgccttcctgccccgccgccaa

SEQ ID NO: 4436 - protein, 78 aa, Neisseria gonorrhoeae
VLSSYFEGNISANLVQTLVFYSPVSVFCHSRFRFQQTAFKQLKEKGQIAQGSPFNQIRISIPGNFGHLTVSAFLPRRQ

SEQ ID NO: 4437 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttgccaaccatcgtttggccttggctgccgatgaggttttcgagggccccgccgggccgggcggaagctgtttcggcgggcggcgtaaaggcagacgcggtcgcggcgcggcaggaaaagcggttgtcttcggcattccgaaacgcaacgggcgggcctataccgttgccgcagacgatgccgagcctgaaacgttgctccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaacctttcccgccgttgttgagggaatgcgaatttcgacttaacttcggcacaccgtcccggcagctaaaaatcctgcgggatcggtgtggaatt

SEQ ID NO: 4438 - protein, 217 aa, Neisseria gonorrhoeae; identical to SEQ ID NO: 3930

SEQ ID NO: 4439 - DNA, 1068 bp, Neisseria gonorrhoeae
atgaccaaacatatcgccatcctccgaggcgacggcatcggtcccgaaatcgtcgccgaaaccgtccgcgtactcgacaaatttatcgcccaaggcttggatgccgactacgaatacgcgcctttgggcggcgaagcctacgacgaatacggccatccttatccagaatttacgcaaaacctctgccgcaaagccgatgccgtcctgcttggtgcagtcggttcgccccaatacgacaatctcgaccgtccgttgcgccccgagcgcggcttgttagcaattcgtaaggatttgaacctgtttgccaatttgcgtcctgccgttttatatcccgaattagccaacgcctccacgctcaagcctgaaatcgttgccggtttggatattttgattgtgcgcgaacttaccggcgatatttatttcggcgaaccgcgcggcatccgtgttttggaaaacggcgaacacgaaggctacaacaccatgaaatacagcgaaagcgaaatccgccgcatcgcccacgtggccttccaatccgcccaaaaacgcagcaaaaaagtctgctccgtaggcaaagccaacgttttggaaaccaccgaactgtggcgcgaaatctttgaagaaatcggcaaacaatatcccgatgtcgagctttcccatatgtatgtggacaatgccgccatgcaactcgtgcgcgcgcccaaacagtttgacgtgattgccaccggcaacatcttcggcgacatcctctccgacgaagcctccatgctgaccggctccatcggtatgctgccttccgcttctttggacgaaaacggcaaaggcctgtacgaaccgtctcacggctccgcccccgacatcgccggacaaaacaaagccaacccgctggccaccatcctctcgcttgccatgctgctgcgttacagcctgaacgacgaagcgcgcgcgcaacaagtcgaaaactccgtccaaaaagtgctgcaacaaggcttgcgtaccggcgatatttacgaagaaggcacaaaactcgtttcctgctccgaaatgggcgacgcggtactcgccgccttg

SEQ ID NO: 4440 - protein, 356 aa, Neisseria gonorrhoeae
MTKHIAILRGDGIGPEIVAETVRVLDKFIAQGLDADYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEHEGYNTMKYSESEIRRIAHVAFQSAQKRSKKVCSVGKANVLETTELWREIFEEIGKQYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENSVQKVLQQGLRTGDIYEEGTKLVSCSEMGDAVLAAL

SEQ ID NO: 4441 - DNA, 729 bp, Neisseria gonorrhoeae
atgataaaacttactgcacaacaaatatttgataagttgctggatgaagaaaaaatcttatcggccaatggtcaaattagatttttcttaggagatgtggatattatcgtcaaacaaaaagatgttgtcggcaacatcattcaggaatggctcggcggatggttgagaaaaagggaaattgaatttgatgtttcaaccaatacccaaatgcctcccgatttctttttaaataaaaaagaccgcagcagagaattgttggaagtaaaggcgttcaaccgaaatgcctgcccgggttttgatattgcagattttaaaatgtattctgatgaaatcattcataagccctatatgctggatgtagattatttaatattcggttacgatatggacgacaacggcaatgtaaccatcaaggatttatggcttaaaaaagtatggcaaattaccagaagcatggatgggtgggcaattaatcttcaagtcaaaaaaggcgtggtgcataaaatccgcccgggtgtttggtacagcataaataaaaagaatatgcctatgtttgaatgcttggaagattttgtttccgcaattgaagaaaccgtttatcaaaacccggcaacacggcataacgcatccttatggaaaaagaaatttgaggaagcttataaaaaacactacaaccgatcgatttccataccccgttggcacgaaattgcacacaaatacaaaaagaaa

SEQ ID NO: 4442 - protein, 243 aa, Neisseria gonorrhoeae
MIKLTAQQIFDKLLDEEKILSANGQIRFFLGDVDIIVKQKDVVGNIIQEWLGGWLRKREIEFDVSTNTQMPPDFFLNKKDRSRELLEVKAFNRNACPGFDIADFKMYSDEIIHKPYMLDVDYLIFGYDMDDNGNVTIKDLWLKKVWQITRSMDGWAINLQVKKGVVHKIRPGVWYSINKKNMPMFECLEDFVSAIEETVYQNPATRHNASLWKKKFEEAYKKHYNRSISIPRWHEIAHKYKKK

SEQ ID NO: 4443 - DNA, 1233 bp, Neisseria gonorrhoeae
atgagtggcatcaggaaaggattcgaacaagcctgtcggaaacagtcggttgcttgcgaatgtgtttttacttcagaaatcaaaccggcagctttggaagtattgaagcaaaactaccctgatgaagtgccgtatggagatataacgaaaattgaaacaggggatattcccgattttgacatcctgttggcaggcttcccttgtcaggctttttctttcgccggaaaaagattaggctttgaagatacacggggaacgcttttctttgatgtggcaaggattttaaaggcaaaaaaaccaaaaggttttattttggaaaatgtggaaggattggtgacacacgatagaaaagattcgacacaaaaaatagggcgcaccctgaccgttattttggaaaccttggaagcattgggctactatgtttcttggaaagttttaaatgcaaaagatttcggcattccccaaaacaggaagcgcatttatctgacaggcagtttgaaatccaaacccgacttatctttcgaaacaagcccaagtccgaaattaaaaaatattttggaatcgggactgcctactgaaagcagccctttcatcaaaaaattgctaaaaaaatttcccccgtccgaactgtacggaaaatcagtaaaagacaaacggggagggaaaaacaatattcacagttgggatattgaattaaaaggcgcagtaaccgaagaagagaagcaattgttaaatatccttctaaaagaacggaggaaaaaaaaatgggcttcagaaatcggcatagattggatggatgggatgcctttgacaaaagcgcaaatttcaactttctataaacaccccgatctccaaaatattttggacagcctgacagacaaaggctatttggttttagagcatccgaaacaaaaaattggcgggcaaagaatcaaagatgaatccctgcccaaaggctacaatattgtttcaggtaaaaaatcttttgaaatcaataaaatattagatccaaacgatgttgcgccaaccttggttgcaatggatatggagcaccttttcgtcgttgacaacggcggtttgcgtacacttaccggaaaagaagggttacgcttattcggctatccggacgattattcgtttgatattcccaaaaaagacagatgcgatttattgggtaataccgttgccgtccctgtgattaaggcggtatctgaaagacttctgcatacttta

SEQ ID NO: 4444 - protein, 411 aa, Neisseria gonorrhoeae
MSGIRKGFEQACRKQSVACECVFTSEIKPAALEVLKQNYPDEVPYGDITKIETGDIPDFDILLAGFPCQAFSFAGKRLGFEDTRGTLFFDVARILKAKKPKGFILENVEGLVTHDRKDSTQKIGRTLTVILETLEALGYYVSWKVLNAKDFGIPQNRKRIYLTGSLKSKPDLSFETSPSPKLKNILESGLPTESSPFIKKLLKKFPPSELYGKSVKDKRGGKNNIHSWDIELKGAVTEEEKQLLNILLKERRKKKWASEIGIDWMDGMPLTKAQISTFYKHPDLQNILDSLTDKGYLVLEHPKQKIGGQRIKDESLPKGYNIVSGKKSFEINKILDPNDVAPTLVAMDMEHLFVVDNGGLRTLTGKEGLRLFGYPDDYSFDIPKKDRCDLLGNTVAVPVIKAVSERLLHTL

SEQ ID NO: 4445 - DNA, 102 bp, Neisseria gonorrhoeae
atgaaaacaatttatcgcccctctgtttacattagccgcagcaattatatgttatcaggaatgccgtctgaacagccttcagacggcataggttttaaccgt

SEQ ID NO: 4446 - protein, 34 aa, Neisseria gonorrhoeae
MKTIYRPSVYISRSNYMLSGMPSEQPSDGIGFNR

SEQ ID NO: 4447 - DNA, 639 bp, Neisseria gonorrhoeae
atgaaagcctttaccaaaatcaccgccatcgtcgccccgctcgaccgcagcaacgtcgataccgatgccatcatccccaaacaatttctgaaatccatcaaacgcagcggcttcggccccaacgcctttgacgaatggcgttacctcgaccacggcgaaccgggcatggacaacggcaaacgcccgttgaaccccgatttttccctgaaccagccgcgttaccaaggcgcgcaaatcctgttgacgcgtaaaaacttcggttgcggctcttcacgcgaacatgccccttgggcattggacgactacggcttccgcgccattatcgcccccagcttcgccgacatcttctttaacaactgctacaaaaacggccttttgcccatcgtgttgaccgaagaacaagtcgaccggcttttcaaagaagtcgaagccaacgaaggctatcggctctccatcgaccttgccgagcaaaccctgaccaccccgggcggcgaaacattcacattcgacattaccgaacaccgcaaacactgcctcttaaacggcttggacgaaatcggactgaccctgcaacacgccgacaaaattaaagcctttgaagaaaaacgccgccaaagccagccttggctgtttaacggt

SEQ ID NO: 4448 - protein, 213 aa, Neisseria gonorrhoeae
MKAFTKITAIVAPLDRSNVDTDAIIPKQFLKSIKRSGFGPNAFDEWRYLDHGEPGMDNGKRPLNPDFSLNQPRYQGAQILLTRKNFGCGSSREHAPWALDDYGFRAIIAPSFADIFFNNCYKNGLLPIVLTEEQVDRLFKEVEANEGYRLSIDLAEQTLTTPGGETFTFDITEHRKHCLLNGLDEIGLTLQHADKIKAFEEKRRQSQPWLFNG

SEQ ID NO: 4449 - DNA, 342 bp, Neisseria gonorrhoeae
gtgcggatattaaccataacccttatggagttgagtatgtacgcggtcgtaaaaaccggcggcaaacagtataaagtttccgtcggcgaaaaattgaaagtagaacagataccagcccaactcgacagccaaatcgaactgaccgaagttttgatgattgctgacggcgaatctgtaaaagttggcgcaccctttatcgaaggtgcaaaagtaacggctaaagtagtggcacacggtcgtggcgaaaaagtccgcatcttcaaaatgcgccgccgcaaacactaccaaaaacgccaaggccaccgccaaaatttcacccaaatcgaaatcgtggcaatcgcc

SEQ ID NO: 4450 - protein, 114 aa, Neisseria gonorrhoeae
VRILTITLMELSMYAVVKTGGKQYKVSVGEKLKVEQIPAQLDSQIELTEVLMIADGESVKVGAPFIEGAKVTAKVVAHGRGEKVRIFKMRRRKHYQKRQGHRQNFTQIEIVAIA

SEQ ID NO: 4451 - DNA, 153 bp, Neisseria gonorrhoeae
ttgtgtaaagctattgaaaataaaatattgattttccgcaaagatggctaaaggtgcgataggtacactgaagaaataatcggcagaacaggtttgcctgccggtttgaacaatgattttaacctcccataaggaatacacgatgtctttcaa

SEQ ID NO: 4452 - protein, 16 aa, Neisseria gonorrhoeae
LCKAIENKILIFRKDG

SEQ ID NO: 4453 - DNA, 174 bp, Neisseria gonorrhoeae
gtgcggatacggattgcctcctcgaccggcagcacaaaaatcttgccgtcgccgattttgcccgaacgcgccacctcgacaatcacgtcaatcgcgcgttccacggcatcatccgccaacaccaactcgattttgaccttgggcaggaaatcgacggcgtattccgcaccgcga

SEQ ID NO: 4454 - protein, 58 aa, Neisseria gonorrhoeae
VRIRIASSTGSTKILPSPILPERATSTITSIARSTASSANTNSILTLGRKSTAYSAPR

SEQ ID NO: 4455 - DNA, 864 bp, Neisseria gonorrhoeae
ttttgcaggtttgatgtttgccttacccaacagcgcaccgacggcacggtcaatccgttccgcctgaaggttgccggcaatctgtcctttcatttcgtcaaaagaaggcactttcacctcgcggctgtcgttgacataataaacgccgtagaaatcgccgtttttcagcggcgttgccgtaaattcgccttttttcaagtccttaattgcctgataaagcggcggaacaccctgttccaaatctttcagcggcacatatccgtccggcgcgccggtccgtttggtgcggtcgttgagcgagtattgtttcaaaacggcatcaaaaccttttttcgccttcaaatcggcaaccgcttttttcgcattttcttccttgtcggtcaggatttcgcccaactggacttcctgcgtgcctttataaaaaccgctgatattgtcgtaaacggcttttacttcctgctcggaaaccggttgggttttggcgatatgcagtgcgtatgcctcgccgttcaagccatattttaccgcctgccaaacggttttgaaggacggtttcttgtcgtcgcccgactttttcgcttcggcacgcaatttggcaagcgcatctttaaactctgccgaccggtcgagtttcaggcgtttcacttcctgtgcgaccacggtgttgaccacttcgttttccagcagggattggcgcagttgcggcgtgtcttcggcacggctgttttccgcacggaatgcggcaacctgcgcatcgatgacggaactgtcgattttctgaccgttaacggttgccagcgtttgggcaaacaggctgccggaacaggcaagcagcgcaacggaagtcaggatttttgctttcat

SEQ ID NO: 4456 - protein, 288 aa, Neisseria gonorrhoeae
FCRFDVCLTQQRTDGTVNPFRLKVAGNLSFHFVKRRHFHLAAVVDIINAVEIAVFQRRCRKFAFFQVLNCLIKRRNTLFQIFQRHISVRRAGPFGAVVERVLFQNGIKTFFRLQIGNRFFRIFFLVGQDFAQLDFLRAFIKTADIVVNGFYFLLGNRLGFGDMQCVCLAVQAIFYRLPNGFEGRFLVVARLFRFGTQFGKRIFKLCRPVEFQAFHFLCDHGVDHFVFQQGLAQLRRVFGTAVFRTECGNLRIDDGTVDFLTVNGCQRLGKQAAGTGKQRNGSQDFCFH

SEQ ID NO: 4457 - DNA, 336 bp, Neisseria gonorrhoeae
ttgattttcaaatgccgcccgaatgtgtttcagacggcatcggctgtttcggcgttctccggcggcgttttggaggtggtaagattgtgctgccggcggctatccgtccttttcaatccgggcgtgatgctgtttgtgccggactgtcccgtcggcggcgcggccgggtttttccaatatgaaatgctttgcccgcttttccggcaggggcggttgcagaccggttcgaattttgcttacgatgtttttatgtctgccggacgtttgaatggcgggcggaaacccccgcgccgcctactcgttttcttgccctgctttgctccgttgccttataat

SEQ ID NO: 4458 - protein, 112 aa, Neisseria gonorrhoeae
LIFKCRPNVFQTASAVSAFSGGVLEVVRLCCRRLSVLFNPGVMLFVPDCPVGGAAGFFQYEMLCPLFRQGRLQTGSNFAYDVFMSAGRLNGGRKPPRRLLVFLPCFAPLPYN

SEQ ID NO: 4459 - DNA, 321 bp, Neisseria gonorrhoeae
atgggtttgcgtcttgtgctgacgatgccgtctgaaacggtttcagacggcatcgcaaatcggttattcggtggcgttttcgatttttttgccgagatgggaaatgccgcgtccgacggcattgccgccttttttgacggcttctttggttttgtcccaacctttttcgacggcgttgcctgtttgttcggcggcgcgttcggcggcggcctgtgttttgtcaaggttgcgggcggtgtcttgtttcgcgccctgccaagtgccggcgcaggcggacaaggcgagggcggacagggcggtaacgaaaagtttgttcatggt

SEQ ID NO: 4460 - protein, 107 aa, Neisseria gonorrhoeae
MGLRLVLTMPSETVSDGIANRLFGGVFDFFAEMGNAASDGIAAFFDGFFGFVPTFFDGVACLFGGAFGGGLCFVKVAGGVLFRALPSAGAGGQGEGGQGGNEKFVHG

SEQ ID NO: 4461 - DNA, 321 bp, Neisseria gonorrhoeae
ttgacgaggccgtctgaaatatgtcccgtaaggcagaaacacctaatattcaaaccaaggagtttaaccatgaacaaacttttcgttaccgccctgtccgccctcgccttgtccgcctgcgccggcacttggcagggcgcgaaacaagacaccgcccgcaaccttgacaaaacacaggccgccgccgaacgcgccgccgaacaaacaggcaacgccgtcgaaaaaggttgggacaaaaccaaagaagccgtcaaaaaaggcggcaatgccgtcggacgcggcatttcccatctcggcaaaaaaatcgaaaacgccaccgaa

SEQ ID NO: 4462 - protein, 107 aa, Neisseria gonorrhoeae
LTRPSEICPVRQKHLIFKPRSLTMNKLFVTALSALALSACAGTWQGAKQDTARNLDKTQAAAERAAEQTGNAVEKGWDKTKEAVKKGGNAVGRGISHLGKKIENATE

SEQ ID NO: 4463 - DNA, 1407 bp, Neisseria gonorrhoeae
atgacggcacaaaccctctacgacaaactctggaacagccacgtcgtccgcgaagaaggagacggcaccgtcctgctttacatcgaccgccatctggttcacgaagtaaccagcccgcaggcgtttgaaggtctgaaaatggcggggcgcaagctgtggcgcatcgacagcgtggtctccaccgccgaccacaacaccccgaccggcgattgggacaaaggcatccaagacccgatttccaagctgcaagtcgatacgttggatcaaaacatcaaagagtttggcgcactcgcctacttcccgtttatggacaaaggccagggcatcgtacacgttatggggcccgaacaaggcgcgaccctgcccgggatgaccgtcgtctgcggcgattcgcacacttccacccacggcgcattcggcgcactggcacacggcatcggcacttccgaagtcgaacacacgatggcgacccagtgcattaccgcgaaaaaatccaaatctatgctgattgccgctgacggcaaattaaaagcgggcgttaccgccaaagacgtggcgctctacatcatcgggcaaatcggcacggcgggcggcacgggttacgccgtcgagttcggcggcgaagccatccgcagcctttcgatggaaggcaggatgaccctgtgcaatatggcgattgaggcaggcgcgcgttccggtatggttgccgtcgatcaaaccaccatcgactatgtcaaaggcaagcccttcgcacccgaaggcgaagcttgggacaaagccgtcgagtactggcgcacgctggtgtctgacgaaggcgcggtttttgataaagaataccgtttcaacgccgaagacatcgaaccgcaagttacttggggcacgtcgcccgaaatggttttaaacatcggcggcaaagtgccgaatcccgccgaagaaaccgatccggtcaaacgcagcggcatagagcgcgcactcgaatatatgggtttgaaggccggtacgccgctgaacgaaatccctgtcgatatcgtctttatcggctcttgcaccaacagccgcatcgaagacttgcgcgaagccgctgctatcgccaaaggccataaaaaagccggcaacgtacagcgcgtgttaatcgtccccggctccggtttggttaaagaacaagccgaaaaagaaggcttggacaaaattttcatcgaagccggttttgaatggcgcgaaccgggctgttcgatgtgccttgcgatgaatgccgaccgcctcgcgccgaggcaacgctgcgcctccacgtccaaccgcaattttgaaggccgccaaggcaacggcgggcgcacccacctcgtcagccccgctatggccgccgccgccgccgttaccggacactttaccgacatccgcacgatggcg

SEQ ID NO: 4464 - protein, 469 aa, Neisseria gonorrhoeae
MTAQTLYDKLWNSHVVREEGDGTVLLYIDRHLVHEVTSPQAFEGLKMAGRKLWRIDSVVSTADHNTPTGDWDKGIQDPISKLQVDTLDQNIKEFGALAYFPFMDKGQGIVHVMGPEQGATLPGMTVVCGDSHTSTHGAFGALAHGIGTSEVEHTMATQCITAKKSKSMLIAADGKLKAGVTAKDVALYIIGQIGTAGGTGYAVEFGGEAIRSLSMEGRMTLCNMAIEAGARSGMVAVDQTTIDYVKGKPFAPEGEAWDKAVEYWRTLVSDEGAVFDKEYRFNAEDIEPQVTWGTSPEMVLNIGGKVPNPAEETDPVKRSGIERALEYMGLKAGTPLNEIPVDIVFIGSCTNSRIEDLREAAAIAKGHKKAGNVQRVLIVPGSGLVKEQAEKEGLDKIFIEAGFEWREPGCSMCLAMNADRLAPRQRCASTSNRNFEGRQGNGGRTHLVSPAMAAAAAVTGHFTDIRTMA

SEQ ID NO: 4465 - DNA, 165 bp, Neisseria gonorrhoeae
ttgttcatttcgttatatctaaagaatgattcgatacgaaagaatacttgtcgtcattctttcaaaagcattattatctgtaccttgtcaaaaaacacgcagaggcagacgaaagatgaaattaccggttatgtcgcccgaacattcggcgcaacttcaggcgtt

SEQ ID NO: 4466 - protein, 55 aa, Neisseria gonorrhoeae
LFISLYLKNDSIRKNTCRHSFKSIIICTLSKNTQRQTKDEITGYVARTFGATSGV

SEQ ID NO: 4467 - DNA, 1167 bp, Neisseria gonorrhoeae
atgaatttgtttccgggcggcttcaataatctgaatccgaatttcatcccgctggcggcggttgccgcgcaagatgcggtgcaacgcgcctgcgaaacggagaaatccgtattgattattcccgaaaaccacacgcgcaatacgttttacctgcaaaacgtttacgccctcggcgagattttccgttcggcagggtgtgaagtgcgcttgggcagcctgaatccggaagtaaccgaaccggccgaatttgaaactgcattgggcgacaaaatcctgcttgagcctttgctgcgaacccgcgaccgcgtccaccttgccgacggcttttcgccttgcgtggttttgttgaacaacgatttgtccgccggcattcccgacattctcaaaggcatcggccaaaccgttttgccgccgctgcacggcggttggacgacgcgccgcaaaacaaatcatttcggcgcgtacaaccaagttgccgccgaatttgccaagctgattgacatcgatgaatggcagatcaacccgtattttgaaaaaatcggcggtttggacttccaagggcgcgaaggtgaagatgcgctggcggaagcggtagaacgcgtgctggcgaaaattcaagccaaatacgacgaatcgggcattgccgacaaacctttcgtcatcgtcaaagccgatgccggcacttacggcatgggtgtgatgagcgtcaaatcctccgacgaagtgcgcggcttgaaccgcaaaaaccgcaacaaaatggcgaaggtgaaagagggcttggaagtcagcgaagtgattgtccaagaaggggtttatacctatgaaaccttgaacggcgcggtgtgcgaacccgtcgtctatatgatggaccgtttcgtcatcggcggctttttccgcgtacacgaagggcgcggtgcggacgaaaacctcaacgccggcggtatggtgtttgtgccgctgtccaacagcattcctaccggtaacggcgataattcgcaagaagctccagaagcctgcaaacgcgtattcgaacaatgggattcgctcggtatgccgcgttctgaaaaagactgcgacgtggacaacgaacataaccgcctctacgtttacggcgtaatggcacgtctgtcgcttttggcggcttcaatcgagttggaagaaacggcg

SEQ ID NO: 4468 - protein, 389 aa, Neisseria gonorrhoeae
MNLFPGGFNNLNPNFIPLAAVAAQDAVQRACETEKSVLIIPENHTRNTFYLQNVYALGEIFRSAGCEVRLGSLNPEVTEPAEFETALGDKILLEPLLRTRDRVHLADGFSPCVVLLNNDLSAGIPDILKGIGQTVLPPLHGGWTTRRKTNHFGAYNQVAAEFAKLIDIDEWQINPYFEKIGGLDFQGREGEDALAEAVERVLAKIQAKYDESGIADKPFVIVKADAGTYGMGVMSVKSSDEVRGLNRKNRNKMAKVKEGLEVSEVIVQEGVYTYETLNGAVCEPVVYMMDRFVIGGFFRVHEGRGADENLNAGGMVFVPLSNSIPTGNGDNSQEAPEACKRVFEQWDSLGMPRSEKDCDVDNEHNRLYVYGVMARLSLLAASIELEETA

SEQ ID NO: 4469 - DNA, 654 bp, Neisseria gonorrhoeae
ttgaaatacagatgccgtctgaagcggaaatccggttcagacggcatttcggatatttggcgtgtgggaacatctgtttcagacggcatctcagactatttaaaaaagggaaaacatgagcatcaagcaatggccggaaggcgaaaggcccagggaaaagctgttggaacgcggggcggcggctttgagcgatgccgaacttttggcaatccttttacgcgtcgggacgcgcgggatgagcgcggtcgatttggcgcgctacctattgcaggagttcggcagcttggggaggctgatgagcgcggaggtcggcaaactgtcggcatacaaagggatggggacggcaagtttcacacagttcgccgtggtcagggaaatcgggcggcggatattggaggaagaattgcaggaagaaattaccttatccgatcccgataccgttgccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattatcgcgcacaaccatccgggcggctcgcc

SEQ ID NO: 4470 - protein, 218 aa, Neisseria gonorrhoeae
LKYRCRLKRKSGSDGISDIWRVGTSVSDGISDYLKKGKHEHQAMAGRRKAQGKAVGTRGGGFERCRTFGNPFTRRDARDERGRFGALPIAGVRQLGEADERGGRQTVGIQRDGDGKFHTVRRGQGNRAADIGGRIAGRNYLIRSRYRCRLFTLSFGAGKSRSQRRAAAEPPKPTDCGQRAVARYGCGKHDLHPRNRQTGIGRICRQPDYRAQPSGRLA

SEQ ID NO: 4471 - DNA, 675 bp, Neisseria gonorrhoeae
atgagcatcaagcaatggccggaaggcgaaaggcccagggaaaagctgttggaacgcggggcggcggctttgagcgatgccgaacttttggcaatccttttacgcgtcgggacgcgcgggatgagcgcggtcgatttggcgcgctacctattgcaggagttcggcagcttggggaggctgatgagcgcggaggtcggcaaactgtcggcatacaaagggatggggacggcaagtttcacacagttcgccgtggtcagggaaatcgggcggcggatattggaggaagaattgcaggaagaaattaccttatccgatcccgataccgttgccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattatcgcgcacaaccatccgggcggctcgcctgaaccttcgcaggaagacatcatgttcacaaggcggctggcacaggccatgtcgctggttgatgtttcgctgctcgaccattttatcgttacctcgcaaaccgtccgttcgttcaggcagctcgggctgatgccc

SEQ ID NO: 4472 - protein, 225 aa, Neisseria gonorrhoeae
MSIKQWPEGERPREKLLERGAAALSDAELLAILLRVGTRGMSAVDLARYLLQEFGSLGRLMSAEVGKLSAYKGMGTASFTQFAVVREIGRRILEEELQEEITLSDPDTVADYLRFHLGQEKVEVSVALLLNRQNQLIAVRELSRGTVAENTIYIREIVKLALDEYADSLIIAHNHPGGSPEPSQEDIMFTRRLAQAMSLVDVSLLDHFIVTSQTVRSFRQLGLMP

SEQ ID NO: 4473 - DNA, 723 bp, Neisseria gonorrhoeae
atggaaacacaaaacaaacctaccgttaccgacattgaccgccccatactcgtcccgcccggcggacataaaaaagtcttgctgcattcctgctgcgccccgtgcagcggcgaagtgatggaagccatgcttgcctccggcatcggctacaccatttatttttacaatcccaatatccatccgcacaaagagtatatgctccgaaaagaggaaaacatgcgctttgcggaaaagttcggcatccctttcatcgataaagacgacgactacgaaaacgaccgcaaagaatggtttgccaaagccaaaggcatggagtttgagccggaacgcggcatccgctgcaccatgtgtttcgatatgcgttttgaaaaagcggcgcaatacgcgcacgaacacggttttcccgtctttaccagttcgctgggcatttcacgctggaaaaatatggcgcaaatcaacgactgcggacaccgtgccgccgcgccttacgatgatgtggcctattgggacttcaactggcgcaaaggcggcggcggcgcgcgtatgattgaaatcagcaaacgcgaaaacttctaccagcaggaatactgcggctgcgcctattccttgcgcgattccaacgcccaccgcaaatcgcagggacgcatccccgtcaaactcggcgtgctgtattacggcgacgaatcgacacaatacgaacctgcacccgtccgagtggacaaa

SEQ ID NO: 4474 - protein, 241 aa, Neisseria gonorrhoeae
METQNKPTVTDIDRPILVPPGGHKKVLLHSCCAPCSGEVMEAMLASGIGYTIYFYNPNIHPHKEYMLRKEENMRFAEKFGIPFIDKDDDYENDRKEWFAKAKGMEFEPERGIRCTMCFDMRFEKAAQYAHEHGFPVFTSSLGISRWKNMAQINDCGHRAAAPYDDVAYWDFNWRKGGGGARMIEISKRENFYQQEYCGCAYSLRDSNAHRKSQGRIPVKLGVLYYGDESTQYEPAPVRVDK

SEQ ID NO: 4475 - DNA, 1161 bp, Neisseria gonorrhoeae; identical to SEQ ID NO: 49

SEQ ID NO: 4476 - protein, 387 aa, Neisseria gonorrhoeae; identical to SEQ ID NO: 50

SEQ ID NO: 4477 - DNA, 270 bp, Neisseria gonorrhoeae
atggcaagtaaaaaagcaggcggcagcacccgcaacggtcgcgattcagaagccaaacgcttgggcgttaaagcctacggcaacgagctgattcccgcaggttccatcatcgtacgccaacgcggtaccaaattccacgcaggcgacaacgtaggtatgggcaaagaccacactttgttcgccaaaattgacggttatgtcgaattcaaaaccaaaggcgcgctgaaccgtaaaactgtcagcatccgtccttacaccggttctgaagaa

SEQ ID NO: 4478 - protein, 90 aa, Neisseria gonorrhoeae
MASKKAGGSTRNGRDSEAKRLGVKAYGNELIPAGSIIVRQRGTKFHAGDNVGMGKDHTLFAKIDGYVEFKTKGALNRKTVSIRPYTGSEE

SEQ ID NO: 4479 - DNA, 1245 bp, Neisseria gonorrhoeae
atgcaacttaccgctgtcggactcaatcatcaaaccgcacctttaagcatacgggaaaagctggcgtttgccgccgccgccctgccagaagccgtccgcaatcttgcccgaagcaatgcggcaacggaggcggtaatcctttctacctgcaaccgcaccgagctttactgcgtcggcgattcggaagaaatcatccgatggcttgccgattaccacagtttgccgattgaagaaatccgtccgtatctgtacacgctggatatgcaggaaaccgtgcgccacgccttccgcgttgcctgcggcttggattcgatggttttgggcgagccgcagattttggggcagattaaagatgcggtgcgtgcggctcaagaacaggaaagtatgggggcaaaactcaatgccctgttccaaaaaaccttttccgttgctaaagaagtccgtaccgataccgctgtcggcgaaaattcggtttcgatggcttccgcgtccgtcaagttggcggaacagatttttcccgacatcggcgatttgaacgtattgtttatcggcgcaggcgaaatgattgagctggttgccacttattttgccgccaaaaatccccggctgatgacggttgccaaccggacgctggcgcgtgcacaggagttgtgcgacaagctcggtgttaacgccgaaccgtgcctgctgtccgatctgcctgccattctgcacgattacgacgtggtggtttcttcaacggcgagccagcttccgatagtcggcaaaggcatggtcgaacgcgcattgaaacagcgtcagagtatgccgttgttcatgcttgacttggccgtgccgcgcgatattgaagcggaagtcggcgatttgaacgatgcgtatctttatacggtggacgatatggtcaacatcgtccaaagcggcaaggaggcaaggcagaaggccgccgccgccgccgaaacgctggtgtccgaaaaggttgccgaatttgtcaggcagcagcagggcaggcagagcgttccgctgattaaggccttgcgggacgagggcgagaaagcgcgcaagcaggtgttggaaaatgcgatgaaacagcttgccaaaggcgcaacggcggaagaggttttggaacggctgtccgtccaactgaccaacaagctgctgcattcgccaactcaaaccttgaataaggcgggggaagaagataaagatttggttcatgccgtcgcgcagatttatcatttggacaaa

SEQ ID NO: 4480 - protein, 415 aa, Neisseria gonorrhoeae
MQLTAVGLNHQTAPLSIREKLAFAAAALPEAVRNLARSNAATEAVILSTCNRTELYCVGDSEEIIRWLADYHSLPIEEIRPYLYTLDMQETVRHAFRVACGLDSMVLGEPQILGQIKDAVRAAQEQESMGAKLNALFQKTFSVAKEVRTDTAVGENSVSMASASVKLAEQIFPDIGDLNVLFIGAGEMIELVATYFAAKNPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 4481 - DNA, 1302 bp, Neisseria gonorrhoeae
ttgccgcgtcgggagggcggcattatgaaatccctttttatttggctgcttctattgggctcggcggcaggcgttttctaccatacccaaaaccaatccctgcccgcgggcgaacttgtctatccgtccgcaccgcaaatcagggacggcggcgatgcgctgcactacctcaaccgcatccgcacacaaatcggtttgcacgcgctggcacacgcgccggttttggaaaattccgcccgcaggcacgcacgctatctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaggaagccgccgaatcgtccgacagcgacatccgcacgcagcaacgccaagtggacgctttgatgagcgcaatctaccaccgcctttcgctgcttgaccgccataccgacgaagcaggtgcggcatttgtgcgcgaaaacggcaaaaccgtcctcgtattcaatcagggcaacggcagcttcgagcgcgcctgtgcaaaaggaaggcggcagccggaagcaggacggaaatattaccgcaacgcttgccacaacggtgcggccgtttatgctgacgaagccatgcccgtaacggaattgctttataccgcctatccggttggcggcggcgcgctgccttatttttacggggaacgtcccgaccccgtgccggaatatgaaatcacaggcaatcctgccagcattgatttttccgaggcggcaggcaaaattgcgatgaaaagtttcaagctgtatcagggtaaaaacgaaatccgccccgtcagggttttaaccgccggcaacgaccctaacggcaggctgaccgcgcaccaattcgcccttttcccgctcaaacctttggaatacggcacgctttatacggcggtattcgactatgtccgcaacggacggcacgcgcaggcgaaatggcagtttagaacccgaaaacccgattacccttattttgaggtaaacggcggcgagacacttgcggttagaaaaggcgaaaaatatttcatccactggcgcggacgctggtgtctggaagcgtgtacccgttatacctaccggcggcagttcggcaacagcctgtccatactccggcacgaagcgggcggcattgtcttcagcgtcagcggaatggcgggaagccgcatcaggcttactccggaagacagcccggaacgcggtgtaaccctttatttgcaggat

SEQ ID NO: 4482 - protein, 434 aa, Neisseria gonorrhoeae
LPRREGGIMKSLFIWLLLLGSAAGVFYHTQNQSLPAGELVYPSAPQIRDGGDALHYLNRIRTQIGLHALAHAPVLENSARRHARYLTLNPEDGHGEHHPDNPHYTAQKLTERTRLAGYLYNGVHENISTEEEAAESSDSDIRTQQRQVDALMSAIYHRLSLLDRHTDEAGAAFVRENGKTVLVFNQGNGSFERACAKGRRQPEAGRKYYRNACHNGAAVYADEAMPVTELLYTAYPVGGGALPYFYGERPDPVPEYEITGNPASIDFSEAAGKIAMKSFKLYQGKNEIRPVRVLTAGNDPNGRLTAHQFALFPLKPLEYGTLYTAVFDYVRNGRHAQAKWQFRTRKPDYPYFEVNGGETLAVRKGEKYFIHWRGRWCLEACTRYTYRRQFGNSLSILRHEAGGIVFSVSGMAGSRIRLTPEDSPERGVTLYLQD

SEQ ID NO: 4483 - DNA, 1185 bp, Neisseria gonorrhoeae
ttgacagttatgtcaggtagaacaggacggaacagtgccactcaggcgcaaccggaacgcgtcatgctggtgggcgtaatgttggataaagatgatacgggcagcaatgccgcccgtctgaacggttttcagacggcattggcggaagccgtcgagctggtcaaagcggcgggcggcgattccgtacgcgtggagactgccaaacgcgaccgcccgcacactgcgctgtttgtcggcacgggcaaggcggcggagctgtcggaagcagttgccgcagacggcattgatttggtcgtattcaaccacgaacttactcccacgcaggaacgcaatttggaaaaaatcctccaatgccgcgtattggacagagtggggctgattctggcgattttcgcccgccgcgcccgcacgcaggaaggcaggctgcaagtcgagttggcgcaattgagccatttggcgggacgcttgatacgcggttacggacatttgcaaagccagcgcggcggtatcggcatgaaagggccgggcgaaaccaaactggaaaccgaccgccgattaaccgcccatcggatcaacgccttgaaaaaacagcttgccaacctcaaaaaacagcgcgccctgcgccgcaagtcccgcgagtcgggcagaatcaaaacgtttgcgctggtcggctataccaatgtcggcaaatccagcctgttcaaccggctgaccaagtcgggcatatatgcgaaagaccagcttttcgccactctcgacacgacggcgcggcggctgtacatcagtcccgcatgcagcattatcctgaccgataccgtcggattcgtcagcgatctgccgcacaaactgatttccgccttttccgccaccttggaagaaaccgtgcaagccgatgtgctgctgcacgtcgtcgatgctgccgcccggaacagcgggcagcagattgaagacgtggaaaacgtactgcaagaaatccatgcccacgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtattgtgccgccgcaccaaacacagacgaaaccgaaatgcca

SEQ ID NO: 4484 - protein, 395 aa, Neisseria gonorrhoeae
LTVMSGRTGRNSATQAQPERVMLVGVMLDKDDTGSNAARLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLTAHRINALKKQLANLKKQRALRRKSRESGRIKTFALVGYTNVGKSSLFNRLTKSGIYAKDQLFATLDTTARRLYISPACSIILTDTVGFVSDLPHKLISAFSATLEETVQADVLLHVVDAAARNSGQQIEDVENVLQEIHAHDIPCIKVYNKTDLLPSEEQNTGIWRDAAGKIAAVRISVAENTGIDALREAIAEYCAAAPNTDETEMP

SEQ ID NO: 4485 - DNA, 2493 bp, Neisseria gonorrhoeae
ttgtgccgccgcaccaaacacagacgaaaccgaaatgccatgaaaaaaacctgtttccactgcgggctggacgttcccgaaaacctgcatctgaccgtccgctacgaaggcgaagaccgcgaaacctgctgcgtcggctgtcaggcagtcgcacaaagcatcatcgattccggcttgggcagttattacaaacgacgcaccgccgacgcgaaaaaaaccgaactgccgccccaagaaatcctcgaccaaatccgcctgtacgacctgcccgaagtccaatccgactttgtggaaacccataatggcacgcacgaagcagtgctgatgctcagcggcattacctgcgccgcctgcgtctggctgatcgaacagcagcttttgcgcacagacggcatcgtccgcatcgacctcaattacagcacgcaccgctgccgcgtcgtctgggacgacggcaaaatccgcctctccgacattctgttgaaaatccggcagacaggctacaccgccgcaccctatgacgcgcaaaaaatcgaagccgccaaccaaaaagaacgcaaacaatacatcgtccgccttgccgttgccggactgggtatgatgcagacgatgatgttcgcgctgccgacctacctttacggcggcgacatcgaacccgatttcctgcagatcctccattggggcggcttcctgatggtgctgcccgtcgtattttattgcgccgtcccgttttatcaaggcgcgttgcgcgacctgaaaaaccgccgcgccggtatggacacgccgattgccgccgccatcatcatgaccttcatcgccggcatttacagcctcgccaccaacgcagggcaggggatgtatttcgaatccatcgcgatgctgctgtttttcctgctgggcggacgctttatggaacacattgcccgacgcaaggcaggcgatgccgccgaaaggctggtgaaactgatacccgccttctgccaccggatgcccggctatcctgccgtacaggatgtccgcgaatccgccgtcgtcaaactccaagcaggcgatattgtgatggtcaaacccggcgaaaccatccccgttgacggcacggtgctggaaggaaacagtgccgtcaacgaatctatgctgaccggcgagagcctgcccgtcgccaaaatgccgtctgaaaaagtaaccgcaggtacactcaacacgcaaagccctctgattatacgcaccgaccgcaccggcggcggcacgcgcctgtcgcacatcgtccgcctgctcgaccgcgccttggcgcaaaaaccgcgcactgccgagttggcggaacaatacgcctcatctttcatattcggcgagctcctgcttgccgtcccggtcttcatcggttggacgctgtacgccgacgcgcacaccgcattgtggattaccgtcgccctgctggtcattacctgcccctgcgccctgtcgcttgccacgccgaccgcgctggcagcttctaccggtacgctggcgcgcgaaggtattttaatcggcggaaagcaggcaatcgaaaccctctcccaaaccaccgacatcattttcgacaaaaccggcacgctgacccaaggcaatcccgccgtccgccggattgaactgctcggcagcatgaccgaagcccaagtgctggcagtggcgcaaagtttggaacagcagtcagaacacccgctcgcgcgcgccatcctcaactgccgcatttcaggcggcagcgtccccgaaatccaagtcggacaacgcctcaaccgcatcggggaaggcgtgggtgcgcaactgaccgtcaacggcgaaacacaggtttgggcattggggagggcatcctatgttgccgaaatttcaggtaaagaaccgcaaacagaaggcggcggcagcgcggtttacctcggcagtcaaagcggtttccaagccgtgttctacctgcaagacccgctcaaagacagcgcggcggaggcagtgcggcagttggcaggcaaaaacctgacgctgcacatcctcagtggcgaccgtgaagaagcagttgctgaaaccgcccgtgccttgggtatcgcgcactaccgcgcccaagcaatgccggaagacaagctggaatacgtcgaagccttgcaaaaagaagggaaaaaagtgctgatgataggcgacggcatcaacgacgcgcccgttttggcgcaggcagacgtatccgccgccgcagtcggcgggacggatattgcgagggacggcgcagacattgtgttattgaacgaagatttgcgtaccgtcgcccacctgctcgatcaggcgcggcgcacccgccatatcatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacggggggaaatgccgtccgaacaa

SEQ ID NO: 4486 - protein, 831 aa, Neisseria gonorrhoeae
LCRRTKHRRNRNAMKKTCFHCGLDVPENLHLTVRYEGEDRETCCVGCQAVAQSIIDSGLGSYYKRRTADAKKTELPPQEILDQIRLYDLPEVQSDFVETHNGTHEAVLMLSGITCAACVWLIEQQLLRTDGIVRIDLNYSTHRCRVVWDDGKIRLSDILLKIRQTGYTAAPYDAQKIEAANQKERKQYIVRLAVAGLGMMQTMMFALPTYLYGGDIEPDFLQILHWGGFLMVLPVVFYCAVPFYQGALRDLKNRRAGMDTPIAAAIIMTFIAGIYSLATNAGQGMYFESIAMLLFFLLGGRFMEHIARRKAGDAAERLVKLIPAFCHRMPGYPAVQDVRESAVVKLQAGDIVMVKPGETIPVDGTVLEGNSAVNESMLTGESLPVAKMPSEKVTAGTLNTQSPLIIRTDRTGGGTRLSHIVRLLDRALAQKPRTAELAEQYASSFIFGELLLAVPVFIGWTLYADAHTALWITVALLVITCPCALSLATPTALAASTGTLAREGILIGGKQAIETLSQTTDIIFDKTGTLTQGNPAVRRIELLGSMTEAQVLAVAQSLEQQSEHPLARAILNCRISGGSVPEIQVGQRLNRIGEGVGAQLTVNGETQVWALGRASYVAEISGKEPQTEGGGSAVYLGSQSGFQAVFYLQDPLKDSAAEAVRQLAGKNLTLHILSGDREEAVAETARALGIAHYRAQAMPEDKLEYVEALQKEGKKVLMIGDGINDAPVLAQADVSAAAVGGTDIARDGADIVLLNEDLRTVAHLLDQARRTRHIIRQNLIWAGAYNIIAVPLAVLGYVQPWIAALGMSFSSLAVLGNALRLHKRGEMPSEQ

SEQ ID NO: 4487 - DNA, 159 bp, Neisseria gonorrhoeae
ttgatatataagaaaaattgtcacaataagaaaagttatgcagaaaataaaatgaaaaggatggttttcattgaaaatggttgttctgccaccgtcatacacagagccagtatttggaaaaaaataatccatattgacataattattccatttgtcgca

SEQ ID NO: 4488 - protein, 53 aa, Neisseria gonorrhoeae
LIYKKNCHNKKSYAENKMKRMVFIENGCSATVIHRASIWKKIIHIDIIIPFVA

SEQ ID NO: 4489 - DNA, 465 bp, Neisseria gonorrhoeae
atgccgtctgaaggtgcagtttccgtttgtccgacggttgccgtcggacaaacgggcggtttaatccacttcgcccgcgtattgttcggcagtcagcaggccgtcgtaatcggcaggattggcaggtttgattttgaagaaccagcctgcgccgtaagggtcgctgttggcggtttccggcgcgcctggcaagtcatcgttgacggcaacgacttcgcccgcaatcggcgcatacacgtcggatgcggcttttacagactcaaccacaccggactgttcttcggcggcgaggttcgcaccgacttcgggcagctcgacaaacacgatgtcgcccaacagctcttgcgcgtgatgggtaataccgacggtaatggtaccgtcttcttcaaggcgcagccattcatggctggcaacgtatttcagttctgttgggatgttgttgctcatggtttgattctccattgg

SEQ ID NO: 4490 - protein, 155 aa, Neisseria gonorrhoeae
MPSEGAVSVCPTVAVGQTGGLIHFARVLFGSQQAVVIGRIGRFDFEEPACAVRVAVGGFRRAWQVIVDGNDFARNRRIHVGCGFYRLNHTGLFFGGEVRTDFGQLDKHDVAQQLLRVMGNTDGNGTVFFKAQPFMAGNVFQFCWDVVAHGLILHW

SEQ ID NO: 4491 - DNA, 297 bp, Neisseria gonorrhoeae
gtgtatcaaatcgggtatggggtatgtaaaaagccgcatcgtgaaaagatgcggcttcaggtatcggttgaattattcttcagaaccggtgtaaggacggatgctgacagttttacggttcagcgcgcctttggttttgaattcgacataaccgtcaattttggcgaacaaagtgtggtctttgcccatacctacgttgtcgcctgcgtggaatttggtaccgcgttggcgtacgatgatggaacctgcgggaatcagctcgttgccgtaggctttaacgcccaagcgtttggcttc

SEQ ID NO: 4492 - protein, 99 aa, Neisseria gonorrhoeae
VYQIGYGVCKKPHREKMRLQVSVELFFRTGVRTDADSFTVQRAFGFEFDITVNFGEQSVVFAHTYVVACVEFGTALAYDDGTCGNQLVAVGFNAQAFGF

SEQ ID NO: 4493 - DNA, 183 bp, Neisseria gonorrhoeae
gtggatttatgcgacaaatggaataattatgtcaatatggattatttttttccaaatactggctctgtgtatgacggtggcagaacaaccattttcaatgaaaaccatccttttcattttattttctgcataacttttcttattgtgacaatttttcttatatatcaatcacataatgataat

SEQ ID NO: 4494 - protein, 61 aa, Neisseria gonorrhoeae
VDLCDKWNNYVNMDYFFPNTGSVYDGGRTTIFNENHPFHFIFCITFLIVTIFLIYQSHNDN

SEQ ID NO: 4495 - DNA, 159 bp, Neisseria gonorrhoeae
ttggaaataaaagagaaaccaagcatatggattcctacctacgcgggaatgacgacggtgttttgccgtagccaaagcagaaaaacatccctattgtcattttatcatgataggacagcaaggatgttaaaaattaattatcattatgtgattgatata

SEQ ID NO: 4496 - protein, 53 aa, Neisseria gonorrhoeae
LEIKEKPSIWIPTYAGMTTVFCRSQSRKTSLLSFYHDRTARMLKINYHYVIDI

SEQ ID NO: 4497 - DNA, 102 bp, Neisseria gonorrhoeae
ttgagcgcgcatttgtggatcaataagccgcttgaaatgccgtctgaacggcatcagcaatcaaaaaccccgaatcttgccaatcaggattcggggttttta

SEQ ID NO: 4498 - protein, 34 aa, Neisseria gonorrhoeae
LSAHLWINKPLEMPSERHQQSKTPNLANQDSGFL

SEQ ID NO: 4499 - DNA, 747 bp, Neisseria gonorrhoeae
ttgtccgtacaccactggacagacgcatattttacctttacctgcatccgcgacgaatcgttgcgctttgaaaacggacagttcgtcatggtcgggctgatggcggacggcaagccgctgatgcgcgcatacagcgtcgcctccgccaactgggaagaacacctcgaatttttcagcattaaagtccaagacggcccgctgaccagccgcctgcaacacctcaaagtcggcgacgaagtgttaatcagcaaaaaaccgaccggaactctggttgccggcgacctgaatccgggcaaacacctttacttgttgagcaccggtaccggcatcgcccctttcttgagcatcaccaaagaccccgagatttacgagcaatttgaaaaaatcatcctcgtacacggcgtgcgctacaaaaaagatttggcgtactacgaccgctttaccaaagaattgcccgaacacgaatacctcggcgacttggttaaagaaaaactgatttactacccgattgtttcccgagaagaattcgaacaccgcggccgcctgaccgacctgatggtaagcggcaaactgtttgaagacatcggcctgcccaaaatcaacccgcaagacgaccgcgcgatgctgtgcggcagccccgcgatgctgaaagatacctgcaaagttttggacgatttcggtctgacagtctccccgaaaaccggcgtgcgcggcgactacctgattgagcgcgcatttgtggatcaa

SEQ ID NO: 4500 - protein, 249 aa, Neisseria gonorrhoeae
LSVHHWTDAYFTFTCIRDESLRFENGQFVMVGLMADGKPLMRAYSVASANWEEHLEFFSIKVQDGPLTSRLQHLKVGDEVLISKKPTGTLVAGDLNPGKHLYLLSTGTGIAPFLSITKDPEIYEQFEKIILVHGVRYKKDLAYYDRFTKELPEHEYLGDLVKEKLIYYPIVSREEFEHRGRLTDLMVSGKLFEDIGLPKINPQDDRAMLCGSPAMLKDTCKVLDDFGLTVSPKTGVRGDYLIERAFVDQ

SEQ ID NO: 4501 - DNA, 123 bp, Neisseria gonorrhoeae
gtggtgtacggacaatactttttgggtattgaatgctgccatttgggtttcctgtcagtaaaagaaatggatagtgcttgttcgggacgtgcggcagagtggaaatgtctgcccgattcggga

SEQ ID NO: 4502 - protein, 41 aa, Neisseria gonorrhoeae
VVYGQYFLGIECCHLGFLSVKEMDSACSGRAAEWKCLPDSG

SEQ ID NO: 4503 - DNA, 792 bp, Neisseria gonorrhoeae
atgaccttacctatgcaggaaacccgtttttctatactgctggacgaattggcggcaaaacaggaggcaaccatcgccccctacctgcttgccgacgggaccaaggtatgggtacgcaaagcaggcaggcacaatgcgcgatggcgttacgcgctgctcggtatggttgcccgatatttgaaactgggggtgttgaagccggttcccagcctcggcggcgagcctgccattgcaaccgaatcaaaacgcctgtacgaattgcgttcggcagggatagccgttcccgaattgctcgccctccggaaaaatgcccttatgttcggcaatttggaaggcatcccgctcgatacgcaaatccgccaagaagccgaagccggaaaggcggacgcttggcttgccggtttggaagccattgcacgcgtgcataaaaaacggcagttcctcagtcaggcgtttgcacgaaatatgatgtgggacggaaaaaacatcagctttttggattttgaagacgacccttccgaggtcctgaccatagcgcaatgccaagcccgcgattggctctgctacatccattcgaccgcgctgatattgaaaaacggcggactgctggaagcggctgcggaaaaatggggcggcgtattgtcggatcagcctgccgaaatacaaaagctgattgccggcaccgtcaaaccgattctcccgatacgcaggctggaacacccccgctggggacgggacgcgctcaggctggcagcctcgatttccttaatttccctcgccgatatgccgccg

SEQ ID NO: 4504 - protein, 264 aa, Neisseria gonorrhoeae
MTLPMQETRFSILLDELAAKQEATIAPYLLADGTKVWVRKAGRHNARWRYALLGMVARYLKLGVLKPVPSLGGEPAIATESKRLYELRSAGIAVPELLALRKNALMFGNLEGIPLDTQIRQEAEAGKADAWLAGLEAIARVHKKRQFLSQAFARNMMWDGKNISFLDFEDDPSEVLTIAQCQARDWLCYIHSTALILKNGGLLEAAAEKWGGVLSDQPAEIQKLIAGTVKPILPIRRLEHPRWGRDALRLAASISLISLADMPP

SEQ ID NO: 4505 - DNA, 153 bp, Neisseria gonorrhoeae
ttgtcgtcattcccgcgcaggcgggaatccagacttgtcggcacagaaacttatcgggtaaaacggtttcttcaattttatgttccggattcccgcctgcgcggggataacgattcaggtatttctacatcgaatccgctttttatatcaacc

SEQ ID NO: 4506 - protein, 51 aa, Neisseria gonorrhoeae
LSSFPRRRESRLVGTETYRVKRFLQFYVPDSRLRGDNDSGISTSNPLFIST

SEQ ID NO: 4507 - DNA, 1353 bp, Neisseria gonorrhoeae
ttgatacacattaagctgaaagtaaaaatccgcatacaccctcccctgcatatttcttcaacaacgggttttgatataatcgcctatctgttacagatagttcaaacggcattcaaacccttacaaatgccgtctgaaatcatcggcatccgcctatgcaaaggatattttatgagtttacacagcgacatcctcgtcgtcggcgcaggcccggcgggtttaagttttgcagccgaacttgccggcagcggtttgaaagttactctgatcgaacgcagcccactgactgttctgcaaaatcctccctatgacggacgcgaaatcgccctgacccatttttcccgcgaaatcatgcagcgtttgggtatgtgggacaaaattcccgaaaacgaaatctaccccttgcgcgatgccaaagtgctgaacggacgttccgactaccagctccactttccccaaccgactgaagcgcgcggcgagcctgccgactgtttgggctatctgatttccaaccacaatatccgccgcgccgcctatgaagtcgtatcacaactcgacaatgtcagcattctgaccgatacggccgttaaagaagtcaaaacatctgataatgaagcgcaagtctttttggaaaatggagacattctaaccgcgcgtctccttttggcagcagacagccgtttctcacaaacccgccgacaactcggtatttcttcagatatgcacgactacagccgaaccatgttcgtctgccgcatgaaacataccctttccaaccaacataccgcttacgaatgcttccattacggacgcaccatcgcactgctgccactggaaaagcgcctgaccaataccgtcattacagtcgataccgataaaatcaacagcgttcaaaacctttcgcccgaagaattggcggcaagcgtaaaagaacagctcaagggcaggctcggcgacatggaactggtcagcagcatccaccattacccccttgtcggcatgattgccaaacgtttctacggcaaacgcagcgcgctgatcggcgatgcggctgtcggtatgcaccccgtaacggcacacggcttcaacctcgggctttccagcgcggatattctggcaaaactgatactcgaagccgaacagcgcggtcaagacatcggcgcggcttccttgttggaaaaatacagcagcaaacatatgctgcacgcccatccgctttatcacggcaccaatatgatgctgaaactgtttaccaacgaaaccgcgccggcaaaactgttgcgcggtttggtattacgagccggcaacaacttcccgccgctgaaaaagctgattaccaaacaactgaccggt

SEQ ID NO: 4508 - protein, 451 aa, Neisseria gonorrhoeae
LIHIKLKVKIRIHPPLHISSTTGFDIIAYLLQIVQTAFKPLQMPSEIIGIRLCKGYFMSLHSDILVVGAGPAGLSFAAELAGSGLKVTLIERSPLTVLQNPPYDGREIALTHFSREIMQRLGMWDKIPENEIYPLRDAKVLNGRSDYQLHFPQPTEARGEPADCLGYLISNHNIRRAAYEVVSQLDNVSILTDTAVKEVKTSDNEAQVFLENGDILTARLLLAADSRFSQTRRQLGISSDMHDYSRTMFVCRMKHTLSNQHTAYECFHYGRTIALLPLEKRLTNTVITVDTDKINSVQNLSPEELAASVKEQLKGRLGDMELVSSIHHYPLVGMIAKRFYGKRSALIGDAAVGMHPVTAHGFNLGLSSADILAKLILEAEQRGQDIGAASLLEKYSSKHMLHAHPLYHGTNMMLKLFTNETAPAKLLRGLVLRAGNNFPPLKKLITKQLTG

SEQ ID NO: 4509 - DNA, 432 bp, Neisseria gonorrhoeae
gtgcagatgccgtctgaaaataaccccctaccaatggagaatcaaaccatgagcaacaacatcccaacagaactgaaatacgttgccagccatgaatggctgcgccttgaagaagacggtaccattaccgtcggtattacccatcacgcgcaagagctgttgggcgacatcgtgtttgtcgagctgcccgaagtcggtgcgaacctcgccgccgaagaacagtccggtgtggttgagtctgtaaaagccgcatccgacgtgtatgcgccgattgcgggcgaagtcgttgccgtcaacgatgacttgccaggcgcgccggaaaccgccaacagcgacccttacggcgcaggctggttcttcaaaatcaaacctgccaatcctgccgattacgacggcctgctgactgccgaacaatacgcgggcgaagtggat

SEQ ID NO: 4510 - protein, 144 aa, Neisseria gonorrhoeae
VQMPSENNPLPMENQTMSNNIPTELKYVASHEWLRLEEDGTITVGITHHAQELLGDIVFVELPEVGANLAAEEQSGVVESVKAASDVYAPIAGEVVAVNDDLPGAPETANSDPYGAGWFFKIKPANPADYDGLLTAEQYAGEVD

SEQ ID NO: 4511 - DNA, 1455 bp, Neisseria gonorrhoeae
atgccgtctgaatccgttttcctgcaatttcgacaaacgagaaaaatcatgagatacatcagcacgcgcggcgaaaccgcacacaaaccgttcagcgaagttttattgatggggcttgcacccgacggcggactgatgctgccggaacattatccgcaaatcgggcgcgaaaccttggacaaatggcgcggtttggcttatcccgaattggcgtttgaaatcatgtgcctgttcgttaccgatattccggaggacgatttgcgcgacattctgaaccgtacttacacggaagcggcgttcggtactaaggaaatcacccccgtccgcacgctttcagacggcatcaaaatccaagccttgtccaacggcccgacgctggcgttcaaagatatggcgatgcagtttttgggcaatgcgtttgaatatgttttaaacaaagaaggcaaaaaactcaatatcttgggcgcaaccagcggcgatacgggttcggctgcggaatatgccttgcgcggcaaaaaaggcgtgaacgtatttatgttgtcgcccgacggtaaaatgagcgcgttccaacgcgcgcagatgtacagcctgcaagacgggaatatccacaatatcgccgtgaaggggatgtttgacgactgccaggacattgtgaaggcagtgcagaacgatgccgcgttcaaggaaaaataccatatcggtacggtcaattcgatcaactgggggcgcatcgtcgcgcaagtggtttattactttgcaggctatttcaatgccacttcaagcaatgacgaaaccgtcagcttttgcgtaccgagcggcaacttcggcaacgtttgcgcgggacacatcgccaaacaaatgggcctgcctgtccgctgcctgattgtcgcgaccaatgaaaacgatgtgctggacgagtttttcaaaaccggcgcataccgcccgcgcaacagcgcgcatacttatgtaacctccagcccgtctatggacatttccaaagcgtccaacttcgagcgtttcgtgttcgacctgatggatcgcgatcctcaggaaatcaatacgctgtgggcggaagtcgcggcaggcaaaggctttgacctgcggtttgccttggacaaagtcggcggcaaatacggctttacctccggcaaatctacccacgccgaccgcctcgccaccatcagacaggtttacgagcaagacaaagaactcatcgacccgcatactgccaacggcgtaaaagtcgcccgcgaagtgcgcgaagcgggggaaacggtggtttgtttggaaaccgcgttggcggcgaaattcgatgcgaccatacgcgaagccgtcggcgatgtcgccattccgcgccccgccgcgctggaaggtttggaaaacctgccgcagcgcgtgcaaaccgtgccgaacagtgcggatgcggtaaaaggcatcatcgaacaaacccttgcc

SEQ ID NO: 4512 - protein, 485 aa, Neisseria gonorrhoeae
MPSESVFLQFRQTRKIMRYISTRGETAHKPFSEVLLMGLAPDGGLMLPEHYPQIGRETLDKWRGLAYPELAFEIMCLFVTDIPEDDLRDILNRTYTEAAFGTKEITPVRTLSDGIKIQALSNGPTLAFKDMAMQFLGNAFEYVLNKEGKKLNILGATSGDTGSAAEYALRGKKGVNVFMLSPDGKMSAFQRAQMYSLQDGNIHNIAVKGMFDDCQDIVKAVQNDAAFKEKYHIGTVNSINWGRIVAQVVYYFAGYFNATSSNDETVSFCVPSGNFGNVCAGHIAKQMGLPVRCLIVATNENDVLDEFFKTGAYRPRNSAHTYVTSSPSMDISKASNFERFVFDLMDRDPQEINTLWAEVAAGKGFDLRFALDKVGGKYGFTSGKSTHADRLATIRQVYEQDKELIDPHTANGVKVAREVREAGETVVCLETALAAKFDATIREAVGDVAIPRPAALEGLENLPQRVQTVPNSADAVKGIIEQTLA

SEQ ID NO: 4513 - DNA, 516 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgc

SEQ ID NO: 4514 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 4515 - DNA, 165 bp, Neisseria gonorrhoeae
gtgtggcgatgggtgcggtcgggatgctgcccggtatccctccgtttttggagcagttcaaatctttgggctaggctgaaatcgcaaatgccgtctgaaccggtttcagacggcatttttgcaaacaggcaaaatgacggcggcgggattttttattttcccgat

SEQ ID NO: 4516 - protein, 55 aa, Neisseria gonorrhoeae
VWRWVRSGCCPVSLRFWSSSNLWARLKSQMPSEPVSDGIFANRQNDGGGIFYFPD

SEQ ID NO: 4517 - DNA, 180 bp, Neisseria gonorrhoeae
ttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggc

SEQ ID NO: 4518 - protein, 60 aa, Neisseria gonorrhoeae
LTMLLDNLGLIGCKERSAQLGFVGRVLIPAVGFLILCVAMGAVGMLPGIPPFLEQFKSLG

SEQ ID NO: 4519 - DNA, 477 bp, Neisseria gonorrhoeae
ttgccgacggcagaaagttttttggttgtctttccatttgcggtattggctgttgcaatgtggtcgcccgattttttaggacatcaagtgttccaaaaaatcagctatccggaaaaaaccgataaggtattgatgaatatagacgacaccatgacaagttgttctgtccgtcaagcagtgggttctattttagggggtgcaaattttacctcttcttggggaacttatatcgtgccggcatcgattgccaaacaccccattccgggcggtgcggttttaacggcggttttatgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgt

SEQ ID NO: 4520 - protein, 159 aa, Neisseria gonorrhoeae
LPTAESFLVVFPFAVLAVAMWSPDFLGHQVFQKISYPEKTDKVLMNIDDTMTSCSVRQAVGSILGGANFTSSWGTYIVPASIAKHPIPGGAVLTAVLCIIAGLWGYPMDLAIWQPVLIVGVCLPLLEAGMEMTRKGKTTQSAAIVVFSSVWSIRFSAGR

SEQ ID NO: 4521 - DNA, 141 bp, Neisseria gonorrhoeae
ttgaaaactgccgaaatgccgtctgaaacgtttcagacggcatttttgtattatgaaccgttttgcggtttccatatccttggcagacggtttgcagcagattcgcatacggcagatgtttcaagcagaaaggaaacacaa

SEQ ID NO: 4522 - protein, 47 aa, Neisseria gonorrhoeae
LKTAEMPSETFQTAFLYYEPFCGFHILGRRFAADSHTADVSSRKETQ

SEQ ID NO: 4523 - DNA, 567 bp, Neisseria gonorrhoeae
ttgcgcttcgtcgccggcgagcgcggattgatgtttttcgatacagaaggaaaatcccatactgcaatatttatgaaaatcgttggcggcaatggaaagattgccggcgaggtggtgatagacggggaatatgctcttgatattgtccgcatgaatgatgatttgagtattgccgtgcaagataataagggtagaagccgtgcttccgacctggaagcattgtcgcaagcgaaatcatttaccctaattgcgttcagccgttatgcgggcacagttgaagtggataaagtatcggctgttacaggcatttgtgcagattaccgcagcaaaggcctgaaggttgccgttgcagacaatatgaggcccaaacaagaaatcgttgtattccgtgcaagcggcgtaatggcaagtaataagcgcaagataaacgaagcatatttggattattctgcatcctctaaactgccttccgcccaaaagcaagaattggaacaagataaaaacaatatgattgccgtccattacggacgcttggaagaattaatcgcacgaggtatctgcgtacgc

SEQ ID NO: 4524 - protein, 189 aa, Neisseria gonorrhoeae
LRFVAGERGLMFFDTEGKSHTAIFMKIVGGNGKIAGEVVIDGEYALDIVRMNDDLSIAVQDNKGRSRASDLEALSQAKSFTLIAFSRYAGTVEVDKVSAVTGICADYRSKGLKVAVADNMRPKQEIVVFRASGVMASNKRKINEAYLDYSASSKLPSAQKQELEQDKNNMIAVHYGRLEELIARGICVR

SEQ ID NO: 4525 - DNA, 537 bp, Neisseria gonorrhoeae
ttggggctgcctgacagctttgtactggaaaatgtgcgctatgagcttttaatcgccgccgcgtctatcttattggtatcgggcttttttctgcccggcgccaacctgcccggtacgcacgggccgctgattccgatgattcccatcgttgtgtcggcaggcgggcatcctttggcgttcggcatttcgattgcggttttaggtctgctgatggctttatttcgcggcggcagtattatggcgaagctgacaagcaacggcgtatgcggcggattattactctatttgggctttatcggcacgacggggcaggtaaaaaaattgttttcgtgggcaggcggttttaatatgccctacatcgcttttaccgtcattattgtaacgattgtgatgtacgctttgttggagcattggaaaaaacgctggttggccgtgcctttgggatgcttgattgccggtgtggcggcatttgcattgggtgcgccgtttgagtttcacaccgcccccggcctgcctccaatgagtcctgcttattgg

SEQ ID NO: 4526 - protein, 179 aa, Neisseria gonorrhoeae
LGLPDSFVLENVRYELLIAAASILLVSGFFLPGANLPGTHGPLIPMIPIVVSAGGHPLAFGISIAVLGLLMALFRGGSIMAKLTSNGVCGGLLLYLGFIGTTGQVKKLFSWAGGFNMPYIAFTVIIVTIVMYALLEHWKKRWLAVPLGCLIAGVAAFALGAPFEFHTAPGLPPMSPAYW

SEQ ID NO: 4527 - DNA, 336 bp, Neisseria gonorrhoeae
ttgggctttaaatggggttacggcttccgaacgcagcccgtatcaaaaagaaaagtcatgcgccccttttacgaggcgcgatatataaggaggaaggttatggaaaaacataatgggacttatcgggatttacaccgtccggcttcggaatttgcgacgcgggacgaatatttggaacatgaattgcagattatgcaaccaaaacgctggcggcccaacctgccctttcgcgattaccgcttcgagtgggaggatttgattcctgcgatggcgggaacgattggaaaagtggtgatggtggggggcggcggcgtttgccgcacctttggggctgcc

SEQ ID NO: 4528 - protein, 112 aa, Neisseria gonorrhoeae
LGFKWGYGFRTQPVSKRKVMRPFYEARYIRRKVMEKHNGTYRDLHRPASEFATRDEYLEHELQIMQPKRWRPNLPFRDYRFEWEDLIPAMAGTIGKVVMVGGGGVCRTFGAA

SEQ ID NO: 4529 - DNA, 129 bp, Neisseria gonorrhoeae
atgtatccctccttgtgcggatgttttctatatttgtgcaatcgaaatcttttaggcggattgttgctgaaaattaactttttaatcaagtggtttgtaaattgtatcagttttccggatgatgattat

SEQ ID NO: 4530 - protein, 43 aa, Neisseria gonorrhoeae
MYPSLCGCFLYLCNRNLLGGLLLKINFLIKWFVNCISFPDDDY

SEQ ID NO: 4531 - DNA, 597 bp, Neisseria gonorrhoeae
atggatgccgtacaattaaaatcatttgtcgccgtcgcgcacgagggcaaccttacccaaaccgccaaacgacttttcctttcccagcctgccgtttccgcccaaattaaagcccttgaagaatatgtcggcacgccgctgttcaggagcacggggaaaggcatggtattgacgcgggcgggcgaaatactgttgcccgaagcggaatccctgctgcaatacaaacacaagttggagtattttgccaaaacgctggcaggcgattattcggaagagaccagtttgggcattatccaccccatcgattcggcaaaactcgtcgcgctgacggacaatatcggtcaaacagccccccaaaacgcgcctgcacatccaatacggaatgagcggcgaaatcctctcgcgcatccaacacaaaaccctgcacggcggctttatactcggcaacgccgcccaaggcggcatccgcagcgtattcctgcaaaacctgacctacgcgctgatttgcccgcaaagccaatattcccggctgacccgctcccttccgcagagcctgcaagaatgcgtatggatagaaatgtcgggcgtgtccggaag

SEQ ID NO: 4532 - protein, 199 aa, Neisseria gonorrhoeae
MDAVQLKSFVAVAHEGNLTQTAKRLFLSQPAVSAQIKALEEYVGTPLFRSTGKGMVLTRAGEILLPEAESLLQYKHKLEYFAKTLAGDYSEETSLGIIHPIDSAKLVALTDNIGQTAPQNAPAHPIRNERRNPLAHPTQNPARRLYTRQRRPRRHPQRIPAKPDLRADLPAKPIFPADPLPSAEPARMRMDRNVGRVRK

SEQ ID NO: 4533 - DNA, 447 bp, Neisseria gonorrhoeae
atgagcggcgaaatcctctcgcgcatccaacacaaaaccctgcacggcggctttatactcggcaacgccgcccaaggcggcatccgcagcgtattcctgcaaaacctgacctacgcgctgatttgcccgcaaagccaatattcccggctgacccgctcccttccgcagagcctgcaagaatgcgtatggatagaaatgtcgggcgtgtccggaagtaggaagcacctgcaccagttttggcgcagcaaccggctctcacccaaaaaaacagatattgtgcgactacccccaaacccttatcgatttggttgcaggcggtataggtgtggcaatggtgcagggaaacaaagccgaagcggcggcaaaagaaggcgcgggcgtggctattatcgaatcgtgccgccacagtatgccgctcaatttcatttatgcggaagaatacgagga

SEQ ID NO: 4534 - protein, 149 aa, Neisseria gonorrhoeae
MSGEILSRIQHKTLHGGFILGNAAQGGIRSVFLQNLTYALICPQSQYSRLTRSLPQSLQECVWIEMSGVSGSRKHLHQFWRSNRLSPKKTDIVRLPPNPYRFGCRRYRCGNGAGKQSRSGGKRRRGRGYYRIVPPQYAAQFHLCGRIRG

SEQ ID NO: 4535 - DNA, 258 bp, Neisseria gonorrhoeae
ttgtgcgactacccccaaacccttatcgatttggttgcaggcggtataggtgtggcaatggtgcagggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcgttgaaaaagtatggggagtgcaggcggtgcagccgcccgttgtctcggacaac

SEQ ID NO: 4536 - protein, 86 aa, Neisseria gonorrhoeae
LCDYPQTLIDLVAGGIGVAMVQGNKAEAAAKEGAGVAIIESCRHSMPLNFIYAEEYEDNPHVSLLLECVEKVWGVQAVQPPVVSDN

SEQ ID NO: 4537 - DNA, 135 bp, Neisseria gonorrhoeae
atgaaccgttttgcggtttccatatccttggcagacggtttgcagcagattcgcatacggcagatgtttcaagcagaaaggaaacacaataaaaataaaaaagcctccgaacagtcggaggctttgctttcaaac

SEQ ID NO: 4538 - protein, 45 aa, Neisseria gonorrhoeae
MNRFAVSISLADGLQQIRIRQMFQAERKHNKNKKASEQSEALLSN

SEQ ID NO: 4539 - DNA, 2073 bp, Neisseria gonorrhoeae
agccgcgttgtcgaagccgctgtggcgcagcagtgcgtctatgctcggttcgcgtccgcggaaggctttgaaggattccgccgcgctgcgggagccgccgacggcaaggatttcttgccagaagcgtttgcctgtggcggcgacgtcgtcgctttcttcaaaggcggcgtaggcatcggtgctgaggacttcggcccatgcgtagctgtaatagcctgcggaatagccgccggcgaagatgtggccgaagctgttggcgaagcggttgtattcgggcggttggatgacggcgacttctttgcgcacgctgtctaaaacctgctgccagtttttcagacggcattcgtcgctttcactgtaaatcatcatatcgaagagggcgaactccatttgccggacgaggaacataccgcgctggaagtttttggcggcgagcattttgtcgaagagttctttcggcaggggctcgccggtttcttcgtgggcggacatttgtgccaatacattgtattcccaaacgaagttttccataaactggctgggcagttcgaccgcgtcccattctacgccgttgatgccggacacgcccagttcgtccacttgggtaagcaggtggtgcagtccgtggccggtttcgtggaagagggtgaggatttcgtcgtggcttaaacgcgcttctttgccgccgacgggcggggcgaagttgcagacgaggtaggcggtgggcagttgcagcgtgccgtcggcaaagcggcggcggcctttgtagtcgttcatccacgcgccgccgcgtttgccttcgcgtgcgtacaaatccatataaacgccgccgatggttttgccgttttgttgcaattcaaaatagcgcacgtctttgtgccagacgggaacggttttttcggcgaatccgatgccgtagagttttttgatttgggcgaacaggcctgccagaactttgccgacggggaagtattttttgacttcggtttcgctgaatgcgtatttggcttcgcgcagtttttcgccggcgtagctcaagtcccacggctgcgggtcggcgagaccgaggtgttcgcgggcgaaggctttgacttcggcgaggtctttttcggcgtagggtttggcgcggcgggcgaggtcgtgcaggaagtttaaaacctgttcgggcgtgtccgccattttggttgccagcgacaattcggcgtaatttttaaagccgagcagtttggcggttttcaatgcgttttcgagcgtgcggtcgatgttggcggtgttgtcgaatttgccgtcgtttgaaagttcgctggcacgggtaacgtaggcgcggtagatttgttcgcgcagttcgcggttgccggcgtattggataacggcaaggtagtgcggaatctgcaagccgattttgtaacctgttttgccttcgctttgcgcggcggcggcaaacatggcgagcgcgtcttcgggaatgccggcaagcggtgcggcatcgtcaaagtaaatgccgaacgcgtcggtcgcgtctaggacgttttgggagaatttggcggaaagttgcgcgccttcggtttgcagttttgccagttctgcctgccgttcgggcggcagttccgcgccgctcaatacgaaatcgcgcaggtcgtgatcgagcttggttttttgtgcgggggaaagcgttgcaaattcgggggaatttttgatggttttgaagcggttgtacagttcgatgtcttgtccgatttcggtgaagaagacggtgatttcaggcatcagttcgttatagacggcgcgcagttcgggcgtgtcgacgacggagttgagatgggacacgacgccccaaatcctgccgacgcgttcggtgatgccggtcagacgctcgacggtgttcgcccagccggtgtgcgtttgcgctttgacggcggcgatttgtccgcgcgcttcggcgatggcggtttggacggcgggtttgatgtcttcggttttgatttgattaaaacggggttcttcgcccaagtggagcagtgcgttgtcaatcataagatgggtttcctttgcgtgttgtgcttcagacggcat

SEQ ID NO: 4540 - protein, 104 aa, Neisseria gonorrhoeae
SRVVEAAVAQQCVYARFASAEGFEGFRRAAGAADGKDFLPEAFACGGDVVAFFKGGVGIGAEDFGPCVAVIACGIAAGEDVAEAVGEAVVFGRLDDGDFFAHAV

SEQ ID NO: 4541 - DNA, 531 bp, Neisseria gonorrhoeae
ttgagggcaaaagtcattatgctcaaaaatgaaatacgagggggacttggtattccgccggattgggctacaatgcgcggacaggcaaaaaaaacgaatgtctttgccgatgcggaaaaaagagttttccggcgggaaaaaaggatcgtacaacatccgcttatccgtttcccatcagtttggctgaatgatatcggggccgcgccattattcggcaggccccattttattgccacacattgcctgcccgattcccgtttcaacagcaaacccttccaatattttgttcaaacttggatcgcggcagatgggggcgtgcaagccccgcaaggtttttttggcttttacggaacagcacgcatttcgccaaacggcaaaattgcattaacggaattgaaaacttttggaattgtgcaaaacggcatttgcgtcagtttaacggcatttccaaagggcattttaagccgtattcgagagaatgcggatggcgttttcagtgttttcagcgtgataaaattcaaatttctattc

SEQ ID NO: 4542 - protein, 177 aa, Neisseria gonorrhoeae
LRAKVIMLKNEIRGGLGIPPDWATMRGQAKKTNVFADAEKRVFRREKRIVQHPLIRFPSVWLNDIGAAPLFGRPHFIATHCLPDSRFNSKPFQYFVQTWIAADGGVQAPQGFFGFYGTARISPNGKIALTELKTFGIVQNGICVSLTAFPKGILSRIRENADGVFSVFSVIKFKFLF

SEQ ID NO: 4543 - DNA, 2658 bp, Neisseria gonorrhoeae
ttgagtgcggcaaacaatatcgttgaagtaggaggcagcccgatgaaccaagaagggattaccgctcacggaaatgccacgattaccctcaaggcgaaagaaaacaataaaattaccgtggaaaacgccgcatacagcagcgacggcatttcgactctgattaacagaacgggggcaagacccggaacaagggatgatggaaataaaatcatactggaagccggcggcgataatattgttaccatgaaatccggcgatgcggatgcggattatgtaaacaattccaaagtattaacggagacaccatattataaaagcaaacgaggttccaacggcatttttgcctatggcgacaaatcgctggtcaaactgattggcgagaataatatcgttaagagtgaaatcagtgaaaaatctaaggcattaaatgggggatttcgccatatcggcatttattcatggcaaaacgcgaaagtcgaattgtctgcgaagagcgacaatatcgtacaaggcggaatttggggcttatactccaacaactcctcaatttccctcaaggggaaaaataatgtgatttcaaacccgaaatataatgttttcgcctacaaaaaggcaaaggtggatttgactgtcgaaaataaaaacacattatctgatgcggaatttggcgtatatgccttaaacacaagtatggttaatttgtcttcaaaagataataacgaggtaaaaagcacccaagtgggtctgtattcgcaagacggcggttcaatcaatgtagataggaaggataatattattgaaggcgacgcggttgccttggtgggaaaaggtggaagtcaaaacattcgggcaagccgtacaaacctgattagttcaaaaagcttaggaattcatgctgaacaagctgcaaaaatagccataaccggcgcaagcaatacaattcatgcaagcaatgccgctattcgttcattagacaaaagcgaagttaagattgacggtcaaattaccattgactccaacgttgccaatcttgcaaggcaagatggttcaattcatttgaattataaagacgatacccgtatcacaggggcaaccgtatctgataagggtttggtagccatcaaacctttgaataacacgaatattgttgccgacactattcactataaaggcgatgtcttggcggtaaataagggtaaagtggaattagatttcacgccgaacatccttttagcgggacgtttggataattttagcggcttaaccgattccaaacataaaaatttattcgaaaactatgttgcaaatttagacagcaaaagtgcgggcgaaattaactttaatttagccaaagacgcattatggacgatgacaggtcaaagctggctggataaattggaaggacaaggcactatcgattttaataatgatgctaaaacaagtggacgcgccttacatatcggcgaattggcgggtgccaataaattcttgatgcatctgaataaagacggcattcacagcgatatgctctatgtgaaaaaaggcacttcgacaccgcaagaagtcgtcgtcaaaaatctgtccgaagtgctcgacagtatgaattacggcgaacgtttgcgtttcgctacagtaacaaactcaaaaaatgaatttgtgaacggtaaaaaatatattgacgatacgcaccttatggaggatgccctgactgtcgaatactccgcacataacggcgataaaaacaacaaggatgactataataaatcctttaacggctctgaaatgacggcggaaaaagctggagacgattatgtcaataaaacctataccgacaacaggcaaaatgtctatttggtcaaacaggctaccggcaatccgagccgaaatgtcaaaaatatcaatgatatgttcgattcaaccgcacattatgcgttcactttggatacttatgccaaacgcgaaggggagcgggctttttcaacgttggataaaaaagaaggcgattggataaggctgacgcatacccgtgtgattcaatccaatgcgtttaggtttcataacaacgattttgaaatcggatatgaccgattcagcctcaacgagcaggagaaaaaacgcaaatggggcataagtctcgactacggccacggcaggacatcattatggaatacgtttggcaaggacaaaatcaggaaatatgaattggctctgtacaatactacccaatacatagataaagaaggagacgaaacagggtatatcgacaatgtattaaaaataggaaaactgcgtaaccgtgtgattgcacgaaatcatatggggcaattatggggcaagggaaaatatagcaacaccctattctctatcagcaccgaatacggccgccgtaaatttttggatgacgataaattgtggcggattacaccgcaagtacagttgcaatattcctatttgagaggtaccggctatcggatcgataacggcataaacgtcaatttaagccacgcaaacagcctgataggccgcttgggtttggatgtcgtgagaaaatttgacggaggcaaaaaacttttctatatcaaaggcaatatctttcatgaatttttgggcagtcgttcctttaaggcatttgagggcaaaagtcattatgctcaaaaa

SEQ ID NO: 4544 - protein, 886 aa, Neisseria gonorrhoeae
LSAANNIVEVGGSPMNQEGITAHGNATITLKAKENNKITVENAAYSSDGISTLINRTGARPGTRDDGNKIILEAGGDNIVTMKSGDADADYVNNSKVLTETPYYKSKRGSNGIFAYGDKSLVKLIGENNIVKSEISEKSKALNGGFRHIGIYSWQNAKVELSAKSDNIVQGGIWGLYSNNSSISLKGKNNVISNPKYNVFAYKKAKVDLTVENKNTLSDAEFGVYALNTSMVNLSSKDNNEVKSTQVGLYSQDGGSINVDRKDNIIEGDAVALVGKGGSQNIRASRTNLISSKSLGIHAEQAAKIAITGASNTIHASNAAIRSLDKSEVKIDGQITIDSNVANLARQDGSIHLNYKDDTRITGATVSDKGLVAIKPLNNTNIVADTIHYKGDVLAVNKGKVELDFTPNILLAGRLDNFSGLTDSKHKNLFENYVANLDSKSAGEINFNLAKDALWTMTGQSWLDKLEGQGTIDFNNDAKTSGRALHIGELAGANKFLMHLNKDGIHSDMLYVKKGTSTPQEVVVKNLSEVLDSMNYGERLRFATVTNSKNEFVNGKKYIDDTHLMEDALTVEYSAHNGDKNNKDDYNKSFNGSEMTAEKAGDDYVNKTYTDNRQNVYLVKQATGNPSRNVKNINDMFDSTAHYAFTLDTYAKREGERAFSTLDKKEGDWIRLTHTRVIQSNAFRFHNNDFEIGYDRFSLNEQEKKRKWGISLDYGHGRTSLWNTFGKDKIRKYELALYNTTQYIDKEGDETGYIDNVLKIGKLRNRVIARNHMGQLWGKGKYSNTLFSISTEYGRRKFLDDDKLWRITPQVQLQYSYLRGTGYRIDNGINVNLSHANSLIGRLGLDVVRKFDGGKKLFYIKGNIFHEFLGSRSFKAFEGKSHYAQK

SEQ ID NO: 4545 - DNA, 459 bp, Neisseria gonorrhoeae
ttgagagtacaagtttttttaaggggtattgaaacggcttttaaatccaataccgtattaacggggaataacaataaaatatccatcaccactgagggcgacggcttgggattgggcgtaaatggcctccagtccaactccccctattccggacacacgacgggtactttcatcaataatcaaccaagcaatactacccaaccttcccttgacggcaccagcaccatcgaactcaaagccgtcaaggggaataatgaagttgatttaaatgtaaaaaaccacgcctccgtaaaaggcattatcacgtcgcattctgcaaaagcaacgcttgaagccgaggaggataatattgtccgggttaaaaatccggacaccaagacggctttaatcaatgcctggaaagaaaaataccccaataattcgccagaaccatacagggtggggggttcaatccacgat

SEQ ID NO: 4546 - protein, 153 aa, Neisseria gonorrhoeae
LRVQVFLRGIETAFKSNTVLTGNNNKISITTEGDGLGLGVNGLQSNSPYSGHTTGTFINNQPSNTTQPSLDGTSTIELKAVKGNNEVDLNVKNHASVKGIITSHSAKATLEAEEDNIVRVKNPDTKTALINAWKEKYPNNSPEPYRVGGSIHD

SEQ ID NO: 4547 - DNA, 546 bp, Neisseria gonorrhoeae
ttggaacttattaccaccggggaaggggcagatggagacttactggtcaacggttcttacggcatccgttcttttgcagacctaaaattggaatacaaacccgaattatcggtgagaagcaatcatgacattattttcaacaatgattttcaatctgttgacgtacaaccctattccggaaatatccatttggatgtcaaaggaaaaattcaatttaatttgaatgttgccgataaggtaacagatccaaccacacatcaagaaaagttagtgaacgataacgctttagtgcggtatgtcaacaatatcaccccctccgatgaaaatgacaaaggcagcatatccttccattcaaaaacaggcaatttgttcaatatgaacgttaacgttcataaaggcacacaccatttcggtattcacaacctccgcaataccaatgttaatctgactgccgaagacggcgataatgtggttgcgattaaagggaagcttgccgagcctatgccggcaggaaaagttgagagtacaagtttttttaaggggtat

SEQ ID NO: 4548 - protein, 182 aa, Neisseria gonorrhoeae
LELITTGEGADGDLLVNGSYGIRSFADLKLEYKPELSVRSNHDIIFNNDFQSVDVQPYSGNIHLDVKGKIQFNLNVADKVTDPTTHQEKLVNDNALVRYVNNITPSDENDKGSISFHSKTGNLFNMNVNVHKGTHHFGIHNLRNTNVNLTAEDGDNVVAIKGKLAEPMPAGKVESTSFFKGY

SEQ ID NO: 4549 - DNA, 1308 bp, Neisseria gonorrhoeae
atgaccgatttgtttgtccgagaacccgacgcaccgcttgccgaacgtctgcgcccgcatacgcttgatgatgttatcgggcagcagcatttaatcggcgaaggcaagccgctgcgcgtggcggtggaaggcgggaagccgcattctatgttgctgtgggggccgccgggcgtgggcaagacaacgttggcgcggattttggcgcagagtttcaatgcccagtttttgcctgtttccgccgtgttttccggcgtgaaggacatccgcggggcaatcgataaggctgaaatcgctttgcagcagggacgcgcgacgattttgtttgtcgatgaagtccaccgcttcaacaaggcgcagcaggacgcgtttttgccgcatgtcgaaagcggtttgctgacctttatcggcgcaacgacggaaaatccgtcgtttgaagtcaatcccgcgctgctgagccgcgcgcaggtatatgttttgcaatccttgtcttcagacgacctcaagaaactgattgccaaagtgttggctttgcccgaataccgggatttcacgattgaagccgatgtgcaagagctgctcgtcaataccgccgacggtgatgcgcgcagattattgaatttgttggaacaacttttacgtgccgccgacacgcgccgtctgaaaatcctgaccaccgaatttctcgccgacagcttgggcgcgcaaatccgccgtttcgacaaaggcggcgagagtttctacaaccaaatctccgccctgcacaaatccgtgcgcggttcgcatccgaacgccgcgctgtattggttttgccgtatgctcgacggcggcaccgacccgcgctatctcgcccgccgcatcgtgcgtatcgcttgggaagacatcgggcttgccgacccgcgcgccttccaaatcgccaacgatgccgccgccacctttgaacgcttaggctcgcccgaaggcgaactcgcgctggcgcaagccgtgctgtaccttgccgccgccgccaaatccaacgcgggctacaaggcatacaaccaaatgcgccgcttcgtcaaagaaaacgccagcgacgaagtgcccgtccacctgcgcaacgccccgaccaagctgatgaaggaattgggctacggacgcgaataccgctacgcccacgacgaaccgaacgcctacgccgccggcgaaagctatatgcccgacggcttggacgaaccggacttttaccaacccgtcccgcgcgggctggaaatcaaaatcggcgaaaagctggcatggttgaaatcgctggacgaagaggcattaaaggcaaaa

SEQ ID NO: 4550 - protein, 436 aa, Neisseria gonorrhoeae
MTDLFVREPDAPLAERLRPHTLDDVIGQQHLIGEGKPLRVAVEGGKPHSMLLWGPPGVGKTTLARILAQSFNAQFLPVSAVFSGVKDIRGAIDKAEIALQQGRATILFVDEVHRFNKAQQDAFLPHVESGLLTFIGATTENPSFEVNPALLSRAQVYVLQSLSSDDLKKLIAKVLALPEYRDFTIEADVQELLVNTADGDARRLLNLLEQLLRAADTRRLKILTTEFLADSLGAQIRRFDKGGESFYNQISALHKSVRGSHPNAALYWFCRMLDGGTDPRYLARRIVRIAWEDIGLADPRAFQIANDAAATFERLGSPEGELALAQAVLYLAAAAKSNAGYKAYNQMRRFVKENASDEVPVHLRNAPTKLMKELGYGREYRYAHDEPNAYAAGESYMPDGLDEPDFYQPVPRGLEIKIGEKLAWLKSLDEEALKAK

SEQ ID NO: 4551 - DNA, 1104 bp, Neisseria gonorrhoeae
ttgagaatgactgctctgaaaaccaccccgtttcatcaagcccatcaagatgcaggcgcgaagccggtagattttgccggctgggaactgcccatccattatggttcgcaaatcgccgaacacgaagccgtgcgcaccgacgccggtatgtttgacgtatcccatatgctcgttaccgacgtcgtcggagcgaacgccaaagcctttttccgcaaattgattgccaacgacgttgccaaactcgcttttgtcggcaaagccctttattccgctttgctcaacgacaacggcggcgtgattgacgacttgatcgtttaccgcaccaacgaggccgaaacccaataccgcatcgtgtccaacggtgcgacccgtgaaaaagacacggcacaattccacaaagtcggacaagagttcggcgttgccttcaatccgcgctacgacctcggtatgcttgccgtacaaggtcctaaagccattgaaaaactcctgaccgtcaaacccgaatgggcggatgtgattcacggcctcaaaccgttccaaggcgcggatttgggcaacgactggtttgtcgcccgtacaggctacaccggcgaagacggcgtcgaagtgattctgccggataccgaagccgtcgcattcttcaaagccctgcaaacagcaggcgtacagccttgcggcctcggcgcgcgcgacaccctgcgcatggaagccggtatgaacctctacggcaacgatatggacgacgacaccagcccgctcgaagcaggcatgggccggacggttgatttgaaagacgaaagccgcgattttgtcggtaaagccgccttgttggcattgaaagaaaaaggcgttgccgtcaaacaagtcggtttgctgctcgaaaaaggcggcatcctgcgcgcgcatatggaagtgttgaccgacaaaggaaaaggcgaaaccaccagcggcgtattctcgcccagcctgaaacaatctatcgccatcgcccgcgtaccgaaagattttgacggcgataccgccaaagtcctgattcgcggcaaagaagcggacgtgcgcgtactgaagctgccgttcgtccgcagcggtcaaaaacagtttgat

SEQ ID NO: 4552 - protein, 368 aa, Neisseria gonorrhoeae
LRMTALKTTPFHQAHQDAGAKPVDFAGWELPIHYGSQIAEHEAVRTDAGMFDVSHMLVTDVVGANAKAFFRKLIANDVAKLAFVGKALYSALLNDNGGVIDDLIVYRTNEAETQYRIVSNGATREKDTAQFHKVGQEFGVAFNPRYDLGMLAVQGPKAIEKLLTVKPEWADVIHGLKPFQGADLGNDWFVARTGYTGEDGVEVILPDTEAVAFFKALQTAGVQPCGLGARDTLRMEAGMNLYGNDMDDDTSPLEAGMGRTVDLKDESRDFVGKAALLALKEKGVAVKQVGLLLEKGGILRAHMEVLTDKGKGETTSGVFSPSLKQSIAIARVPKDFDGDTAKVLIRGKEADVRVLKLPFVRSGQKQFD

SEQ ID NO: 4553 - DNA, 153 bp, Neisseria gonorrhoeae
atgcgcgataaaatcaaactggaatccggtgcaggtactggccacttctacaccactaccaaaaataaacgcactatgcccggcaaactggaaatcaaaaaattcgatccggttgcccgcaaacacgtagtgtacaaagaaaccaaactgaaa

SEQ ID NO: 4554 - protein, 51 aa, Neisseria gonorrhoeae
MRDKIKLESGAGTGHFYTTTKNKRTMPGKLEIKKFDPVARKHVVYKETKLK

SEQ ID NO: 4555 - DNA, 3027 bp, Neisseria gonorrhoeae; identical to SEQ ID NO: 185

SEQ ID NO: 4556 - protein, 1009 aa, Neisseria gonorrhoeae; identical to SEQ ID NO: 186

SEQ ID NO: 4557 - DNA, 231 bp, Neisseria gonorrhoeae
atgcacaacaacgacatcatcatctacaccacggaagacggactatccgaatttaccctgcgcgagcttgacggcgaactatggcttacccaaaaagaaattgccgaactctaccaaaccagcaaacaaaacatcggtaaacacatcaaagccatatttgcagaacaagaactggacgattcagttgtaaactttcagtttacaactgccgcagacggcaagaactaccga

SEQ ID NO: 4558 - protein, 77 aa, Neisseria gonorrhoeae
MHNNDIIIYTTEDGLSEFTLRELDGELWLTQKEIAELYQTSKQNIGKHIKAIFAEQELDDSVVNFQFTTAADGKNYR

SEQ ID NO: 4559 - DNA, 1200 bp, Neisseria gonorrhoeae; identical to SEQ ID NO: 187

SEQ ID NO: 4560 - protein, 400 aa, Neisseria gonorrhoeae; identical to SEQ ID NO: 188

SEQ ID NO: 4561 - DNA, 558 bp, Neisseria gonorrhoeae; identical to SEQ ID NO: 189

SEQ ID NO: 4562 - protein, 186 aa, Neisseria gonorrhoeae; identical to SEQ ID NO: 190

SEQ ID NO: 4563 - DNA, 840 bp, Neisseria gonorrhoeae; identical to SEQ ID NO: 191

SEQ ID NO: 4564 - protein, 280 aa, Neisseria gonorrhoeae; identical to SEQ ID NO: 192

SEQ ID NO: 4565 - DNA, 1599 bp, Neisseria gonorrhoeae
atgaccgaacaacactttaccgaacaaatcaaatccctaatcgacagcttaaaaaccatctgcgccaactatggtttgggcaatgacggcaacgaatttaaaatcatcagtcaggcgtttttgtataaattcctaaacgacaaatacgattttgaagttaaaaaaattcgcaaagaaaagcccgacgagccgatcgagttcgtcaatatggatattgatggaaaaacagcggttttaaagcccgaacattccatcaagtatttgtcggagcggcaaaacggcgcagactttgccaaactctttgacgatacgctcactgacatcgctgcacataatgctgagttgttttctgtgaaaaccgaaggcggggcgaaaatcgtgttgtttgagcgtattagtcagtacattactgacgaaggtcgccgcgacgatttttgccgcgcgctgatttccaagctggcgggtttcagcttcgaggcgatttttgcgcaaaaattcgactttttcgccacgatttttgaatacctgattaaagactacaacagtaattctggcggcaaatatgccgaatactacacgccgcatgcggtggcgcggattatggcggatattttggtgccggaagatgtgcgcgggcaaatccgcagcgtggacgtttacgacccgtcggccggttcgggaacgctgttgatgaacgtcgcccatgccataggcgaagacaaatgtatgatttatacgcaggatatttcgcagaaatcgtccaatctgctgcggctgaatctgattttgaataatttggtgcattctttgaataatgtggttcagggcaatacgattttgtcgcccgcccacaaagacgcttcaggctgtctgaaaaaatttgatttcattgtttccaatccgccgtttaaattggatttcagcgatttccgcgatcggctggaaagcgatgaaaaccacgaacgcttttttgctggtatcccgaaaatcaagccaacaaagaaagagaagatggaaatctatcagctttttatccagcatattctgttcagcctgaaagaaaacggcaaggcagcgattgtattaccgaccggctttatcacggcaaaatcgggcatcgacaaaaaaatccgcgaatatttggtggaaaacaaaatgcttgccggcgtggtgtccatgccttccaatattttcgccacgacgggaaccaatgtttccatcctgtttatcgacaaaaccaataaagacaaagtggtattaattgacgcatcgggcttgggcgaaaaaatcaaagacggcaaaaaccaaaaaaccgtactttcctgcgaagaagaacaaaaaatctgcaatactttcacgaacaaacaggcagtggaagattttagcgtggtggtcggctacgatgaaatcaaagcgaagaatcacagcttgtcggcggggcagtattttgaggtaaaaattgattatgtggatatatccgccgacgaatttgcgcaaaaaatagcgggattttcagcggatttggataaacttttcgccgaatctgccgaattggaaaaggagattaaggatagattggcgatgttgaaattcaattca

SEQ ID NO: 4566 - protein, 533 aa, Neisseria gonorrhoeae
MTEQHFTEQIKSLIDSLKTICANYGLGNDGNEFKIISQAFLYKFLNDKYDFEVKKIRKEKPDEPIEFVNMDIDGKTAVLKPEHSIKYLSERQNGADFAKLFDDTLTDIAAHNAELFSVKTEGGAKIVLFERISQYITDEGRRDDFCRALISKLAGFSFEAIFAQKFDFFATIFEYLIKDYNSNSGGKYAEYYTPHAVARIMADILVPEDVRGQIRSVDVYDPSAGSGTLLMNVAHAIGEDKCMIYTQDISQKSSNLLRLNLILNNLVHSLNNVVQGNTILSPAHKDASGCLKKFDFIVSNPPFKLDFSDFRDRLESDENHERFFAGIPKIKPTKKEKMEIYQLFIQHILFSLKENGKAAIVLPTGFITAKSGIDKKIREYLVENKMLAGVVSMPSNIFATTGTNVSILFIDKTNKDKVVLIDASGLGEKIKDGKNQKTVLSCEEEQKICNTFTNKQAVEDFSVVVGYDEIKAKNHSLSAGQYFEVKIDYVDISADEFAQKIAGFSADLDKLFAESAELEKEIKDRLAMLKFNS

SEQ ID NO: 4567 - DNA, 135 bp, Neisseria gonorrhoeae
atgaaaccggtcaaacttaaaatgccgtctgaaagcctttcagacggcattttgtttggtttggaaaatacttatgccgttctttccccgaaagagagaatccaaaaaaccaaagccacaggaattcatcggaaa

SEQ ID NO: 4568 - protein, 45 aa, Neisseria gonorrhoeae
MKPVKLKMPSESLSDGILFGLENTYAVLSPKERIQKTKATGIHRK

SEQ ID NO: 4569 - DNA, 1305 bp, Neisseria gonorrhoeae
atgccgtctgaaccgatattaatcaaactgtttttgaccgctgcggacgaacggcagcttcagtacgcgcacgtccgcttctttgccgcgaatcaggactttggcggtatcgccgtcaaaatctttcggtacgcgggcgatggcgatagattgtttcaggctgggcgagaatacgccgctggtggtttcgccttttcctttgtcggtcaacacttccatatgcgcgcgcaggatgccgcctttttcgagcagcaaaccgacttgtttgacggcaacgcctttttctttcaatgccaacaaggcggctttaccgacaaaatcgcggctttcgtctttcaaatcaaccgtccggcccatgcctgcttcgagcgggctggtgtcgtcgtccatatcgttgccgtagaggttcataccggcttccatgcgcagggtgtcgcgcgcgccgaggccgcaaggctgtacgcctgctgtttgcagggctttgaagaatgcgacggcttcggtatccggcagaatcacttcgacgccgtcttcgccggtgtagcctgtacgggcgacaaaccagtcgttgcccaaatccgcgccttggaacggtttgaggccgtgaatcacatccgcccattcgggtttgacggtcaggagtttttcaatggctttaggaccttgtacggcaagcataccgaggtcgtagcgcggattgaaggcaacgccgaactcttgtccgactttgtggaattgtgccgtgtctttttcacgggtcgcaccgttggacacgatgcggtattgggtttcggcctcgttggtgcggtaaacgatcaagtcgtcaatcacgccgccgttgtcgttgagcaaagcggaataaagggctttgccgacaaaagcgagtttggcaacgtcgttggcaatcaatttgcggaaaaaggctttggcgttcgctccgacgacgtcggtaacgagcatatgggatacgtcaaacataccggcgtcggtgcgcacggcttcgtgttcggcgatttgcgaaccataatggatgggcagttcccagccggcaaaatctaccggcttcgcgcctgcatcttgatgggcttgatgaaacggggtggttttcagagcagtcattctcaagtttctccggattttttgttcagatgccgcccgcgcacctgtgcgcggatgaccctatctgtccttgaacctgagattttcggccgtatccgcatgatggcaaaccagtctgctcactgctttgcgcggttgtctgaatggtggttcagacggccttctccccttcggtggacgttattc

SEQ ID NO: 4570 - protein, 435 aa, Neisseria gonorrhoeae
MPSEPILIKLFLTAADERQLQYAHVRFFAANQDFGGIAVKIFRYAGDGDRLFQAGREYAAGGFAFSFVGQHFHMRAQDAAFFEQQTDLFDGNAFFFQCQQGGFTDKIAAFVFQINRPAHACFERAGVVVHIVAVEVHTGFHAQGVARAEAARLYACCLQGFEECDGFGIRQNHFDAVFAGVACTGDKPVVAQIRALERFEAVNHIRPFGFDGQEFFNGFRTLYGKHTEVVARIEGNAELLSDFVELCRVFFTGRTVGHDAVLGFGLVGAVNDQVVNHAAVVVEQSGIKGFADKSEFGNVVGNQFAEKGFGVRSDDVGNEHMGYVKHTGVGAHGFVFGDLRTIMDGQFPAGKIYRLRACILMGLMKRGGFQSSHSQVSPDFLFRCRPRTCARMTLSVLEPEIFGRIRMMANQSAHCFARLSEWWFRRPSPLRWTLF

SEQ ID NO: 4571 - DNA, 969 bp, Neisseria gonorrhoeae
aagtgtttcggagccggcgggatgatttaacaggcggtattgtacgcgcaaaaattcgtccataaccgcctgttggatttccagccgctttgaaacgggggaggcgaagcggacgatgatgcggtatgccttgtcgtcgtacggtacgcgggtaacgcgcggcctggcggcgggcgtgataaacagtttttccgcctgcacgttttccaaataccgctgaatggcggggatgtagggcgcgcacaagggctcgagtacggctttcagacggcatacggcttcatccgaatccaaatggatgggaacggggatttcgaccgtatggatgacatagtcgcccaaaatattgtcgcggcgcacggggtggctcaacaacaggctgttggggaaagaaacggtggttcccgcaagctgtccgaccaaggggttcggaccgacctgcatcatcagcgtgttcaacagattgatgtcgaccacgcgcccgcgcaggccgttgatttcgatatagtcgccgaccgagtattgctgggtggcagaccttaaaatactgcccgacagacacataatcagttcttttgtcgccacgacgaccgccgccgccaccgcaaacatcgacaaagccagcgtttgaatttgcgccgaccagataaatgccagcgaaaacagcaccaaaagcagcgttatattgcggctggcaaccaaaaaccgccgcttgctttcgatgccgaaatccggatgccgtctgaagtggatattcaacagaagggcgcgcgccagcagcaaagccgcgaccgccgccacggattcggccgcctccgcgcgtatcgggacggcatcgggccaagtgttcaacatattccatatttccatttccgcgcccctgtccgaaaagtatagggtgtagattttagtggcaaaaaaacgcttttgccactttgccggcaaattccgcgcccgtaccggccgcaa

SEQ ID NO: 4572 - protein, 9 aa, Neisseria gonorrhoeae
KCFGAGGMI

SEQ ID NO: 4573 - DNA, 129 bp, Neisseria gonorrhoeae
atgacacaaaaacccgacgaaccggattcccgcctgcgcgggaatgacgaattagaagttacccgaaatccgaaaaaagcaaaatccaacccaacagaccgggttttcgtttgtacggaaataatgcaa

SEQ ID NO: 4574 - protein, 43 aa, Neisseria gonorrhoeae
MTQKPDEPDSRLRGNDELEVTRNPKKAKSNPTDRVFVCTEIMQ

SEQ ID NO: 4575 - DNA, 267 bp, Neisseria gonorrhoeae
atgctttatatttgcttcatttattgcattatttccgtacaaacgaaaacccggtctgttgggttggattttgcttttttcggatttcgggtaacttctaattcgtcattcccgcgcaggcgggaatccggttcgtcgggtttttgtgtcatttccgatgaattcctgtggctttggttttttggattctctctttcggggaaagaacggcataagtattttccaaaccaaacaaaatgccgtctgaaaggctttcagacggcattt

SEQ ID NO: 4576 - protein, 89 aa, Neisseria gonorrhoeae
MLYICFIYCIISVQTKTRSVGLDFAFFGFRVTSNSSFPRRRESGSSGFCVISDEFLWLWFFGFSLSGKERHKYFPNQTKCRLKGFQTAF

SEQ ID NO: 4577 - DNA, 1335 bp, Neisseria gonorrhoeae
atgaccgacacagccggcttgcgccgccgcaacctgcggcaatggatagcggaacactacggcggactgcaaaaccgttttgccgaagccgttgccctcaacacaggcgaactctccgcccttttgaaaaacaaatccttcggcgagaaaaaagcccgcaaaatcgaacaggcggcaaaaatgcccgccttctggctcgataccgaacacaccggccgaccgcccggacacacaggaaaacacaccatgtcccatatttcccccatccccgaaatcctagccgacatcaaagccggtaaaatggtcatcatcaccgatgccgaagaccgcgaaaacgaaggcgacctgctgatggcggcgcaattcgttacccccgaagccgtcaactttatgatcaaacacgcgcgcggcttagtctgcctgcctatggaaggtgcaatggtcgaaaaactcggtctgccgatgatgacccaaaaaaacggcgcgcaatacggtaccaactttaccgtttccatcgaagccgcgcacggcattaccaccggcatttccgccgccgaccgcgccctgactattcaaaccgccgtttccccgaccgccaaacccgcagacatcgtccaacccggtcatatcttcccgcttcgcgcccaaaaaggcggcgtactcgtccgtgccggacacaccgaagccggcgtcgacttggcgcaaatgaacgggctgattcccgccgccgtcatctgcgaaatcatcaacgacgacggcacgatggcgcgtatgcccgaactgatgaaattcgccgaagaacacaagctcaaaatcggcacgattgccgacctcatcgaataccgcagccgcaccgaaagcctgctcgaagatatgggcgacgcgcccgtacaaactccgtggggcgagttccaacaacacgtttacgtcgacaaactctccggcgaaacccacctcgccctcgtcaaaggcacaccctccgccgacaccgaaaccctcgtccgtgtccacgaacccttcagcgtgatggacttcatccaagccaatccgcgccattcctggtcgctgcccaaagcccttgagcgcgtccaacaggccgaaagcggcgtcgtcatcctcctgcaccacaccgaagacggcgcatccctgctcgaccgcaccctacccaaaggcgcaaaccaagcctacaaatgggacagcaaaagctacggcatcggcgcgcaaatcctcgccggcctccacgtcaaaaaactgcgcgtcctcggccaaccgtcatctttcaccggcctcaccggcttcggcctcgaagtcgtcggctttgaagaagcggaaaaa

SEQ ID NO: 4578 - protein, 445 aa, Neisseria gonorrhoeae
MTDTAGLRRRNLRQWIAEHYGGLQNRFAEAVALNTGELSALLKNKSFGEKKARKIEQAAKMPAFWLDTEHTGRPPGHTGKHTMSHISPIPEILADIKAGKMVIITDAEDRENEGDLLMAAQFVTPEAVNFMIKHARGLVCLPMEGAMVEKLGLPMMTQKNGAQYGTNFTVSIEAAHGITTGISAADRALTIQTAVSPTAKPADIVQPGHIFPLRAQKGGVLVRAGHTEAGVDLAQMNGLIPAAVICEIINDDGTMARMPELMKFAEEHKLKIGTIADLIEYRSRTESLLEDMGDAPVQTPWGEFQQHVYVDKLSGETHLALVKGTPSADTETLVRVHEPFSVMDFIQANPRHSWSLPKALERVQQAESGVVILLHHTEDGASLLDRTLPKGANQAYKWDSKSYGIGAQILAGLHVKKLRVLGQPSSFTGLTGFGLEVVGFEEAEK

SEQ ID NO: 4579 - DNA, 126 bp, Neisseria gonorrhoeae
ttgtttttcgccaaatcggattatttgccttttggtaaacagatgccgtttgaagccggattcgtggcttcagacggcattgccgcaaccccgccggcggggcggctgtttcttcccgcacgcttc

SEQ ID NO: 4580 - protein, 42 aa, Neisseria gonorrhoeae
LFFAKSDYLPFGKQMPFEAGFVASDGIAATPPAGRLFLPARF

SEQ ID NO: 4581 - DNA, 186 bp, Neisseria gonorrhoeae
gtgcgggaagaaacagccgccccgccggcggggttgcggcaatgccgtctgaagccacgaatccggcttcaaacggcatctgtttaccaaaaggcaaataatccgatttggcgaaaaacaaatttgctttttagtaaatacgcgcttacaatccgctacatccgatttctacaaaggataaaacga

SEQ ID NO: 4582 - protein, 62 aa, Neisseria gonorrhoeae
VREETAAPPAGLRQCRLKPRIRLQTASVYQKANNPIWRKTNLLFSKYALTIRYIRFLQRIKR

SEQ ID NO: 4583 - DNA, 138 bp, Neisseria gonorrhoeae
ttgattgccgggtacggcataggcggtacgagcaggcgcaataccggcaatcctatgatgaatgccgccttcccgataaaaaccggacggatcgccttttactttctacaagtaacagggcttttttttgcccgtttt

SEQ ID NO: 4584 - protein, 46 aa, Neisseria gonorrhoeae
LIAGYGIGGTSRRNTGNPMMNAAFPIKTGRIAFYFLQVTGLFFARF

SEQ ID NO: 4585 - DNA, 366 bp, Neisseria gonorrhoeae
atgtttgatggcgaagtagaagcagatgaaagttattttggcggacaacgcaaaggtaaatgcggtcgcggtgctgccggaaaagtcgcagtattcaggcttctcaaacgaaatggcaaggtttcctttgccgtccgttatgtacgtttcgtaacattcgaagacttcctgaaccctgcccgccgtttcggtttccgtacccccctgttagataagggggggaagattcgaagcggttgccggcttcctgccgtccgccggcgcgtccgtcatcacgccggcaaccgcctttttcatcccttgcttatcttccatggtgcgaatcctcaaaaacgggcaaaaaaaagccctgttacttgtagaaag

SEQ ID NO: 4586 - protein, 122 aa, Neisseria gonorrhoeae
MFDGEVEADESYFGGQRKGKCGRGAAGKVAVFRLLKRNGKVSFAVRYVRFVTFEDFLNPARRFGFRTPLLDKGGKIRSGCRLPAVRRRVRHHAGNRLFHPLLIFHGANPQKRAKKSPVTCRK

SEQ ID NO: 4587 - DNA, 2613 bp, Neisseria gonorrhoeae
gtggcaaaaaaacgcttttgccactttgccggcaaattccgcgcccgtaccggccgcaaatgcgccgcacgccctttcagacggcatccggatgcggataacgctgaatcaggcggcgaaatcggctataatacacaattatatgcgccgtcccgcccgctttttccacaaggtgcggactgttttggcggcatcgcaaaatcttttcaaaatccggcaaaaaatatgactgaacaaaaacacgaagaatacggcgccgacagcatccaggtgctcgaaggcttggaagcggtacgcaaacgccccggcatgtacatcggcgacacgcaggacggcagcggcctgcaccatatggtgtttgaagtattggacaacgccatcgacgaagcactcgccggacattgcgacaaaatcacggtaacgatacacgccgaccattccgtcagcgtcgccgacaacgggcgcggtatgcccaccggcatccacccgaaagaagggcgttccgccgccgaagtcatcatgaccgtcttgcacgcgggcggcaaattcgacaacaacagctacaaaatctccggcggcctgcacggcgtgggcgtatccgtcgtcaacgcgctgtccgactgggtaacgctgaccatctaccgcgacggcaaagaacacttcgtccgcttcgtacgcggcgaaaccgaagagccgctgaaaattgtcggcgattccgacaaaaaaggcacgaccgtgcgcttcctcgccggcacggaaaccttcggcaatatcgaatacagcttcgacatcctcgccaaacgtattcgcgaactttcgttcctaaacaacggcgtggacatcgaattgaccgacgagcgcgacggcaagcacgaaagcttcgccctttccggcggcgtggcgggcttcgtgcaatacatgaaccgcaaaaaaacgcccttgcacgaaaaaatcttctatgcgttcggcgagaaagacggcatgagcgtcgaatgcgcaatgcaatggaacgacagctatcaggaaagcgtgcagtgcttcaccaacaacatccctcagcgcgacggcggtacgcacctgaccgcgctgcgccaagtgatgacgcgcaccatcaacagctacatcgaagctaacgaagtcgccaaaaaagccaaagtggaaaccgccggcgacgatatgcgcgaaggtttgacctgcgtgttgtccgtcaaactgcccgaccccaaattctcatcccaaaccaaagacaaactggtttccggcgaaatcggccccgttgtcaacgaagtcatcaaccaagcactaaccgacttcctcgaagaaaatccgaacgaagccaaaatcatcaccggcaaaatcgtcgatgccgcccgcgcacgcgaagccgcccgcaaagcccgcgaaatcacccgccgcaaaggcgtgatggacggcttgggactgcccggcaaactcgccgactgccaagaaaaagaccctgccctgtctgaactctacctcgtcgagggcgactccgcaggcggttccgccatgcagggccgcgaccgcaaattccaagcgattttgccgctcaaaggtaaaattttgaacgtcgaaaaagcacgttttgaaaaaatgctcgccagccaagaggtcgccaccctgattaccgcgctgggtgcaggcatcggcaaagaagagttcaaccctgaaaaactacgctaccaccgcatcatcatcatgaccgatgccgacgtggacggtgcgcacatccgcaccctgctcctgaccttcttctaccgccaaatgcccgaactggtcgagcgcggctacatttacatcgcccagccgccgctctacaaagccaaatacggcaagcaggagcgttacctcaaagacgaactggaaaaagaccaatggctgctcggccttgccttggaaaaagccaaaatcgtttcagacggccgcaccatcgaaggcgcagaacttgccgacaccgccaaacaattcttgttggcgaaaaccgtcatcgaacaggaaagccgcttcgtggacgaactcgtcctgcgtgccatgctgcacgcgtcgcccattgatttgacgtcgtctgaaaacgccgataaagccgttgccgaactttccggtttgcttgacgaaaaagaagccgccctcgaacgcatcgaaggtcatgaaggacaccggttcatcaaaatcacgcgcaagctgcacggcaacgtcatggtcagctacatcgaacccaagttcctcaacagcaaagcctaccaaaccctcacccaaaccgccgccgcgctcaaaggcttggtcggcgagggcgccaagctctacaaaggcgagaacgagtacgacgcggacagctttgaaaccgctttggacatcttgatgagcgttgcccaaaaaggtatgtccatccaacgatacaaaggtttgggcgagatgaaccccgagcagctttgggaaaccacgatggatcccgccgtgcgccgcctgttgaaagtgcgcatcgaagatgccattgccgccgacgaagtgttcgttaccctgatgggcgacgaggtcgaaccgcgccgcgcctttatcgaaaacaatgcgctgattgcgcaaaatatcgacgca

SEQ ID NO: 4588 - protein, 871 aa, Neisseria gonorrhoeae
VAKKRFCHFAGKFRARTGRKCAARPFRRHPDADNAESGGEIGYNTQLYAPSRPLFPQGADCFGGIAKSFQNPAKNMTEQKHEEYGADSIQVLEGLEAVRKRPGMYIGDTQDGSGLHHMVFEVLDNAIDEALAGHCDKITVTIHADHSVSVADNGRGMPTGIHPKEGRSAAEVIMTVLHAGGKFDNNSYKISGGLHGVGVSVVNALSDWVTLTIYRDGKEHFVRFVRGETEEPLKIVGDSDKKGTTVRFLAGTETFGNIEYSFDILAKRIRELSFLNNGVDIELTDERDGKHESFALSGGVAGFVQYMNRKKTPLHEKIFYAFGEKDGMSVECAMQWNDSYQESVQCFTNNIPQRDGGTHLTALRQVMTRTINSYIEANEVAKKAKVETAGDDMREGLTCVLSVKLPDPKFSSQTKDKLVSGEIGPVVNEVINQALTDFLEENPNEAKIITGKIVDAARAREAARKAREITRRKGVMDGLGLPGKLADCQEKDPALSELYLVEGDSAGGSAMQGRDRKFQAILPLKGKILNVEKARFEKMLASQEVATLITALGAGIGKEEFNPEKLRYHRIIIMTDADVDGAHIRTLLLTFFYRQMPELVERGYIYIAQPPLYKAKYGKQERYLKDELEKDQWLLGLALEKAKIVSDGRTIEGAELADTAKQFLLAKTVIEQESRFVDELVLRAMLHASPIDLTSSENADKAVAELSGLLDEKEAALERIEGHEGHRFIKITRKLHGNVMVSYIEPKFLNSKAYQTLTQTAAALKGLVGEGAKLYKGENEYDADSFETALDILMSVAQKGMSIQRYKGLGEMNPEQLWETTMDPAVRRLLKVRIEDAIAADEVFVTLMGDEVEPRRAFIENNALIAQNIDA

SEQ ID NO: 4589 - DNA, 864 bp, Neisseria gonorrhoeae
ttgcgcggttgtctgaatggtggttcagacggccttctccccttcggtggacgttattctaacgccgctctccagattgtttgtttcaatgtgcagtccctgatacctgagcgatttaagggtgtctgcgccttcggtggttacattgtagttgggtgtaacactctcctgcacatttcccgattatgtcttgaatcggcggtttgggcaagccgtcttaaaagagatgcaaaccgaccgcctctgttttcacatgattttccgaaaacaaaatttgtcccggatgacggtataactttttatatgttaatatggtctccatctatgcggattgccgcaaacacacggacagacaatccgaattccttaaaacggaacgcaaatatgccccaactcactttagacaaaaccgatattaaaatcttacaggtcctccaggaaaacggcaggctgaccaatgtcgaactgtccgaacgtgtcgcactttcgccttctccgtgcctgcgccgtctgaagcagttggaagatgccggcatcgtccgccaatatgccgcgctgctgtctccggaatccgtcaacttaggtcttcaggcatttatccgcgtttccatccgcaaagcaaaagacgcgcgggaagattttgccgcatcggttcgaaaatggccggaagtcttgagctgcttcgccctaaccggcgagaccgactacctgcttcaggcattttttaccgatatgaacgcgttttcccattttgttttggatacgcttttatcccaccacggcgtacaggatgcgcaatcgagctttgttttaaaagaaatcaaacacaccacctccctgccgctcaaccacctgctgaaggaa

SEQ ID NO: 4590 - protein, 288 aa, Neisseria gonorrhoeae
LRGCLNGGSDGLLPFGGRYSNAALQIVCFNVQSLIPERFKGVCAFGGYIVVGCNTLLHISRLCLESAVWASRLKRDANRPPLFSHDFPKTKFVPDDGITFYMLIWSPSMRIAANTRTDNPNSLKRNANMPQLTLDKTDIKILQVLQENGRLTNVELSERVALSPSPCLRRLKQLEDAGIVRQYAALLSPESVNLGLQAFIRVSIRKAKDAREDFAASVRKWPEVLSCFALTGETDYLLQAFFTDMNAFSHFVLDTLLSHHGVQDAQSSFVLKEIKHTTSLPLNHLLKE

SEQ ID NO: 4591 - DNA, 297 bp, Neisseria gonorrhoeae
ttgaaacggcattgtttttcgtggtataaatcgcgttttactattttagaagtttggagactgattatggcacgagtttgcaaagtgaccggtaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcattgcgtaccatcgacaaagtaggcattgatgtcgtattggctgatttgcgtgctcgcggcgaagct

SEQ ID NO: 4592 - protein, 99 aa, Neisseria gonorrhoeae
LKRHCFSWYKSRFTILEVWRLIMARVCKVTGKRPMSGNNVSHANNKTKRRFLPNLQSRRFWVESENRWVRLRVSNAALRTIDKVGIDVVLADLRARGEA

SEQ ID NO: 4593 - DNA, 789 bp, Neisseria gonorrhoeae
atgaacaaaaccctctatcgtgtgattttcaaccgcaaacgcggtgctgtggtagctgttgccgaaaccaccaagcgcgaaggtaaaagctgtgccgatagtggttcgggcagcgtttatgtgaaatccgtttctttcattcctactcattccaaagccttttgtttttctgcattaggcttttctttatgtttggctttgggtacggtcaatattgcttttgctgacggcattattactgataaagctgctcctaaaacccaacaagccacgattctgcaaacaggtaacggcataccgcaagtcaatattcaaacccctacttcggcaggggtttctgttaatcaatatgcccagtttgatgtgggtaatcgcggggcgattttaaacaacagtcgcagcaacacccaaacacagctaggcggttggattcaaggcaatccttggttgacaaggggcgaagcacgtgtggttgtaaaccaaatcaacagcagccatccttcacaactgaatggctatattgaagtgggtggacgacgtgcagaagtcgttattgccaatccggcagggattgcagtcaatggtggtggttttatcaatgcttcccgtgccactttgacgacaggccaaccgcaatatcaagcaggagactttagcggctttaagataaggcaaggcaatgctgtaatcgccggacacggtttggatgcccgtgataccgatttcacacgtattcttgtatgccaacaaaatcaccttgatcagtacggccgaacaagcaggcattcg

SEQ ID NO: 4594 - protein, 263 aa, Neisseria gonorrhoeae
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILVCQQNHLDQYGRTSRHS

SEQ ID NO: 4595 - DNA, 108 bp, Neisseria gonorrhoeae
ttgtatcgtgccattcgtattatcaatgacaacggtagattgctgaccatcgtgaataatcagttgttgattggtcgctatttcgccattttgattgttcaggctgcc

SEQ ID NO: 4596 - protein, 36 aa, Neisseria gonorrhoeae
LYRAIRIINDNGRLLTIVNNQLLIGRYFAILIVQAA

SEQ ID NO: 4597 - DNA, 1611 bp, Neisseria gonorrhoeae
gtgataccgatttcacacgtattcttgtatgccaacaaaatcaccttgatcagtacggccgaacaagcaggcattcgtaatcaagggcagttgtttgcttcttccggtaatgtggcgattgatgcaaatggccgtttggtcaatagtggcacgatggctgccgccaatgtgcaagatatgaataatacagcggaacacaaagtcaatatccgcagtcaagcctttgaaaacagcggtacggcggtatcgcaacaaggcactcaaattcacagtcaatcgattcaaaacactggcaaattattgtcggcaggaacagaggatttagccgtttcaggcagcctgaacaatcaaaatggcgaaatagcgaccaatcaacaactgattattcacgatggtcagcaatctaccgttgtcattgataatacgaatggcacgatacaatcaggccgtgatgttgccattcaggcaaaatcgttatccaacaacggcacacttgccgctgataataaactggatattgcgttacaagatgatttttatgtagaacgcaagatcgtggcgggcaatgaattgtcgctcagtacacgaggcagcctgaaaaattcacataccttgcaagcaggaaaacgcattcggattaaagcaaataaccttgataatgcagtacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgcgaaaacctgaatttaggcattgaacaattaaataaccgtgaaaacagtctgatttacagcggtaacgatatggcggttggcggcgcattagataccaatgaccaagccacaggcaaagcccaaaggatacacaatgccggcgcaatcattgaagctgcaggcaaaatgcgtttaggtgtagaaaagctgcacaataccaatgagcatttgaaaacgcagttggtagaaacagggcgcgagcgtattgttgattacgaagcatttggacgacacgaattattgcgagaaggcacgcaacatgaattaggctggtttgtctacaacaatgaatcagaccacttacgcacccctgatggagtggcgcatgaaaattggcataaatacgattatgaaaaagtaacgcaagaaactcaagtaaccggaactgcgcctgctaaaatcattgcaggtagcgatttgattattgatagcaaagcagtcttcaacagcgacagccgaatcattgccggcggcaattgcttgtgcaaacagaaaaagacggtttgcataacgagcaaacctttggcgagaagaaagtcttcagcgaaaatggtaagttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcat

SEQ ID NO: 4598 - protein, 537 aa, Neisseria gonorrhoeae
VIPISHVFLYANKITLISTAEQAGIRNQGQLFASSGNVAIDANGRLVNSGTMAAANVQDMNNTAEHKVNIRSQAFENSGTAVSQQGTQIHSQSIQNTGKLLSAGTEDLAVSGSLNNQNGEIATNQQLIIHDGQQSTVVIDNTNGTIQSGRDVAIQAKSLSNNGTLAADNKLDIALQDDFYVERKIVAGNELSLSTRGSLKNSHTLQAGKRIRIKANNLDNAVQGNIQSGGTTDIGTQHNLTNRGLIDGQQTKIQAGQMNNIGTGRIYGDNIAIAATRLDNQDENGTGAAIAARENLNLGIEQLNNRENSLIYSGNDMAVGGALDTNDQATGKAQRIHNAGAIIEAAGKMRLGVEKLHNTNEHLKTQLVETGRERIVDYEAFGRHELLREGTQHELGWFVYNNESDHLRTPDGVAHENWHKYDYEKVTQETQVTGTAPAKIIAGSDLIIDSKAVFNSDSRIIAGGNCLCKQKKTVCITSKPLARRKSSAKMVSCTTTGVRVVKDMMKQGIVNKIILCRRKSHATFHWVHLPMNRIAKH

SEQ ID NO: 4599 - DNA, 210 bp, Neisseria gonorrhoeae
ttgggtttgatgataggtttcgctttggctttgagtttgggttgtaccaatgcgaacatgattgcctgcttgaatccgggtgccattatcggaaataacattactgccaaggatgttggcatcgtttcctgcctgcaatacaacttgcttgccttcaaaggtgctgctttgagcagtttcgtgatgactttgggctttatcggtaatgac

SEQ ID NO: 4600 - protein, 70 aa, Neisseria gonorrhoeae
LGLMIGFALALSLGCTNANMIACLNPGAIIGNNITAKDVGIVSCLQYNLLAFKGAALSSFVMTLGFIGND

SEQ ID NO: 4601 - DNA, 2082 bp, Neisseria gonorrhoeae
ttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcattaagccgtcatgcgcccagccaaggcactgagttgccacaaagtaaccgggataatatccgtactgcgaaaagcaacggtatttcgctaccctatacgcccaattcttttaccccattacccggcagcagcttatacattatcaatcctgccaataaaggctatcttgttgaaaccgatccacgctttgccaactaccgtcaatggttgggtagtgactatatgctgggcagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagcagcgcaactgaccagcgatattgtttggttggtacaaaaagaagttaaacttcctgatggcggcacacaaaccgtattgatgccacaggtttatgtacgcgttaaaaatggcggcatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcattctttctgccgaacagacattattgctcaatgcgggtaacaacatcaacaaccaaagcacggccaagagcagtcaaaatgcacaaggtagcagcacctacctagaccgaatggcaggtatttatatcacaggcaaagaaaaaggtgttttagcagcgcaggcaggcaaagacatcaacatcattgccggtcaaatcagcaatcaatcagatcaagggcaaacccggctgcaggcaggacgcgacattaacctggatacggtacaaaccggcaaatatcaagaaatccattttgatgccgataaccataccatccgaggttcaacgaacgaagtcggcagcagcattcaaacaaaaggcgatgttaccctattgtcagggaataatctcaatgccaaagctgccgaagtcggcagcgcaaaaggcacacttgccgtgtatgctaaaaatgacattactatcagctcaggcatccatgccggccaagttgatgatgcgtccaaacatacaggcagaagcggcggcggtaataaattagtcattaccgataaagcccaaagtcatcacgaaactgctcaaagcagcacctttgaaggcaagcaagttgtattgcaggcaggaaacgatgccaacatccttggcagtaatgttatttccgataatggcacccggattcaagcaggcaatcatgttcgcattggtacaacccaaactcaaagccaaagcgaaacctatcatcaaacccaaaaatcaggattgatgagtgcaggtatcggcttcactattggcagcaagacaaacacacaagaaaaccaatcccaaagcaacgaacatacaggcagtaccgtaggcagcctgaaaggcgataccaccattgttgcaagcaaacactacgaacaaaccggcagcaacgtttccagccctgagggcaacaaccttatcagcacgcaaagtatggatattggcgcagcacaaaaccaattaaacagcaaaaccacccaaacctacgaacaaaaaggcttaacggtggcattcagttcgcccgttaccgatttggcacaacaagcgattgccgtagcacacaaagcagcaaacaagtcggacaaagcaaaaacgaccgcgttaatgccatggcggctgccaatgcaggttggcaggcctatcaaacaggcaaaggcgcacaaaact

SEQ ID NO: 4602 - protein, 694 aa, Neisseria gonorrhoeae
LHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVAFSSPVTDLAQQAIAVAHKAANKSDKAKTTALMPWRLPMQVGRPIKQAKAHKT

SEQ ID NO: 4603 - DNA, 270 bp, Neisseria gonorrhoeae
atggcggctgccaatgcaggttggcaggcctatcaaacaggcaaaggcgcacaaaacttagccaatggtacaaccaatgccaaacaagtcagcatctccataacctacggcgaacagcaaaaccgacaaaccacccaagttcaagccaatcaagcccaagcgagtcaaattcaagcaggcggcaaaactacccttattgccgaaggtgcggcgaacaatccaatatcaacatcacaggctcaggtgtttcaggcagagcaggaaccggcc

SEQ ID NO: 4604 - protein, 90 aa, Neisseria gonorrhoeae
MAAANAGWQAYQTGKGAQNLANGTTNAKQVSISITYGEQQNRQTTQVQANQAQASQIQAGGKTTLIAEGAANNPISTSQAQVFQAEQEPA

SEQ ID NO: 4605 - DNA, 249 bp, Neisseria gonorrhoeae
ttgggtgccagcgttgccgtaagcggcaaaacactgggacagggcgcaaaaaataaacctcaagacaaacacctgacaagcatagccgataaaaacggcgcaagttcatcagtagggtacggcagcgacagcgacagtcaaagcagcatcacaaaaagcggcatcaatacccaaaaacattcaaatcacagacgaagccgcacaaatcaggctgacaggcaaaatagcggcacaaaccaaagccgatat

SEQ ID NO: 4606 - protein, 83 aa, Neisseria gonorrhoeae
LGASVAVSGKTLGQGAKNKPQDKHLTSIADKNGASSSVGYGSDSDSQSSITKSGINTQKHSNHRRSRTNQADRQNSGTNQSRY

SEQ ID NO: 4607 - DNA, 444 bp, Neisseria gonorrhoeae
gtgcaaagtgaactggatttacaaagaaccgtcagccaagattttagtaaaaatgttcaacaaaccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgagccgacccaaagcggagcgggcatcgctgcggctaccgcatcgccagacgtatcgtatgcgattggacagcactttaaagatttagccggtcaaaacgcgaatggcaaactaaccgccagtcaagaaaccgctcacgttcttgcccacgcggtattaggagcagcggttgccgcagca

SEQ ID NO: 4608 - protein, 148 aa, Neisseria gonorrhoeae
VQSELDLQRTVSQDFSKNVQQTNTEINQHLDKLKADKEAAETAAAEALANGDMETAKRKAHEAQDAAAKADNWQQGKVILNMLASGLAEPTQSGAGIAAATASPDVSYAIGQHFKDLAGQNANGKLTASQETAHVLAHAVLGAAVAAA

SEQ ID NO: 4609 - DNA, 231 bp, Neisseria gonorrhoeae
ttgggtgcgggcgggtcggaagcggccgccccaatcatcggcaaatggctgtacggcaaaggagacggcggcagcctgaatgcggaggaaaaagagaccgtttcggcgattacaaggatgctgggtacggctgccggagcagctgagggaaactcgtccgccgatgctgtgtggggttgttttcagacggcttcagatttcgcttcctctttttcatatcctataaacatg

SEQ ID NO: 4610 - protein, 77 aa, Neisseria gonorrhoeae
LGAGGSEAAAPIIGKWLYGKGDGGSLNAEEKETVSAITRMLGTAAGAAEGNSSADAVWGCFQTASDFASSFSYPINM

SEQ ID NO: 4611 - DNA, 1647 bp, Neisseria gonorrhoeae
ttgggaaaccacgatggatcccgccgtgcgccgcctgttgaaagtgcgcatcgaagatgccattgccgccgacgaagtgttcgttaccctgatgggcgacgaggtcgaaccgcgccgcgcctttatcgaaaacaatgcgctgattgcgcaaaatatcgacgcataagtgccgttttaaaaaaggagacgggcagcttgccgcgtctccttttggtttgtcaaacggaagccatgccgtctgaaaccgcctttcggagcaaaaccatgatcagcatttttgatattttcaaaatcggtatcggcccttccagttcgcatacggtcggcccgatgaaggccgccgccgcctttgccgcaggcttggacgcgcaaaccgcccgcatcgccatcgacatttacggctcgcttgccctgaccggatacggacacggcacatttgacgcgctgatgctcggtttggaaggcagcctgccgcacgacatcccgcttgccggcattcccgaacgcctcggacgcatccgcacgcagcacatcctccggctcaacgggcaagaaatccgcttcatccccgaccgcgacctgaacatacgcggcaatcaagtgctgcccaaacaccccaacggcctgcgatttaccgcctatgcttcagacggcacggtattgaaggaacaggtttattattcggtcggcggcggctttgtcgttaccgaagaagacttcgagtggcagtcggaaacggaaaaagccgttccttatccttacaacagttgtgccgggctgcttgcccgatgccgtctgaaccggctcgacatctccgaagtcgtgttggcaaacgaagccgcgcttgccggatgcggcgaagccgaaatccgccgccgggttgccggtgttgccgagattatggaagagtgcatcaaacggggcttaaacgcaggcggcgaactgcccggcggattgaacgtccgccgccgcgccccgcagcttgccgccaaactcaaagtcctgcgcgaaaccgaaatcgtcaacacccggctctggccgatggtgtacgccatggcggtcaacgaagaaaacgccgccggcggacgcgtcgttaccgccccgaccaacggcgcggcaggcatcattcccgccgtattgcattatttccgcaagttcaacccccacgccacacaggaacgtgtcgaaaacttcctgctcaccgcaggcgcaatcggcatcctctacaaaaccaacgcctccatttccggcgcggatgtcggttgtcagggcgaagtcggcgtagcgtgttcaatggcggcgggtgcatacgccgaagtcatcggcggcacgcccaaacaagtggaaaacgccgccgaaatggcaatggaacaccatttgggcttaacttgcgaccccgtcggcgggttggtgcaaatcccctgcatcgaacgcaacggcatcgccgccgaaaaagccctcaaactcggcacgctcgcgctcttggaagacggcacggacaaaaaagtctcgctcgacgaagtcatccgaaccatgctgcaaaccggccgggacatgaaggcgacctacaaagaaacctcgcttgccggactcgccgccacgctccggaaaaaagccgtccccgtatccgtgcgcgtggtcgagtgc

SEQ ID NO: 4612 - protein, 549 aa, Neisseria gonorrhoeae
LGNHDGSRRAPPVESAHRRCHCRRRSVRYPDGRRGRTAPRLYRKQCADCAKYRRISAVLKKETGSLPRLLLVCQTEAMPSETAFRSKTMISIFDIFKIGIGPSSSHTVGPMKAAAAFAAGLDAQTARIAIDIYGSLALTGYGHGTFDALMLGLEGSLPHDIPLAGIPERLGRIRTQHILRLNGQEIRFIPDRDLNIRGNQVLPKHPNGLRFTAYASDGTVLKEQVYYSVGGGFVVTEEDFEWQSETEKAVPYPYNSCAGLLARCRLNRLDISEVVLANEAALAGCGEAEIRRRVAGVAEIMEECIKRGLNAGGELPGGLNVRRRAPQLAAKLKVLRETEIVNTRLWPMVYAMAVNEENAAGGRVVTAPTNGAAGIIPAVLHYFRKFNPHATQERVENFLLTAGAIGILYKTNASISGADVGCQGEVGVACSMAAGAYAEVIGGTPKQVENAAEMAMEHHLGLTCDPVGGLVQIPCIERNGIAAEKALKLGTLALLEDGTDKKVSLDEVIRTMLQTGRDMKATYKETSLAGLAATLRKKAVPVSVRVVEC

SEQ ID NO: 4613 - DNA, 147 bp, Neisseria gonorrhoeae
atgcagaagctcccgaaatccgctataatcgcgccccatctgtttcgcacctgcaaacgttccgcagatgcggcactcgggcggcttacccgcgcaaaacatctgtttttctttaaaacacttgaaacggcattgtttttcgtggta

SEQ ID NO: 4614 - protein, 49 aa, Neisseria gonorrhoeae
MQKLPKSAIIAPHLFRTCKRSADAALGRLTRAKHLFFFKTLETALFFVV

SEQ ID NO: 4615 - DNA, 120 bp, Neisseria gonorrhoeae
gtggggttgttttcagacggcttcagatttcgcttcctctttttcatatcctataaacatgtgattaaattttcatttatggagtttttttatctttttgtttgtttttgtgcattgcta

SEQ ID NO: 4616 - protein, 40 aa, Neisseria gonorrhoeae
VGLFSDGFRFRFLFFISYKHVIKFSFMEFFYLFVCFCALL

SEQ ID NO: 4617 - DNA, 789 bp, Neisseria gonorrhoeae
ttgtgcattgctataattgcccgcttacattacttagaccaatcctatgaaacctttcttttcctccaaaaatgtatttcatccctatcccttatcactgttagtcctatcattgatggctgcctccccaccctaacatcagccgcccccacacctgaagctgtttcacaacaacaggatattctccaacgtcaacgtgagaagcaattgcgtgaacagatgcagccggaacaagatgttcgtttggatggtaccgatacgggcatagagaagatggcaacacaggtaggcggtgcaaattcggatgaggcaagcccctgctttcctatttctgaggtggaattggtgggtgaagaagcggctaaattccggtttgcgctcaaccatgccttgtgccaaacacattttgtttccggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcgg

SEQ ID NO: 4618 - protein, 263 aa, Neisseria gonorrhoeae
LCIAIIARLHYLDQSYETFLFLQKCISSLSLITVSPIIDGCLPTLTSAAPTPEAVSQQQDILQRQREKQLREQMQPEQDVRLDGTDTGIEKMATQVGGANSDEASPCFPISEVELVGEEAAKFRFALNHALCQTHFVSGKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWR

SEQ ID NO: 4619 - DNA, 1038 bp, Neisseria gonorrhoeae
gtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttt

SEQ ID NO: 4620 - protein, 346 aa, Neisseria gonorrhoeae
VSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 4621 - DNA, 366 bp, Neisseria gonorrhoeae
atgtatgacaagatacacaaaagctgccggttttttgcaggcagcttttgttttatgtttggggctgtaccggacaaccgggtcaaatttccattagctcattattttaaaattgaaattttatattttatttcactgttgttaaaacgctgttcacatttcttcatcggttttatcattcatcaccttatttacggcttctggagacaggggcttaccgcatttgctgcagtaatcgatttttggaacaggggaaatgcctttaaagaaagtaaagctatccgacccgatgccgacggaggtgccataattcatcttttggaattcgtggcaataggggcagattcctgcgatgattatgtagga

SEQ ID NO: 4622 - protein, 122 aa, Neisseria gonorrhoeae
MYDKIHKSCRFFAGSFCFMFGAVPDNRVKFPLAHYFKIEILYFISLLLKRCSHFFIGFIIHHLIYGFWRQGLTAFAAVIDFWNRGNAFKESKAIRPDADGGAIIHLLEFVAIGADSCDDYVG

SEQ ID NO: 4623 - DNA, 246 bp, Neisseria gonorrhoeae
gtgatatatttcagtttcggaggtatcataattttatcctacataatcatcgcaggaatctgcccctattgccacgaattccaaaagatgaattatggcacctccgtcggcatcgggtcggatagctttactttctttaaaggcatttcccctgttccaaaaatcgattactgcagcaaatgcggtaagcccctgtctccagaagccgtaaataaggtgatgaatgataaaaccgatgaagaaatg

SEQ ID NO: 4624 - protein, 82 aa, Neisseria gonorrhoeae
VIYFSFGGIIILSYIIIAGICPYCHEFQKMNYGTSVGIGSDSFTFFKGISPVPKIDYCSKCGKPLSPEAVNKVMNDKTDEEM

SEQ ID NO: 4625 - DNA, 153 bp, Neisseria gonorrhoeae
atgatacctccgaaactgaaatatatcacaaatattatttacataattgttatttgcagaaaattagaacccgttatcacgtcttggataaatgccaaaaccactgtgattccgagaattaaaaagaaaaatttcggaatcctcatccttttc

SEQ ID NO: 4626 - protein, 51 aa, Neisseria gonorrhoeae
MIPPKLKYITNIIYIIVICRKLEPVITSWINAKTTVIPRIKKKNFGILILF

SEQ ID NO: 4627 - DNA, 168 bp, Neisseria gonorrhoeae
atgaacacaaacttaaatgacaaagacaaagccatggataccgcaatcaggtttcagaaaaggatgaggattccgaaatttttctttttaattctcggaatcacagtggttttggcatttatccaagacgtgataacgggttctaattttctgcaaataacaattatg

SEQ ID NO: 4628 - protein, 56 aa, Neisseria gonorrhoeae
MNTNLNDKDKAMDTAIRFQKRMRIPKFFFLILGITVVLAFIQDVITGSNFLQITIM

SEQ ID NO: 4629 - DNA, 117 bp, Neisseria gonorrhoeae
ttgtctttgtcatttaagtttgtgttcatgtttttgaccctctttgtttctaaaatcctttttaaattgccgactttttccgttccaaatgtcccatttgaacattatcccgctgcc

SEQ ID NO: 4630 - protein, 39 aa, Neisseria gonorrhoeae
LSLSFKFVFMFLTLFVSKILFKLPTFSVPNVPFEHYPAA

SEQ ID NO: 4631 - DNA, 1899 bp, Neisseria gonorrhoeae; identical to SEQ ID NO: 3439

SEQ ID NO: 4632 - protein, 633 aa, Neisseria gonorrhoeae; identical to SEQ ID NO: 3440

SEQ ID NO: 4633 - DNA, 363 bp, Neisseria gonorrhoeae
ttgtattgtttgttcaaaggaaattttatgaaaaaaatcgaggcgattgtcaaaccgttcaagctcgacgacgtgcgcgaggcgttgacggaaatcggcattacgggcatgaccgtcagcgaggtcaaagggttcggcaggcagaaggggcatacggaaatctatcgcggtgcggaatacgccgtcgatttcctgcccaaggtcaaaatcgagttggtgttggcggatgatgccgtggaacgcgcgattgacgtgattgtcgaggtggcgcgttcgggcaaaatcggcgacggcaagatttttgtgctgccggtcgaggaggcaatccgtatccgcacgggcgaacgttcggacgcggcggtt

SEQ ID NO: 4634 - protein, 121 aa, Neisseria gonorrhoeae
LYCLFKGNFMKKIEAIVKPFKLDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 4635 - DNA, 126 bp, Neisseria gonorrhoeae
atgaatttgggtcgtattttaggcagcgggataatgttcaaatgggacatttggaacggaaaaagtcggcaatttaaaaaggattttagaaacaaagagggtcaaaaacatgaacacaaacttaaa

SEQ ID NO: 4636 - protein, 42 aa, Neisseria gonorrhoeae
MNLGRILGSGIMFKWDIWNGKSRQFKKDFRNKEGQKHEHKLK

SEQ ID NO: 4637 - DNA, 1047 bp, Neisseria gonorrhoeae
ttgatattaatgaacacacccatccccttctccgaacggctcatccgctggcaaaaacaacacggtcgccaccacctcccttggcaggtcaaaaacccttattgcgtctggctttccgaaatcatgctccagcaaacgcaggtcgccgccgtgttggactactatccgcgtttcttggaaaaattcccgaccgttcagacgcttgccgccgcgccgcaagacgaagtgttgtcgttgtgggcgggcttgggctattacggccgcgcgcgcaatctgcacaaagccgcgcaacaaatcgtcggacaattcggcggtacgtttccatcggagcgcaaagacttggaaacgctctgcggcgtaggcagaagcaccgccgccgccatttctgcctttgctttcaaccgacgagaaaccatcttggacggcaacgtcaaacgcgttctctgccgtgtttttgcccaagacggcaatccgcaagataaaaaatttgaaaactcgctctggacacttgccgaaagcctgatgccgtctgaaaacgccgatatgcctacttacacgcaaggtttgatggatttgggcgcgaccgtgtgcaaacggacgaaacccttgtgccgtcaatgccctatggcggacatctgcgaagcaaaaaagcaaaaccgcaccgccgagctgccgcgtaaaaaaactgccctcgaagtgcaaaccctgccgctttactggctgattgtccgcaaccgggacggcgcaatcttgctggaaaaacgcaccgccaaaggcatttggggcggactgtattgcgtgccgtgttttgaaagtttgaacgggctttccgactttgccgccaaactctccctgacgatggcggatatggacgaacaaaccgccctgacccaccgcctaacgcaccggctgctgatgattacgccgtttgaagggcaaatgccgtccgaacaccattcagacggcatttggataaagccgggccatttgaaagattacggcctgcccaagcctttggaaatttatttaaacggtaataggttagaa

SEQ ID NO: 4638 - protein, 349 aa, Neisseria gonorrhoeae
LILMNTPIPFSERLIRWQKQHGRHHLPWQVKNPYCVWLSEIMLQQTQVAAVLDYYPRFLEKFPTVQTLAAAPQDEVLSLWAGLGYYGRARNLHKAAQQIVGQFGGTFPSERKDLETLCGVGRSTAAAISAFAFNRRETILDGNVKRVLCRVFAQDGNPQDKKFENSLWTLAESLMPSENADMPTYTQGLMDLGATVCKRTKPLCRQCPMADICEAKKQNRTAELPRKKTALEVQTLPLYWLIVRNRDGAILLEKRTAKGIWGGLYCVPCFESLNGLSDFAAKLSLTMADMDEQTALTHRLTHRLLMITPFEGQMPSEHHSDGIWIKPGHLKDYGLPKPLEIYLNGNRLE

SEQ ID NO: 4639 - DNA, 90 bp, Neisseria gonorrhoeae
atgttattgtataaaattgtgaaaataattcttattgacttattttttgtaggggcatataactcatataaagaaactttattgtggtat

SEQ ID NO: 4640 - protein, 30 aa, Neisseria gonorrhoeae
MLLYKIVKIILIDLFFVGAYNSYKETLLWY

SEQ ID NO: 4641 - DNA, 1014 bp, Neisseria gonorrhoeae
atgaaagcaatggtttatcacggcgcaaacgacatccgttttgaagaaaaaccccgcccgcagattatcgatccgaccgatgcggtggtgaaaatcgtcaaaaccacgatttgcggtaccgacttgggtatttggaaaggcaaaaaccccgaagtcgccgacggtcgtatcctcggtcatgaaggcatcggtattgtagaagaagtcggcgaggctgtaaaaaacatcaaagtcggcgataaagtcattatttcatgcgtcagcaaatgctgcacttgcgacaactgcaaaatccaactttattcgcactgccgcaacggcggctggattttgggctatatgattgacggcacgcaggccgaatacgtccgcacgccttatgccgacaacagcctcgtgccgccgcacgacaacgtcaacgaagaaatcgccctgctgttgagcgacgctttaccgaccgcccacgaaatcggcgtgcaatacggcgatgtgaaacccggcgataccgtattcatcgcaggtgccggccctgtcggtatgtccgccttgttgaccgcccaactgtatagccctgccgccattatcgtgtgcgatatggacgaaaaccgtttgaaaccggcgaaagagttgggcgcgacccataccatcagccccgcttccggcgacgtctccaaacaagttttcgccatcgtcggcgaagacggcgtagattgtgccatcgaagcggtcggtatccctgcaacttggaatatgtgccaagacatcgtgaaacccggcggtcatatcgccgtcgtcggcgtacacggtcaatccgttgatttcaaactggaaaaactgtggattaaaaatcttgccatcactaccggtttggtcaatgccaacaccaccgaaatactgatgaaggcaattttcagcagctcagtggattacaccaaaatgttgacccaccgtttcaaattcagccaattggaaaagcctacgacgtgttcaaacacgccgccgaaaaccaagcga

SEQ ID NO: 4642 - protein, 338 aa, Neisseria gonorrhoeae
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKIQLYSHCRNGGWILGYMIDGTQAEYVRTPYADNSLVPPHDNVNEEIALLLSDALPTAHEIGVQYGDVKPGDTVFIAGAGPVGMSALLTAQLYSPAAIIVCDMDENRLKPAKELGATHTISPASGDVSKQVFAIVGEDGVDCAIEAVGIPATWNMCQDIVKPGGHIAVVGVHGQSVDFKLEKLWIKNLAITTGLVNANTTEILMKAIFSSSVDYTKMLTHRFKFSQLEKPTTCSNTPPKTKR

SEQ ID NO: 4643 - DNA, 219 bp, Neisseria gonorrhoeae
ttgcaaaattccttttcttcaaacagccgacatccaaccacaggtttttcggctgttttcgtttcaaataaccgccgttcccaccaaaatatcccattaatcccccttaaatatagtggattaaatttaaaccagtacggcgttacctcgccttgccgtactattttactgtctgcggcttcgttgccttgtcctgatttaaatttaatccactatacc

SEQ ID NO: 4644 - protein, 73 aa, Neisseria gonorrhoeae
LQNSFSSNSRHPTTGFSAVFVSNNRRSHQNIPLIPLKYSGLNLNQYGVTSPCRTILLSAASLPCPDLNLIHYT

SEQ ID NO: 4645 - DNA, 183 bp, Neisseria gonorrhoeae
atgggatattttggtgggaacggcggttatttgaaacgaaaacagccgaaaaacctgtggttggatgtcggctgtttgaagaaaaggaattttgcaaaggtctctgagcgttattttttaacgacggttaacttgttagtttcagccgctcatcacggcattttaccgatagggcgattttta

SEQ ID NO: 4646 - protein, 61 aa, Neisseria gonorrhoeae
MGYFGGNGGYLKRKQPKNLWLDVGCLKKRNFAKVSERYFLTTVNLLVSAAHHGILPIGRFL

SEQ ID NO: 4647 - DNA, 168 bp, Neisseria gonorrhoeae
ttgccgcttggcgactcagtcggcatacacagcagcaccgcccctaaaatgcccatccatctccagaacaatgcgaatgacgcgcgatatgcggagacctatgacgaaaaaataattataatatatttatcaattagtcataaaaatcgccctatcggtaaaatgccg

SEQ ID NO: 4648 - protein, 56 aa, Neisseria gonorrhoeae
LPLGDSVGIHSSTAPKMPIHLQNNANDARYAETYDEKIIIIYLSISHKNRPIGKMP

SEQ ID NO: 4649 - DNA, 96 bp, Neisseria gonorrhoeae
ccgcttcaacgccaacgtcaacacgcccgccgtaaccagccccaagcctatccattcctgcgtgttcgggcgttcgtccaagaaaaccaccgccat

SEQ ID NO: 4650 - protein, 32 aa, Neisseria gonorrhoeae
PLQRQRQHARRNQPQAYPFLRVRAFVQENHRH

SEQ ID NO: 4651 - DNA, 591 bp, Neisseria gonorrhoeae
gtgcctgtgatggcgattgacgacttaagcaccgccgtcgatttgtcccgcgcccttgtcgaaggcggcatccccaccctcgaaattaccttgcgcacccccgtcggactcgaggccatccgcctgattgccaaagaaatgcccaacgccatcatcggcgcaggtacggtaaccaatcccgaacagctcaaagccgtcgaagacgcaggcgcggttttcgccatcagcccgggtttgcacgaatccctcgccagagccggccgcaacagcggcattcccctgattcccggcgttgccactccgggcgaagtccaactggctttggaacacggcatcgacacactcaaactcttccctgccgaagtcgttggcggcaaagcgatgctcaaagccctctacggaccttacgccgacgtacgcttctgcccgaccggcggcatcagcctcgccactgcgcccgattacttggcattgcccaacgtcttatgcgtcggcggctcttggctgacaccgaaagaagccgtgaaaaacaaagactgggacaccatcacccgcctcgccaaagaagcggcggcattgaaacccaaagcc

SEQ ID NO: 4652 - protein, 197 aa, Neisseria gonorrhoeae
VPVMAIDDLSTAVDLSRALVEGGIPTLEITLRTPVGLEAIRLIAKEMPNAIIGAGTVTNPEQLKAVEDAGAVFAISPGLHESLARAGRNSGIPLIPGVATPGEVQLALEHGIDTLKLFPAEVVGGKAMLKALYGPYADVRFCPTGGISLATAPDYLALPNVLCVGGSWLTPKEAVKNKDWDTITRLAKEAAALKPKA

SEQ ID NO: 4653 - DNA, 135 bp, Neisseria gonorrhoeae
ttgtctgaaaacttaaccccccccatcccgtttgacctcaacaaaaacgacaccccccacttggagaaccgaaatgtccaaactgaccccccgcgaaatcctgaccgccggcgcagttgtgcctgtgatggcgat

SEQ ID NO: 4654 - protein, 45 aa, Neisseria gonorrhoeae
LSENLTPPIPFDLNKNDTPHLENRNVQTDPPRNPDRRRSCACDGD

SEQ ID NO: 4655 - DNA, 1833 bp, Neisseria gonorrhoeae
atgaaccacactcctatccaccccaaactcgccgaaatcaccgggcgcattatcgaacgcagccgtccgacgcgtgaaaaatatctggcgaaaatccgcagtgccaaacagatgggacgcttagagcgcaaccagctcggctgcagcaatttggcgcacggctatgccgccatgcccaaaagcatcaaaatcgaaatgcttcaggaaaccgtccccaacttaggcatcatcactgcctacaacgacatggtttccgcacaccagccgtttaaagacttccctgaccaaatcaaagacgaagcacaaaaaaacggcgcgaccgcacaagtcgccggcggcacgcctgccatgtgcgacggcatcacgcaaggctacgccggcatggaattgtcactgttttcccgcgacgtgattgcgatgagtaccgccgtcgggctgtcgcaccaaatgtttgacggcagcctgtttatgggcgtgtgcgacaaaatcgttccgggtctgatgataggtgcgctttcgttcggtcatattcccggtatcttcgttccggcaggcccgatgtccagcggcatcggcaataaagaaaaagcccgtacccgccaacttttcgccgaaggcaaagtcggacgcgacgaacttttgaaaagcgaaatgggttcttaccacagcccgggcacctgcactttctacggcacggcaaactccaaccaaatgatgatggaaatgatgggcgtacacctgcctgccgccgcctttgtccacccctataccgacctgcgcgaagccctgacccgctacgccgccggacacctcgcgcgcggcatcaaaaacggcacgattaaacctttgggcgaaatgttgaccgaaaaatccttcatcaatgccctgatcggtttgatggcgaccggcggctcgaccaaccacaccatgcacctcgtcgctatggcgcgcgccgcaggcgtaattttgaactgggacgacttcgacgaaatttcttccatcatcccgctgctcatccgcgtgtatcccaacggcaaagccgacgtgaaccactttaccgcagcaggcggcctgcctttcgttatccgcgaattgctggacgcaggcttattgcacgacgatgtcgataccgtcgtcggacacggtatgcgccactacactaaagagcctttcctcatcgacggcaaactcgaatggcgcgaagcccccgagaccagcggcaacgacgacatcctgcgtaaagccgacaatccgttctccccggacggcggtctgcgcctgatgaaaggcaacatcggacgcggcgtggttaaagtgtcagccgtacgcgaaggctgccgcatcatcgaagcacccgccatcgtgttcaacgaccagcgcgaagtgttggcggcatttgaacgcggcgagttggaacgcgattttatctgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtcaggcaaagtgcccgcgtccatccacatgacgcccgaagccctgatgggcggcaacatcgccaaaatccgtaccggcgacctgattcgcttcgactccgttaccggcgaactcaacgtcctgattaacgaggccgaatggaacgtccgagaagtcgagcgcatcgatttgggcgcgaaccaacaaggctgcggccgcgaactcttcgccggcttccgcagtatgaccagcagtgcggaaaccggtgcgatgagcttcggcggagaatttgcc

SEQ ID NO: 4656 - protein, 611 aa, Neisseria gonorrhoeae
MNHTPIHPKLAEITGRIIERSRPTREKYLAKIRSAKQMGRLERNQLGCSNLAHGYAAMPKSIKIEMLQETVPNLGIITAYNDMVSAHQPFKDFPDQIKDEAQKNGATAQVAGGTPAMCDGITQGYAGMELSLFSRDVIAMSTAVGLSHQMFDGSLFMGVCDKIVPGLMIGALSFGHIPGIFVPAGPMSSGIGNKEKARTRQLFAEGKVGRDELLKSEMGSYHSPGTCTFYGTANSNQMMMEMMGVHLPAAAFVHPYTDLREALTRYAAGHLARGIKNGTIKPLGEMLTEKSFINALIGLMATGGSTNHTMHLVAMARAAGVILNWDDFDEISSIIPLLIRVYPNGKADVNHFTAAGGLPFVIRELLDAGLLHDDVDTVVGHGMRHYTKEPFLIDGKLEWREAPETSGNDDILRKADNPFSPDGGLRLMKGNIGRGVVKVSAVREGCRIIEAPAIVFNDQREVLAAFERGELERDFICVVRYQGPRANGMPELHKLTPPLGILQDRGFKVALLTDGRMSGASGKVPASIHMTPEALMGGNIAKIRTGDLIRFDSVTGELNVLINEAEWNVREVERIDLGANQQGCGRELFAGFRSMTSSAETGAMSFGGEFA

SEQ ID NO: 4657 - DNA, 255 bp, Neisseria gonorrhoeae
gtggataggagtgtggttcatgttcggtctcctggcggaacggggtggtattggggatttgtttgtgcgtttctgatttttgtatcgggtatgttagacggtgagtatagtggattaaatttaaaccggtccggcgttgcctcgccttgccgtactatttgtgctgtctgcggctcgccgccttgtcctgatttaaatttaattcactatattttaaaaggtacgccgtctgaaagtgggaagcgggtgctatta

SEQ ID NO: 4658 - protein, 85 aa, Neisseria gonorrhoeae
VDRSVVHVRSPGGTGWYWGFVCAFLIFVSGMLDGEYSGLNLNRSGVASPCRTICAVCGSPPCPDLNLIHYILKGTPSESGKRVLL

SEQ ID NO: 4659 - DNA, 1443 bp, Neisseria gonorrhoeae
atgagtacacagacaaattttgatttggtgttgttcggtgcgaccggcgatttggcaatgcgcaaacttttgccctgcctgtatcaggcgcatgttgccggtctgcttcatcccgaagggcgtattttgggggtcagccgcagcgagttggataccgaaggttttctggcgaaggtggaaaccagttccaaaatccatgtgaaagaaaatttttccggtgaggcgtgggcttcgtttgttgaacgtctcgcatatctcaaagtcgatgttacgcagccggacgattttgccgctttgggcgatttggtcaaagcacgcaaagaaaccgacaacgtcgtcatctatctgtccaccgcgccgaaattcttcgcgcaagcctgcgaaaaccttgctgcgatcggtttgaatgccgacaatgtgcgcgtggttttggaaaaaccgctgggtacggatttggcttcttcccaacaaatcaataccgatgtggcgcgttatttcaaagaagggcaaatttaccgcatcgaccactaccttggcaaagaaagcctgcaaaacctgcttgcgctgcgttttgccaatgtaatgttcgagccgctgtggaacaataaatacatcgaaagcgtgcagctgaccatcgccgaacagctcggtgtggaagagcgcggcgagttttacgacattaccggcgcgttgcgcgatatggtgcaaaaccatttgatgcagatgctgtgcatgactgcgatggaagcccccgccggcttggatgccgacgcggtgcgcgatgaaaaagtcaaagtcatcaagtcattgaagccgctgaccatcgaatctgtcaatgaaaatgtcgtgcgcggacaatataccgctgccaaaggcatgaacggctatcttgaagaaatcaacgttccgcaagacagctttaccgaaacctacgtcgccattaaagccgaaatcgaaaacgaacgctggaagggcgttcccttctacctgcgtaccggcaaacgcatggcgggcaaagtggcggaaatcgttttgaacttccgcccgctgcaaaaccatattttcgacaacagccaaaccgcgccgaaccgtttggttatcgagcttcaaccgaatgaatccgtccgcctttacacgcaggtgaaaaccccgggtgcgggcaacaaagtggaagtaacgcctttgggcgtggatttgggcaaggccgttgaaggccgccgcgccgaggcttacgaacgcctgctgttggatgtgattaacggcaaactcgctttgttcaaccgccgcgacgaactcgaagccgcgtgggaatatgtgatgccgattttggaaaactgggcaaataacaccacgccgccgcacggttacggcgcacactcttggggtcctgaagccgcccgcgaactgttggcgcgcgacggcaacaagtggcacgaagaacag

SEQ ID NO: 4660 - protein, 481 aa, Neisseria gonorrhoeae
MSTQTNFDLVLFGATGDLAMRKLLPCLYQAHVAGLLHPEGRILGVSRSELDTEGFLAKVETSSKIHVKENFSGEAWASFVERLAYLKVDVTQPDDFAALGDLVKARKETDNVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPAGLDADAVRDEKVKVIKSLKPLTIESVNENVVRGQYTAAKGMNGYLEEINVPQDSFTETYVAIKAEIENERWKGVPFYLRTGKRMAGKVAEIVLNFRPLQNHIFDNSQTAPNRLVIELQPNESVRLYTQVKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 4661 - DNA, 693 bp, Neisseria gonorrhoeae
atgtttgtttggcacgaatacgaaaatgcggcagaagcggcgcagtctttggctgacgcagtggcggatgctttgcagggcgcactggacgagaagggcggtgcggtgttggcagtttccggcggacgttcgccgattgcatttttcaacgccctgtcgcaaaaagatttggattggaaaaacgtcggaattaccttggcagatgaacgcatcgtgccgaccaaccacgccgacagcaataccggtctggtgcgcgaatacctgttaaagaacaaagccgctgcggcagtgtggattcctatggtggaagacggaaaaactgaaaccgaattacatcccgatgctgttgtcgattatgcgctgaaacattacaagcagcccgatgttttgattttgggtatgggaaacgacgggcatacggcttcgattttcccaaaagctccgcagtttcagacggcaatcgacggttcggcaggtgtcgcgctggtgcataccacgcccgttaccgcgccgcacgagcgcatcagcatgactttggatgcgattgcccatactgggcatgtatttttggcgatacagggcgaagagaaaaaagccgtgttcgaccaagccgcacaaggcgaaaaccgcgaatatccgatcagcctcgttttgaaccatcaaggagtgaactgccatgtcttctacgccgaa

SEQ ID NO: 4662 - protein, 231 aa, Neisseria gonorrhoeae
MFVWHEYENAAEAAQSLADAVADALQGALDEKGGAVLAVSGGRSPIAFFNALSQKDLDWKNVGITLADERIVPTNHADSNTGLVREYLLKNKAAAAVWIPMVEDGKTETELHPDAVVDYALKHYKQPDVLILGMGNDGHTASIFPKAPQFQTAIDGSAGVALVHTTPVTAPHERISMTLDAIAHTGHVFLAIQGEEKKAVFDQAAQGENREYPISLVLNHQGVNCHVFYAE

SEQ ID NO: 4663 - DNA, 594 bp, Neisseria gonorrhoeae
atgaatatcgatacttccgaaaataaagatgctgttgccgaacacaccggacaatggttggaaaaagccgtcatcggtctgaacctgtgtccctttgccaaagccccccacgttaaaaaccttgtccgcatcgcgatcagcgaagccaaacaccttgacggttttttggaagacttggacgaagaactgcagcgactgggcaatacacccgccaccgaactggaaaccaccctgctggttcacccgaccctattccccgatttcgacgtattcaacgatatgctcgacattgccgatgccgccgttgtcgaaaacggcttggaaggcatcgtccaaatcgccccgtttcatccctatttccaatttgaaggcacggattcagacggcatcggcaactacaccaaccgttctccctatccgacgctgcacctcatccgcgaagacagcattgccaaagccgcacaagcctttcccgacgcttcggcaatattcgaacgcaatatcgccctgctggaaaaaatgggacatgaaggctgggcaaaactcggtatcacatcctgcccttatccgcacaataagaaaaatatttcaaaa

SEQ ID NO: 4664 - protein, 198 aa, Neisseria gonorrhoeae
MNIDTSENKDAVAEHTGQWLEKAVIGLNLCPFAKAPHVKNLVRIAISEAKHLDGFLEDLDEELQRLGNTPATELETTLLVHPTLFPDFDVFNDMLDIADAAVVENGLEGIVQIAPFHPYFQFEGTDSDGIGNYTNRSPYPTLHLIREDSIAKAAQAFPDASAIFERNIALLEKMGHEGWAKLGITSCPYPHNKKNISK

SEQ ID NO: 4665 - DNA, 984 bp, Neisseria gonorrhoeae
atgtcttctacgccgaataaacacgccgattacccgaggctggttgccgacatcggcggcacaaacgcccgtttcgcattggaaaccgcgccgtgcgtgattgagaaagtcgccgtcctgccgtgtaaggaatacgacacggttaccgacgcggtgcgtgcctatctgaaccaaagtggtgcaacgggcgtacggcacgcggcatttgccatcgccaacccgattttgggcgactgggtgcagatgaccaaccaccattgggcgttttccatcgaaaccacccgtcaggctttggggctggacaccctcatccttttgaacgactttaccgcgcaggcattggcggtaacgcagacttcaagcaaagacctgatgcaggtaggcgggcaaaagcctgtcgaattcgcccccaaggccgttatcggccccggtaccggcttgggcgtgagcggattggtgcacagccccgcaggctgggtggcgttggcgggcgagggcgggcataccagtttcccgccgtttgacgatatggaagtgttgatttggcagtacgccaaaaacaaataccgccacgtttccgccgaacgtttcctcagcggcgcaggtttgagcctgatttatgaaacgctggcggtcaagcagaaagccgaaccggcaaaactgatgccgtctgaaattaccgaaaaggcattaaattgcgaatcgcccctgtgccggcaggcattggacattttctgcgcgatgctgggcacggtcgcttccaacctcgccctgactttgggcgcgcgcgggggcgtgtatttgtgcggcggcattatcccgcgaatgttggattacttcaaaacctcccccttccgcagccgctttgaaaacaaagggcgttttgaagcctaccttgccgcgattcccgtttatgtcgtcttgagcgaatttccgggtattgccggcgcggcggcggcgctcggcaaccacctgaaaaacgtc

SEQ ID NO: 4666 - protein, 328 aa, Neisseria gonorrhoeae
MSSTPNKHADYPRLVADIGGTNARFALETAPCVIEKVAVLPCKEYDTVTDAVRAYLNQSGATGVRHAAFAIANPILGDWVQMTNHHWAFSIETTRQALGLDTLILLNDFTAQALAVTQTSSKDLMQVGGQKPVEFAPKAVIGPGTGLGVSGLVHSPAGWVALAGEGGHTSFPPFDDMEVLIWQYAKNKYRHVSAERFLSGAGLSLIYETLAVKQKAEPAKLMPSEITEKALNCESPLCRQALDIFCAMLGTVASNLALTLGARGGVYLCGGIIPRMLDYFKTSPFRSRFENKGRFEAYLAAIPVYVVLSEFPGIAGAAAALGNHLKNV

SEQ ID NO: 4667 - DNA, 882 bp, Neisseria gonorrhoeae
ttgcagcagggccgcattatcgaagggcatatcattatgttaagcaaaatcagcgaatcactggccgacctgtccggtgcggaacgcaaagttgccgaatgcgccttggcagaacccaagtggtttgtccacgccgccgtcgccgaaatcgccgaccgcgcctcggtcagccagccgaccgtcatccggttctgccgcagcctcggttataaggggctgccggaattcaagctctccctgtccgccagcatcgggcacgaaggtatgccttatgtccacgaagaactcaatgccgacgacgatatggcgaatgtggttgaaaaagtgttgggcaacgccgccgcagccttgttgggggagaggaggttcttaaaagaatccgaactcgaaaacggcatcgccaccctgatgcacgcccgccgcgtcgaattttacggcgtgggcaattccggcattgtggcacaggacgcgcagcacaaatttttccgtttcggcatgtccaccgtcgcctatgtcgatacgcacacgcaactgatggcggcatccgttttgagcgatcaggatgttttggttgccatttccaacacgggttcgtctatcgaacttttggatgcggtcagcatcgccaaagaaaacggcgcgtccgtcatcgcactgacccgcaacgattcgcctctggcgcaacttgccgactgcgtgttgagcgttgccacacaggaaaacgccgaactctacacgcccatggtttcccgcctcttgcagcttgccgtcatcgatattctcgccatcggacttgccctgcgcttgggcgatgctgccagcctgcaattgcagaaaagcaaaaaaagcatacacaacaagcacatcgattacgacaaagac

SEQ ID NO: 4668 - protein, 294 aa, Neisseria gonorrhoeae
LQQGRIIEGHIIMLSKISESLADLSGAERKVAECALAEPKWFVHAAVAEIADRASVSQPTVIRFCRSLGYKGLPEFKLSLSASIGHEGMPYVHEELNADDDMANVVEKVLGNAAAALLGERRFLKESELENGIATLMHARRVEFYGVGNSGIVAQDAQHKFFRFGMSTVAYVDTHTQLMAASVLSDQDVLVAISNTGSSIELLDAVSIAKENGASVIALTRNDSPLAQLADCVLSVATQENAELYTPMVSRLLQLAVIDILAIGLALRLGDAASLQLQKSKKSIHNKHIDYDKD

SEQ ID NO: 4669 - DNA, 150 bp, Neisseria gonorrhoeae
atggcggaaaccccgccctttaaggcggcagggttcgggtttgccgcaaccccttccaaatcggggcggtacgcagggttgcgccttatgtgcgcatcgatgtgcggaaacgccccccgtcacggaaaacctcaatcgggagcatacaga

SEQ ID NO: 4670 - protein, 50 aa, Neisseria gonorrhoeae
MAETPPFKAAGFGFAATPSKSGRYAGLRLMCASMCGNAPRHGKPQSGAYR

SEQ ID NO: 4671 - DNA, 1644 bp, Neisseria gonorrhoeae
  MISC_FEATURE (1)..(1644): n = g, a, t, or c
atgaaacaccttcacgacttaccggcctggtcaaaattgtggaaccactttgacgacagcaaaacattgcatatgcgcgaaatgttcgagcaagacccgcagcgggcggaacgctactggctgcaagtcggcggactgacgctggactactccaaaaaccgcatcaacgacgaaaccatgtccctactgttcgagttggcgcgtgaagcaggcgtgccggagcggatgcggcagatgttccacggcgaaaaaatcaataccaccgaaaaccgcgccgtcctgcatgtcgcccttcgcaaccgcaccaattcgccgattatggttgacggtgaagatgtgatgcccaaagtcaaccgcgttttgcaacgtatgggcgaatttgcacacgaagtccgcagcggaagctggctgggctataccaaccaagtcattaccgacgttgtcaacatcggcatcggcggatcggatttgggcccgctgacgatgtgtaccgcgctcaaacctttcggtcatccgcgcctcaatatgcacttcgtctccaacgtggacggctcgcaactgcgcgacgtattgtccaaagtccacccngaaaccacgctgttcatcatcgcctccaaaacatttaccacgcaggaaacgctgaccaacgcgctgaccgcgcgcgaatggtttttgaatcatgcgggtgacgaagaagccgttgccaaacacttcgccgccgtttccaccaatcgaaaagccgtcgccgaattcggcatcgacatcgccaatatgtttgaattttgggattgggtcggcggtcggtacagcctgtggtccgccatcggattgccgattatgctgtatctcggcgaagaaaacttcatcgaaatgctcaacggcgcgcacctgatggaccaacacttcatcaacaccccgctcgagcgcaacctgcccgtcatcctcgccctcatcggcatctggtatatcaactactacggtggcggcagccacgtcatcgcgccttacgaccaacatttgcaccgcctgcccaaattcatccagcagctcgatatggaaagcaacggcaaacaggttacgttggacggcaaagcagtcggacacgaaacctcgccgattatctggggagaaacgggcattaacggtcagcacgccttcttccaactgctgcatcaaggcacgcacatcacccccatcgacctgattgcctcgcttgaaaaacgcagcaacctgcccggacaccacgaaatcctgcttgccaacgtctttgcacaagcagaagcctttatgtgcggcaaaacccccgacgaagtccgcgccgaactcaaagcgcagggtatggatgaggcgcgcatcgaagagctggttccgcacaaaaccttctccggcaaccgcccgaccaacctcatcctgatggataaggtcaacccccgcaatatgggcagcctgattgccatgtacgaacacaaaaccttcgtccaaggcatcatttggggcatcaacagcttcgaccagtggggcgtggaactcggcaaacaactggctaaaaccattttgggcgaactgacaggcgaaaccgaacctcaaaaacacgacagctcgaccgaacgcctgattaacctctacctgcagaccaaccgcaaa

SEQ ID NO: 4672 - protein, 548 aa, Neisseria gonorrhoeae
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMCGKTPDEVRAELKAQGMDEARIEELVPHKTFSGNRPTNLILMDKVNPRNMGSLIAMYEHKTFVQGIIWGINSFDQWGVELGKQLAKTILGELTGETEPQKHDSSTERLINLYLQTNRK

SEQ ID NO: 4673 - DNA, 1011 bp, Neisseria gonorrhoeae
atgaaaaaaaatttacccgcactggcattggcaagtatgctgattttgtcgggctgcgaccgtttgggaataggcaacccgttttccggaaaggaaatttcctgcggaagcgaagagactaaagagattttggtcaaactggtccgcgacaatgtcgaaggtgaaaccgtcaaaacttttgacgacgacgcattcaaagaccaagcatttgccgatatcggcatatcgcatatccgcagaatggtcgaacgtttgggcataaccgtcgatgaagtccgaactaccgagaaaaccgacacgtccagcaaactcaaatgtgaagccgcgttaaaactggacgtgcccgacgatgttgtcgattatgccgtcgccgccaaccaatctataggcaacagccataagaaaacgcccgacttttttgaaccctactaccgcaaagaaggcgcgtattatgtcaaaactatttcttacagcgtccagccgacagacgacaaaagcaaaatctttgccgaactcagtcaggcacacgatatcatccatccgctcagcgagctggtgtctatggcactgattaaagagccgttggacaaagcgaaacaaaggaacgaaaaacttgaagcggcagaagccaccgcgcaggaagcgagggaggcagaagaagcggcggcgcaggaggcattgggtcgggagcaggaagccgcccgcgtatccgaatgggaagaacgctacaagctgtcgcgcagcgagttcgagcagttttggaaaggattgcctcaaactgtacagaataagctgcaagcctcgcagaaaacatggaaaagcggtatggacaagatctgtgccaacaatgcgaaagccgaaggtgaaacgccaaacggcataaaagtcagtgagttggcgtgtaaaacggcagaaaccgaagcacgcttggaagagctgcacaaccgtaaaaaagcccttatcgacgaaatggtcagggaagaggacaagaaagaactgccaaagcggctc

SEQ ID NO: 4674 - protein, 337 aa, Neisseria gonorrhoeae
MKKNLPALALASMLILSGCDRLGIGNPFSGKEISCGSEETKEILVKLVRDNVEGETVKTFDDDAFKDQAFADIGISHIRRMVERLGITVDEVRTTEKTDTSSKLKCEAALKLDVPDDVVDYAVAANQSIGNSHKKTPDFFEPYYRKEGAYYVKTISYSVQPTDDKSKIFAELSQAHDIIHPLSELVSMALIKEPLDKAKQRNEKLEAAEATAQEAREAEEAAAQEALGREQEAARVSEWEERYKLSRSEFEQFWKGLPQTVQNKLQASQKTWKSGMDKICANNAKAEGETPNGIKVSELACKTAETEARLEELHNRKKALIDEMVREEDKKELPKRL

SEQ ID NO: 4675 - DNA, 138 bp, Neisseria gonorrhoeae
atgccccagtaccgcaactggcaaaacggtttgggtgccaaatgcgccgacggcgacgaatacggggtggcacaatctgactgccgtaccagagaaatcaatgcgaaaaccaaagaaatccaaggttatctgattgac

SEQ ID NO: 4676 - protein, 46 aa, Neisseria gonorrhoeae
MPQYRNWQNGLGAKCADGDEYGVAQSDCRTREINAKTKEIQGYLID

SEQ ID NO: 4677 - DNA, 621 bp, Neisseria gonorrhoeae
ttgacggttttttggaagacttggacgaagaactgcagcgactgggcaatacacccgccaccgaactggaaaccaccctgctggttcacccgaccctattccccgatttcgacgtattcaacgatatgctcgacattgccgatgccgccgttgtcgaaaacggcttggaaggcatcgtccaaatcgccccgtttcatccctatttccaatttgaaggcacggattcagacggcatcggcaactacaccaaccgttctccctatccgacgctgcacctcatccgcgaagacagcattgccaaagccgcacaagcctttcccgacgcttcggcaatattcgaacgcaatatcgccctgctggaaaaaatgggacatgaaggctgggcaaaactcggtatcacatcctgcccttatccgcacaataagaaaaatatttcaaaatgatccgttatcttttaattgcctgcggcggcatctccctgctgttggggataatcggcatttttttgccgctgttgccgaccacgccgttcgtactactctccgccgcctgctgggcaaaggcatccccgcgctttcaccgctggctgcaccggcaccgctatttcggcccgatggttca

SEQ ID NO: 4678 - protein, 207 aa, Neisseria gonorrhoeae
LTVFWKTWTKNCSDWAIHPPPNWKPPCWFTRPYSPISTYSTICSTLPMPPLSKTAWKASSKSPRFIPISNLKARIQTASATTPTVLPIRRCTSSAKTALPKPHKPFPTLRQYSNAISPCWKKWDMKAGQNSVSHPALIRTIRKIFQNDPLSFNCLRRHLPAVGDNRHFFAAVADHAVRTTLRRLLGKGIPALSPLAAPAPLFRPDGS

SEQ ID NO: 4679 - DNA, 1545 bp, Neisseria gonorrhoeae
atgccgtctgaaacggaggacacaatggattatccaccgcttaagggtgcggcattggcgtgggttacgctgtctttggggcttgccgtatttatggaggttttagatacgaccatcgccaacgtcgccgtccccgtcattgccggcaacctcggtgcggcaaccacgcaggggacgtgggtcatcacttctttttccgtggcaaacgccgtttccgtgccgctgacgggctttttggcaaaacgtatcggcgaggtcaaattgtttaccgccgccgccgccggtttcgtcatcgcatcgtggctgtgcggcatcgcgcccaaccttcagtcgctggttgttttccgcattttgcagggctttatcgccgggccgttgattcccctgtcgcaaagcctgttaatggcatcctatccgcccgcaaaacggatgctggcactggcattgtgggcaatgaccgtcgttgtcgcccctgtcctcgggccgatactcggcggttggatttccggaaactggcattggggttggattttcttcattaatatccccatcgggatcatatcggcatggattacatggaaacatttgaaacaccgcgaaacggcaaccgtcagaacgccgaccgactatgtcgggctgacgctgatgatggtcggtatcggcgcgttacagatgatgctggacaggggtaaggaacttgactggttcgcctctggagaaatcattaccttgggcataaccgcgctggtgtgcttgtcgtattttattgtttgggaattgggagaaaaatatccgattgtcgatttatcgctgtttaaagatcggaattttaccgtcggcgtaattgccacctcgttgggtttcatggtgtatatggggacgctgaccctgctgccgttagtgttgcagaccaacttgggctatacctccgcgtgggcagggcttgctgccgcgcccgtcggcatcctccccgtcttcctatctccgttaatcggcaggttcggcaataaaatcgatatgcgcctgctcgtaaccgccagcttcctgacctttgccttcactttttattggcgcactgatttttatgccgacatggatatcggcaacgtcatctggccgcagttttggcagggggtaggcgttgccatgttcttcctgccgctgaccaccatcacactgtcgcacatgaagggcggacagattgccgccgccggcagcctgtcgaatttcctgcgcgtgctgatgggcggtgtcggcgtatccgtcgtcagcaccctgtgggaacggcgcgaagcgttgcaccacacgcgttttgccgaacacatcacgccctattccgcaacattgcacgaaacggcggcgcatttgtcccaacaaggcatttccgacggtcaaactctaggcatcatcaacaataccattacgcaacagggcttcatcatcggatcgaacgaaatattcctcgccggcagcattttgtttatcgtcctgattcccattggctggctggcgaaaccgccgttccacagcggcggcggtggacat

SEQ ID NO: 4680 - protein, 515 aa, Neisseria gonorrhoeae
MPSETEDTMDYPPLKGAALAWVTLSLGLAVFMEVLDTTIANVAVPVIAGNLGAATTQGTWVITSFSVANAVSVPLTGFLAKRIGEVKLFTAAAAGFVIASWLCGIAPNLQSLVVFRILQGFIAGPLIPLSQSLLMASYPPAKRMLALALWAMTVVVAPVLGPILGGWISGNWHWGWIFFINIPIGIISAWITWKHLKHRETATVRTPTDYVGLTLMMVGIGALQMMLDRGKELDWFASGEIITLGITALVCLSYFIVWELGEKYPIVDLSLFKDRNFTVGVIATSLGFMVYMGTLTLLPLVLQTNLGYTSAWAGLAAAPVGILPVFLSPLIGRFGNKIDMRLLVTASFLTFAFTFYWRTDFYADMDIGNVIWPQFWQGVGVAMFFLPLTTITLSHMKGGQIAAAGSLSNFLRVLMGGVGVSVVSTLWERREALHHTRFAEHITPYSATLHETAAHLSQQGISDGQTLGIINNTITQQGFIIGSNEIFLAGSILFIVLIPIGWLAKPPFHSGGGGH

SEQ ID NO: 4681 - DNA, 252 bp, Neisseria gonorrhoeae
ttgcggcggctttggcatcggcaagcgcgtcggcaaccgtatcgccgacaggatgcagcccggcagatcgggaataatcacgccccagttgctttgatcggggttttggaacagcacggcgggatagtaaatcattgcttcctttctcggatatgcggtatcggcaaagtccaaacgcaacgaaggggatttaaaaacgacaaaaacgcaaaagccgccgacattcccgcatccaagtttcagtcaatcaga

SEQ ID NO: 4682 - protein, 84 aa, Neisseria gonorrhoeae
LRRLWHRQARRQPYRRQDAARQIGNNHAPVALIGVLEQHGGIVNHCFLSRICGIGKVQTQRRGFKNDKNAKAADIPASKFQSIR

SEQ ID NO: 4683 - DNA, 246 bp, Neisseria gonorrhoeae
atgttccatctcgaagggcttttgcaggaaaacctgccgattcccgaggcgcaaagcatagaggttaatcgggacaatcccgattatgccgatgcggtgttgtggacgatggttgaagcggacgatgccgcattaaccggacaggtgcggtttaacgtcagttggccgcaacatatcctcaaccgtgtcgatgcctgcactgccgcccgtcatgaaacccgagcggttttttggcgaaagccgcct

SEQ ID NO: 4684 - protein, 82 aa, Neisseria gonorrhoeae
MFHLEGLLQENLPIPEAQSIEVNRDNPDYADAVLWTMVEADDAALTGQVRFNVSWPQHILNRVDACTAARHETRAVFWRKPP

SEQ ID NO: 4685 - DNA, 306 bp, Neisseria gonorrhoeae
atgccccgccaatcctgccactcttcgccattcccgcgaaagcgggaatccggaacccaaacgcggcaggaatctatcggaaagaataacccgaccgccgtcattcccgcgcaggctggaatccagacccacaacgttaaggcggtttatcagaaaaaaccgaaaccgaacgccctagatttccgcctgcgcgggaatgacgaagagttggggagtgacgaaaggcgggaacaaccgcgcaaaaagccgccgactccttcagacggcatcggcaataaaaaagcccgaaaaaatcgggctgaaagt

SEQ ID NO: 4686 - protein, 102 aa, Neisseria gonorrhoeae
MPRQSCHSSPFPRKRESGTQTRQESIGKNNPTAVIPAQAGIQTHNVKAVYQKKPKPNALDFRLRGNDEELGSDERREQPRKKPPTPSDGIGNKKARKNRAES

SEQ ID NO: 4687 - DNA, 882 bp, Neisseria gonorrhoeae
ttggcggtcggaacgaagcaggaagacgaaatcaaacggcacgtccacaaagtattttcacactgggcaaaccacccagacgccgccgccgtcggttacgaagaccgcaatgaaaggcaaagaagcgcgctcgtatcgacttggacggacggcgacttaaacgacaacggctttttaaccccgcgattggacagcaaaatggcaacgggcggcgcagaaaaccgccccaaagccctggttttaaaactgtgcatcaaagccgccgacaccttgggcgaagccgtgttccggataaagtcccacggcgaaaccgccaacgccggcgcactggacgcgtcaaggctggcgcaaggtttgcaggaaaaagccgaccgcgaccacacccacaccaccgcccaaatccaagggctggacgaaaaaatcagcgccgccgttgccgcgcaattcacacgccaaaccatcggcggcgtggatattgtcagattccccgacggcacaatgatacagaccggcagttacaggtttgcaagaggcggcagccccataggaaacgaagttgtcttccccatcgcctttgccgacggcaacgtcaaatgcttcgtatccgaacgccattcgggacgcgtcaacggcgaaaggcaacacaactggctgtttatccgcgcaaaaaaccacgccgccgccattattaccaactggtacgaaagcagttgcgactggatggccatcggcaaatccgcctcgggaaacgccgccagccccaccccgatagtccccgaaatacctgaaatcgatgaagaaccgcaaagagagagtggaagatcatcaaccggactccgaaacccccgccgccaccgaggcctcgacttccccgtggggtcg

SEQ ID NO: 4688 - protein, 294 aa, Neisseria gonorrhoeae
LAVGTKQEDEIKRHVHKVFSHWANHPDAAAVGYEDRNERQRSALVSTWTDGDLNDNGFLTPRLDSKMATGGAENRPKALVLKLCIKAADTLGEAVFRIKSHGETANAGALDASRLAQGLQEKADRDHTHTTAQIQGLDEKISAAVAAQFTRQTIGGVDIVRFPDGTMIQTGSYRFARGGSPIGNEVVFPIAFADGNVKCFVSERHSGRVNGERQHNWLFIRAKNHAAAIITNWYESSCDWMAIGKSASGNAASPTPIVPEIPEIDEEPQRESGRSSTGLRNPRRHRGLDFPVGS

SEQ ID NO: 4689 - DNA, 369 bp, Neisseria gonorrhoeae
ttgaacagcctcaaaaccgacggcgtctattccctgccgacggcggtcggcagctcgaacctgcccgttgaaaacaccgcctgccatatccaagtcatcgccggcacgcaacccggctggtgcaggcagttgggctatcccgcctacacgtccgacgtgtacgaacgctaccagaccagcagcgcaaacgacgactggagcgcgtggaaaaaactcaattcggaaggcatccccgccggcgcgatcgtgtcctttcccaaagccgtccgaaaccccgcaggctatctcaaagccgacggcacgatctttgcacaaaacaccttctcgacctttaccgcgccctgggcaacacaaacaaactgcccgacc

SEQ ID NO: 4690 - protein, 123 aa, Neisseria gonorrhoeae
LNSLKTDGVYSLPTAVGSSNLPVENTACHIQVIAGTQPGWCRQLGYPAYTSDVYERYQTSSANDDWSAWKKLNSEGIPAGAIVSFPKAVRNPAGYLKADGTIFAQNTFSTFTAPWATQTNCPT

SEQ ID NO: 4691 - DNA, 567 bp, Neisseria gonorrhoeae
atggcaaacgcaaccgaacaaaaccaattcgaccaagccgtccgcctcatcgaacccggcgacagcgtcgtcgtcggcccaggcgcgcccgtcaaccaaccactgcaagccctcgccaaccgcacccttttgctcaaaaaccaaaccgaagcccttcagacggcatccgacaccaaagccgccgcaagcaccgccgtcaacgcaggcgacggactgacgggcggcggcagccttgcccaaagccgcaccatcgcactgggcgcgcccgggcaaatcaccgcaacaagccaaaacaccgtcccaaaaaacggccacacccacgccatcgacaccgcacgcaccgaccgcgccggcatcgtccgattagacaatgccattagcgaagccgaagacaccgccgccacccccaaagccgtcaaaaccgcgctcgaccaagcccgcgccgccgccgcgaccgccgacctcaaagtctccctctccgacaaccaaaccgttaccggccaaaaaacctttaccgccgaaacacaattccaaagcggcatccggctgtccgccaacccgacgcac

SEQ ID NO: 4692 - protein, 189 aa, Neisseria gonorrhoeae
MANATEQNQFDQAVRLIEPGDSVVVGPGAPVNQPLQALANRTLLLKNQTEALQTASDTKAAASTAVNAGDGLTGGGSLAQSRTIALGAPGQITATSQNTVPKNGHTHAIDTARTDRAGIVRLDNAISEAEDTAATPKAVKTALDQARAAAATADLKVSLSDNQTVTGQKTFTAETQFQSGIRLSANPTH

SEQ ID NO: 4693 - DNA, 357 bp, Neisseria gonorrhoeae
atgatccgttatcttttaattgcctgcggcggcatctccctgctgttggggataatcggcatttttttgccgctgttgccgaccacgccgttcgtactactctccgccgcctgctgggcaaaggcatccccgcgctttcaccgctggctgcaccggcaccgctatttcggcccgatggttcataactgggaacaaaacggcgcagtgccgcgcaaagccaagattttcgccatcagcatgatgaccgcatcctgcctgatgatgttttggcagtttccccaacgctggtgggtcggggcggtttcatcggttttttgttcccttgtcgccatatggatgtggcgcagacccgaatct

SEQ ID NO: 4694 - protein, 119 aa, Neisseria gonorrhoeae
MIRYLLIACGGISLLLGIIGIFLPLLPTTPFVLLSAACWAKASPRFHRWLHRHRYFGPMVHNWEQNGAVPRKAKIFAISMMTASCLMMFWQFPQRWWVGAVSSVFCSLVAIWMWRRPES

SEQ ID NO: 4695 - DNA, 297 bp, Neisseria gonorrhoeae
gagaatcgttctctttgagctaaggcgaggcaacgccgtaccggtttttgttaatccactataaaaggtcttttctaaaatatgcagatattcgaatgtcgaatttgccttatgattacggttttctgtcttatccgccttaaaatgccggtattccgtttgaaccaaattatatttgccgaaacactcaaaaatctcccttacctgcccgacagacatcaagacttcgttgttgtaactgagaaaaatatattgaaagtccgcatccctaatcaaagcctcaaataccggaaccac

SEQ ID NO: 4696 - protein, 5 aa, Neisseria gonorrhoeae
ENRSL

SEQ ID NO: 4697 - DNA, 1182 bp, Neisseria gonorrhoeae
atgaaatcaggaaattcggaacccaatcttatggaaacgcacacagacgaaacaaaacttcaaaacacgcaagtcaaacgcaaacgccgcctgacggcattgacgctgctgttcgcgctttccgccgcagccgccggatcggcgttttttttatggtggcagcacgaagaggaaacggaagacgcttatgttgccggacgcgtggttcaggttacgccgcaaaagggcggcacggtgcggaaggttttgcacgacgatacggatgccgtgaaaaaaggcgacgtgctggcggtgttggatgacgataatgatgtgctggcttacgagcgggcaaaaaacgagttggttcaggcggtgcgccaaaaccgccggcaaaatgccgccacttcgcaggcgggggcgcaggttgccttgcgccgtgcggatttggcgcgcgcgcaggatgatttacgccgccggtccgctttggcggaatcgggtgcggtgtccgccgaagagctggcacacgcccgtacggcagtgtctcaggcgcaggcggcggttaaggcggctttggcggaagaatcttcggcacgcgcggctttgggcggagatgtttctttgcgcgaacagccggaggttcagacggcaatcggcaggttgaaagatgcgtggctgaaccttcggcggacgcaagtccgcgcgccggcggacggtcaggtggcgaagcgttcggtgcaggtcgggcagcaggtggcggcaggcgcgccgctgatggcggtggtgccgctgtcggatgtgtgggtggatgccaattttaaagagacgcagttgcggcatatgaaaatcggacagcctgccgagctggtgtccgatttgtacggcaaacaaattgtttatcgcggcagggtggcagggttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccc

SEQ ID NO: 4698 - protein, 394 aa, Neisseria gonorrhoeae
MKSGNSEPNLMETHTDETKLQNTQVKRKRRLTALTLLFALSAAAAGSAFFLWWQHEEETEDAYVAGRVVQVTPQKGGTVRKVLHDDTDAVKKGDVLAVLDDDNDVLAYERAKNELVQAVRQNRRQNAATSQAGAQVALRRADLARAQDDLRRRSALAESGAVSAEELAHARTAVSQAQAAVKAALAEESSARAALGGDVSLREQPEVQTAIGRLKDAWLNLRRTQVRAPADGQVAKRSVQVGQQVAAGAPLMAVVPLSDVWVDANFKETQLRHMKIGQPAELVSDLYGKQIVYRGRVAGFSAGTGSAFSLIPAQNATGNWIKVVQRVPVRIVLNREDVDRHPLRIGLSMTVKVDTSAAGAPVSKTPGAALPEMESTDWSEVDRTVDEILGQSAP

SEQ ID NO: 4699 - DNA, 288 bp, Neisseria gonorrhoeae
ttgcggctgggcgaaatccaaattatcgaacgcgacggcgagttcaagtgggacggctcggtcttgttcgacggcagccgcacattcggcaggcgcgagggtgactgggcggaataccgcattgtcttaacgcgccccgtcagcatccgccaaaccgcccgcatccgcgccatgttggcggaaatcgcccccttgcggtgcgaacttaccgcgctcgactaccgcaaccatccccaccgctggaacggcaaaatccgctttaacggcgaatacggtttcggcacgaca

SEQ ID NO: 4700 - protein, 96 aa, Neisseria gonorrhoeae
LRLGEIQIIERDGEFKWDGSVLFDGSRTFGRREGDWAEYRIVLTRPVSIRQTARIRAMLAEIAPLRCELTALDYRNHPHRWNGKIRFNGEYGFGTT

SEQ ID NO: 4701 - DNA, 90 bp, Neisseria gonorrhoeae
gtgaaaaaaatcacactgcacagccccgctgccgacatcgaatgcggcaacggcgaatacatccgaatcacgtccacgctcgagcgcgaa

SEQ ID NO: 4702 - protein, 30 aa, Neisseria gonorrhoeae
VKKITLHSPAADIECGNGEYIRITSTLERE

SEQ ID NO: 4703 - DNA, 243 bp, Neisseria gonorrhoeae
ttgcagggggctgttgttcgcggggacggtgctgttcatttattcgcgctcgagcgtggacgtgattcggatgtattcgccgttgccgcattcgatgtcggcagcggggctgtgcagtgtgatttttttcacgccggggtgtctaacgcgccgatgattttagacagggcgacggatgcgccgatgtgggcgttttgccgccataggttatccaaggcttcgcaggcggtctgccgttcggct

SEQ ID NO: 4704 - protein, 81 aa, Neisseria gonorrhoeae
LQGAVVRGDGAVHLFALERGRDSDVFAVAAFDVGSGAVQCDFFHAGVSNAPMILDRATDAPMWAFCRHRLSKASQAVCRSA

SEQ ID NO: 4705 - DNA, 246 bp, Neisseria gonorrhoeae
ttgaccgccgcgcgcgaatacctgcccgccgaaacacgccgccccctttgtgacaacgtgcaagtaaccgccgcccaacccaaagacacggcagtagagtattccgccgaataccaccccgccgccaatattcaagccgaacggcagaccgcctgcgaagccttggataacctatggcggcaaaacgcccacatcggcgcatccgtcgccctgtctaaaatcatcggcgcgttagacaccccggcg

SEQ ID NO: 4706 - protein, 82 aa, Neisseria gonorrhoeae
LTAAREYLPAETRRPLCDNVQVTAAQPKDTAVEYSAEYHPAANIQAERQTACEALDNLWRQNAHIGASVALSKIIGALDTPA

SEQ ID NO: 4707 - DNA, 546 bp, Neisseria gonorrhoeae; identical to SEQ ID NO: 193

SEQ ID NO: 4708 - protein, 182 aa, Neisseria gonorrhoeae; identical to SEQ ID NO: 194

SEQ ID NO: 4709 - DNA, 192 bp, Neisseria gonorrhoeae
atggaattaaaagccgttacaagcctgaccatcgacaccccccaaaccaccataaccggacacctgaccgtcaaccaaaccaccaccgcccaagggctgctgacctaccaaaacggcatgaacggccaaggcggcagcctgtccgagcacacccaccccgacgactccggcggtacaacggaaaaaccccaa

SEQ ID NO: 4710 - protein, 64 aa, Neisseria gonorrhoeae
MELKAVTSLTIDTPQTTITGHLTVNQTTTAQGLLTYQNGMNGQGGSLSEHTHPDDSGGTTEKPQ

SEQ ID NO: 4711 - DNA, 900 bp, Neisseria gonorrhoeae
ttggaagcctgccggaaacggcaaaagccgccccgttccgccattacggggcggtttcccacatcaagacgagacagaaatgaccgaccgccaaatagacaacctcatcaaacccgccaccatcgccgacaccgaccccgcgtccgcgcacaacacggcggcattaccaccgactggctgccctatatcgtcccctttgcaggcggcgtgtcagtatggcgcatcccaagtgtcggcgaagcctgcaccatcttatcccctgccggcgaacccgagaacggcgtagttttatgctgccaagcctccgaccgataccccgccccgtccgccgaccccgccgaaaccgtcgtccgatttcatccgctacaaccacaacagcggcgcgatggaattaaaagccgttacaagcctgaccatcgacaccccccaaaccaccataaccggacacctgaccgtcaaccaaaccaccaccgcccaagggctgctgacctaccaaaacggcatgaacggccaaggcggcagcctgtccgagcacacccaccccgacgactccggcggtacaacggaaaaaccccaatgaccgacgcagaaaacggacgcgggcaagacaccctcgcccacatcgcccaatccatccgcaacatcctgttcacaagaataggaacgcggctgatgcgcgaagaatacggcagttttattcccgacttgatcgatatgcccgccggtcacgccgccatcgccctcatccaccaagccgccgttaccgccctcgcaagatggaaaccccgcataaccgtccgccgcatacaggcagacaccgccgacctcgccgccggcaaaatcaaattaaccctagacgtaacccttgccgacggcggcgaacgaacctaccgcatcaaa

SEQ ID NO: 4712 - protein, 300 aa, Neisseria gonorrhoeae
LEACRKRQKPPRSAITGRFPTSRRDRNDRPPNRQPHQTRHHRRHRPRVRAQHGGITTDWLPYIVPFAGGVSVWRIPSVGEACTILSPAGEPENGVVLCCQASDRYPAPSADPAETVVRFHPLQPQQRRDGIKSRYKPDHRHPPNHHNRTPDRQPNHHRPRAADLPKRHERPRRQPVRAHPPRRLRRYNGKTPMTDAENGRGQDTLAHIAQSIRNILFTRIGTRLMREEYGSFIPDLIDMPAGHAAIALIHQAAVTALARWKPRITVRRIQADTADLAAGKIKLTLDVTLADGGERTYRIK

SEQ ID NO: 4713 - DNA, 168 bp, Neisseria gonorrhoeae
ttgatcaagtccgcgctaaaacacatcgtacagcgcaaaaccggatgggaatggcaaaatccggaaacaaacatttttcaaagcgtacaaacaaaaaataccaaccggaggttggtatttcttaacttttggcgcggcggacggggctcgaacccgcgaccaccggcg

SEQ ID NO: 4714 - protein, 56 aa, Neisseria gonorrhoeae
LIKSALKHIVQRKTGWEWQNPETNIFQSVQTKNTNRRLVFLNFWRGGRGSNPRPPA

SEQ ID NO: 4715 - DNA, 204 bp, Neisseria gonorrhoeae
ttgcccttatccctttcagacggcattcaagattcgggtctgcgccacatccatatggcgacaagggaacaaaaaaccgatgaaaccgccccgacccaccagcgttggggaaactgccaaaacatcatcaggcaggatgcggtcatcatgctgatggcgaaaatcttggctttgcgcggcactgcgccgttttgttcccagtta

SEQ ID NO: 4716 - protein, 68 aa, Neisseria gonorrhoeae
LPLSLSDGIQDSGLRHIHMATREQKTDETAPTHQRWGNCQNIIRQDAVIMLMAKILALRGTAPFCSQL

SEQ ID NO: 4717 - DNA, 204 bp, Neisseria gonorrhoeae
atgaccgaccgccaaatagacaacctcatcaaacccgccaccatcgccgacaccgaccccgcgtccgcgcacaacacggcggcattaccaccgactggctgccctatatcgtcccctttgcaggcggcgtgtcagtatggcgcatcccaagtgtcggcgaagcctgcaccatcttatcccctgccggcgaacccgagaacggcg

SEQ ID NO: 4718 - protein, 68 aa, Neisseria gonorrhoeae
MTDRQIDNLIKPATIADTDPASAHNTAALPPTGCPISSPLQAACQYGASQVSAKPAPSYPLPANPRTA

SEQ ID NO: 4719 - DNA, 120 bp, Neisseria gonorrhoeae
ttggatagaaaaaacaaacgccgtctgaaaccttcagacggcattttttacccacccccaaacctaaaaaccacaaccaagccctacaccgcttgcccccacctcgccgccgccccaaaa

SEQ ID NO: 4720 - protein, 40 aa, Neisseria gonorrhoeae
LDRKNKRRLKPSDGIFYPPPNLKTTTKPYTACPHLAAAPK

SEQ ID NO: 4721 - DNA, 237 bp, Neisseria gonorrhoeae
atgcgaaacaaaataaaccgcaacgacatggaactcggctacacgccttacaaccttcgcaccctgcgcaaccgctgcaaactgacacaggccgagttggcgcaaatcgtcggggtgaagcactacatacaggtaggccgctgggaagccgaacccgataccgaaacgcggcgggccgatatgccgctggaaaaatggcggcagttcctcgattggatagaaaaaacaaacgccgtc

SEQ ID NO: 4722 - protein, 79 aa, Neisseria gonorrhoeae
MRNKINRNDMELGYTPYNLRTLRNRCKLTQAELAQIVGVKHYIQVGRWEAEPDTETRRADMPLEKWRQFLDWIEKTNAV

SEQ ID NO: 4723 - DNA, 426 bp, Neisseria gonorrhoeae
ttgccgtttccggcaggcttccaacagagtgaggttattttggggcggcggcgaggtgggggcaagcggtgtagggcttggttgtggtttttaggtttgggggtgggtaaaaaatgccgtctgaaggtttcagacggcgtttgttttttctatccaatcgaggaactgccgccatttttccagcggcatatcggcccgccgcgtttcggtatcgggttcggcttcccagcggcctacctgtatgtagtgcttcaccccgacgatttgcgccaactcggcctgtgtcagtttgcagcggttgcgcagggtgcgaaggttgtaaggcgtgtagccgagttccatgtcgttgcggtttattttgtttcgcatattttttgtggctgtactagattatccctaaattccacaccgatcccgcaggatttt

SEQ ID NO: 4724 - protein, 142 aa, Neisseria gonorrhoeae
LPFPAGFQQSEVILGRRRGGGKRCRAWLWFLGLGVGKKCRLKVSDGVCFFYPIEELPPFFQRHIGPPRFGIGFGFPAAYLYVVLHPDDLRQLGLCQFAAVAQGAKVVRRVAEFHVVAVYFVSHIFCGCTRLSLNSTPIPQDF

SEQ ID NO: 4725 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttaccaatcatcgtttggccttggctgccgatgaggttttcgagtgccccgccgggccgggcggaagctatttcggcggacggcgtaaaggcggacgcggtcgcggcgcggcaggaaaagcggttgtcttcggcattccgaaacgcaacgggcgggcctataccgttgccgcggacgatgccgagcctgaaacgttgctccctgccgttaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaacctttcccgccgttgttgagggaatgcgaatttcgacttaacttcggcacaccgtcccggcagctaaaaatcctgcgggatcggtgtggaatt

SEQ ID NO: 4726 - protein, 217 aa, Neisseria gonorrhoeae
MKITHCKLKKEVQKEPLRSFVPEVTARSAADILGIHPDSAALFYRKIRTVTNHRLALAADEVFECPAGPGGSYFGGRRKGGRGRGAAGKAVVFGIPKRNGRAYTVAADDAEPETLLPAVKKKIMPDGIVYADSPGSRGKLDAGGFTRCRINRSKEFADRRNHINGIGNFWNQAKRALRKYNGIDRKPFPPLLRECEFRLNFGTPSRQLKILRDRCGI

SEQ ID NO: 4727 - DNA, 303 bp, Neisseria gonorrhoeae
gtgtgttatcttcatatttcgagggtaacatatctgctaatctggtacagaccctatttttttgactgcccggcggcaggtttcggtaaggacggcggcaaatcgggcttcgtctgccggtttgccgccgaaaaaaataaaatcgtaaagggtgatgccgttttcggaatggcggtaatgcccgcccgggcattcgccgtctgtctgcctgtggattttggcaatcaggcggggatagcggcaatgggtaatgaaacggcttgcgccgtcttgcccgataatccattcggggtagcggttgaa

SEQ ID NO: 4728 - protein, 101 aa, Neisseria gonorrhoeae
VCYLHISRVTYLLIWYRPYFFDCPAAGFGKDGGKSGFVCRFAAEKNKIVKGDAVFGMAVMPARAFAVCLPVDFGNQAGIAAMGNETACAVLPDNPFGVAVE

SEQ ID NO: 4729 - DNA, 282 bp, Neisseria gonorrhoeae
atgaacagagccgcactattcaaccgctaccccgaatggattatcgggcaagacggcgcaagccgtttcattacccattgccgctatccccgcctgattgccaaaatccacaggcagacagacggcgaatgcccgggcgggcattaccgccattccgaaaacggcatcaccctttacgattttatttttttcggcggcaaaccggcagacgaagcccgatttgccgccgtccttaccgaaacctgccgccgggcagtcaaaaaaatagggtctgtaccagat

SEQ ID NO: 4730 - protein, 94 aa, Neisseria gonorrhoeae
MNRAALFNRYPEWIIGQDGASRFITHCRYPRLIAKIHRQTDGECPGGHYRHSENGITLYDFIFFGGKPADEARFAAVLTETCRRAVKKIGSVPD

SEQ ID NO: 4731 - DNA, 261 bp, Neisseria gonorrhoeae
atggcagacatcctgccatccgacaagcggcggcaaccgccaaaaacgaaaggaaatccaataaacataatcgaacaagaaacaaaacgcaccgagttaagaaaaatagatgccgaaatcgccaaaatcattgccgacgcgcacaaaatcaacgccgaatccgtaaaaatagcccaagagtcccgctggtatcccatgatggcggccaccggtctggttaccgccatcgccgccgtgttggcactgatattcaaatttgcc

SEQ ID NO: 4732 - protein, 87 aa, Neisseria gonorrhoeae
MADILPSDKRRQPPKTKGNPINIIEQETKRTELRKIDAEIAKIIADAHKINAESVKIAQESRWYPMMAATGLVTAIAAVLALIFKFA

SEQ ID NO: 4733 - DNA, 333 bp, Neisseria gonorrhoeae
ttgaatagtgcggctctgttcattttgttgagggataaagcccctcgcggggcttgtggtcaggcaaatttgaatatcagtgccaacacggcggcgatggcggtaaccagaccggtggccgccatcatgggataccagcgggactcttgggctatttttacggattcggcgttgattttgtgcgcgtcggcaatgattttggcgatttcggcatctatttttcttaactcggtgcgttttgtttcttgttcgattatgtttattggatttcctttcgtttttggcggttgccgccgcttgtcggatggcaggatgtctgccatgtatgtatgt

SEQ ID NO: 4734 - protein, 111 aa, Neisseria gonorrhoeae
LNSAALFILLRDKAPRGACGQANLNISANTAAMAVTRPVAAIMGYQRDSWAIFTDSALILCASAMILAISASIFLNSVRFVSCSIMFIGFPFVFGGCRRLSDGRMSAMYVC

SEQ ID NO: 4735 - DNA, 105 bp, Neisseria gonorrhoeae
atggtgcgggcggcggtgtttgccatgtcatatataaacgaaatatattttcagttttgccacctgaagcgttgttttttgaatattgcatctaaaatactgact

SEQ ID NO: 4736 - protein, 35 aa, Neisseria gonorrhoeae
MVRAAVFAMSYINEIYFQFCHLKRCFLNIASKILT

SEQ ID NO: 4737 - DNA, 246 bp, Neisseria gonorrhoeae
atgcacggattccgcgacctcttcaccaacatcagcctgaccgccggaaaagacaccctcacaacagacctcgcccttggccacatcagccgcgccgccctccaacgcgccggcttctcaagcctgcaccactacctgaccgccgacagctaccgcctccaagagcggcgcgaactcgccgaatggtacggccgccgccaccgccaagcatacgaagccgccgcccaaaacacttgcaataaaacc

SEQ ID NO: 4738 - protein, 82 aa, Neisseria gonorrhoeae
MHGFRDLFTNISLTAGKDTLTTDLALGHISRAALQRAGFSSLHHYLTADSYRLQERRELAEWYGRRHRQAYEAAAQNTCNKT

SEQ ID NO: 4739 - DNA, 1068 bp, Neisseria gonorrhoeae
atggcggcacacaacaaactgacccaaaaacaaatagaagcagccaaggcagacggcaaacaaagcaagctggccgacggcggcggcttatatctgctgctgcaccccaacggcagcaaatactggcggatgcgctaccggcacggcggatgcgaaaaaaccctagccttgggcgtatatcccgccgtcagcctcaagcaggcccgcgaacttgcccgcgccgcccgggcgcagaccgccgccggcatcgaccccgtcgccgaacaccaccgcacccgtcccggcagcgggcgcagccttcccgaaatcgcccgcgcgtggtacggcagccgtcaagggcaacgcgccgacaacacactggaaggcgaccgccgttcactcgcctacctgaccgactactacaaagacaacaccgacatcaacgacatcaccaccgccggcgtatcaaaatttatcgaacacctcaaccgcatcaacatccccgcctgcgcccggcgcaccgtccaaatcctcgcccaaatatgggactatgccgtccagcgcggcatcattaccgacgaatggcgcaaccccgcaaccaccgcccgcccactgctaaacacaagcaaacccaaaccccagccccacatccgccccgacgagttgcccgacttttaccgcaccctccaaaccgcccacgacctgcacccgtacgcccgccccctgctgctgcttgccgccctgaccgtcccccgtccgtccgcactgctttccgcccgctggcaagacatcgacctcaccgcccggttatggcacatccccgccgccgacatgaagaccaaacacccctttaccgtcccactgtcggactgggcagtagaaatactccgagagctgcacacacagaccggcgacaacatccaccttttcccaggcatccgcccacggcgcaaacccgccccccatcccgaccacatcagcatcaaattcgcccacaacgccatccgacgactgggctatgacggcagcaccccggcaaatccaaacacaccatgcacggattccgcgacctcttcaccaacatcagcc

SEQ ID NO: 4740 - protein, 356 aa, Neisseria gonorrhoeae
MAAHNKLTQKQIEAAKADGKQSKLADGGGLYLLLHPNGSKYWRMRYRHGGCEKTLALGVYPAVSLKQARELARAARAQTAAGIDPVAEHHRTRPGSGRSLPEIARAWYGSRQGQRADNTLEGDRRSLAYLTDYYKDNTDINDITTAGVSKFIEHLNRINIPACARRTVQILAQIWDYAVQRGIITDEWRNPATTARPLLNTSKPKPQPHIRPDELPDFYRTLQTAHDLHPYARPLLLLAALTVPRPSALLSARWQDIDLTARLWHIPAADMKTKHPFTVPLSDWAVEILRELHTQTGDNIHLFPGIRPRRKPAPHPDHISIKFAHNAIRRLGYDGSTPANPNTPCTDSATSSPTSA

SEQ ID NO: 4741 - DNA, 735 bp, Neisseria gonorrhoeae
ttgtgggtcaaacaccacacgccgaaactcatcactttcgccatcagccgtcccgaatcctaccgttttaaagccggacagttctcccgactcggtttctacgaaggtaaaggctttatttggcgtgcctattccgtcgtttccgcagaatatgccgacacgctcgaatattttgccgtactcatccaagacggccccatgtcggcccttttcgccaaaatgcaacagggcgacaccatcctgctcgataaaaatgccactggctttctcctgcccgaacgcttccccgacggcaaggatttggtgatgctctgtaccggctcgggcatcgcccccttcctttccattctcgaacaacccgaaatccggcagcgtttcgataccgtcaacctgatacattccgtatcttttcccgaagaattgattttcaacgaccggctggccgcattgtccgaacatcccctggtaggcgaatacggacactcgttccgtttcgtccctgttaccacccgtgccgccaacccctcgggcttaagcggaaaacgcattccggaactcttaaaaaacaacagcatcgaacaggcgctgcataccaagctcaccccggaatccacacggtttatgatttgcggtaacccggaaatggtcaaagacactttccaaacgctgctcgatatgggttacgccatgcaccgcaaccgcattcccggtcaaatcatgatggaaaacggcttc

SEQ ID NO: 4742 - protein, 245 aa, Neisseria gonorrhoeae
LWVKHHTPKLITFAISRPESYRFKAGQFSRLGFYEGKGFIWRAYSVVSAEYADTLEYFAVLIQDGPMSALFAKMQQGDTILLDKNATGFLLPERFPDGKDLVMLCTGSGIAPFLSILEQPEIRQRFDTVNLIHSVSFPEELIFNDRLAALSEHPLVGEYGHSFRFVPVTTRAANPSGLSGKRIPELLKNNSIEQALHTKLTPESTRFMICGNPEMVKDTFQTLLDMGYAMHRNRIPGQIMMENGF

SEQ ID NO: 4743 - DNA, 216 bp, Neisseria gonorrhoeae
gtgtggtgtttgacccacaaaatcttttcttcggtgaattttgcttcgggcgaggctgccatgttgttgtccttgagtgtgtttgtcgggattatagccaatttgggtgtttttttctgccttactctgctggattttatgaaaaagttaggcttaaccgtttttatcatcatactttttcaaatactactaaaaaatgcattaccgactaggcgg

SEQ ID NO: 4744 - protein, 72 aa, Neisseria gonorrhoeae
VWCLTHKIFSSVNFASGEAAMLLSLSVFVGIIANLGVFFCLTLLDFMKKLGLTVFIIILFQILLKNALPTRR

SEQ ID NO: 4745 - DNA, 294 bp, Neisseria gonorrhoeae
atgaataaaaatataatttatatattttctttattaatcactattgttattttctttatatttgaaaagaatgtaataagcaaaataagttttgattataataaaaaagaattcttaattagtgatataacgaactttaactgggatcatgtaaaactgtatataatcaattcagatttccaaaaaattgttttttatgataaaggtaagatagtttttgaggaattaatagaactagataggaaagggaaagttttacctcaatatctatttgattcatatttgaaaaatgtt

SEQ ID NO: 4746 - protein, 98 aa, Neisseria gonorrhoeae
MNKNIIYIFSLLITIVIFFIFEKNVISKISFDYNKKEFLISDITNFNWDHVKLYIINSDFQKIVFYDKGKIVFEELIELDRKGKVLPQYLFDSYLKNV

SEQ ID NO: 4747 - DNA, 222 bp, Neisseria gonorrhoeae
ttggctggattaattttgaaactcgataaaaataatggtttttatcaagcagaaagaaacagtaatggaaattatgatatcgtaagaaaaaattatctgaaaaatattaccaaaatacaatcaaatatattgatttacttagataataccagtaccggatttaaaattcaacagaggagaaaacaaatcagagcacaaatttcagccagacaatggagaaga

SEQ ID NO: 4748 - protein, 74 aa, Neisseria gonorrhoeae
LAGLILKLDKNNGFYQAERNSNGNYDIVRKNYLKNITKIQSNILIYLDNTSTGFKIQQRRKQIRAQISARQWRR

SEQ ID NO: 4749 - DNA, 288 bp, Neisseria gonorrhoeae
ttgcaaatatatgttaaaataaatttatttttcgttttcgacagattatttattaaagacatatatttatttgttttaaataaaattatttatcaaaaagaacatatattcccaagcacggcaatccgccttcccgccgccttccggtttgggaaactggtttatcctgattatttactttacaatcaatcggaaaacttttttcaaaaacaaacaggcagcacagtccgcctatgtccgggcggcacgaagcctgtatcactcccgcgcgccgcgcaaggcagtgct

SEQ ID NO: 4750 - protein, 96 aa, Neisseria gonorrhoeae
LQIYVKINLFFVFDRLFIKDIYLFVLNKIIYQKEHIFPSTAIRLPAAFRFGKLVYPDYLLYNQSENFFQKQTGSTVRLCPGGTKPVSLPRAAQGSA

SEQ ID NO: 4751 - DNA, 102 bp, Neisseria gonorrhoeae; identical to SEQ ID NO: 465

SEQ ID NO: 4752 - protein, 34 aa, Neisseria gonorrhoeae; identical to SEQ ID NO: 466

SEQ ID NO: 4753 - DNA, 2094 bp, Neisseria gonorrhoeae
aaagagataatttcttttttttttgcctgcgaccaccaacacgtcaccgccttccaatgtaaacgaggcatccgggttttcaatccggccggtgcggcggcggacgaacaagagtttgatgccgtaagccgccatcggaagcgtgccgactgttttgccgacggcgtatgcttctgcagccaaaggaaaggcgtggcggacggtttcgccattttcgccgaatcctgcctcatcatcactaccgacaaacagtccctccaacgcggcataacggctgtggcggatatttgccatcgtctgatagacgtgccggtacgacgcgccgttacccaacatcgcatagcctgccagcacgagtccggtttctttggtgtccgacacggcttcttccgcacccatatcggtaaacgttttcacataatcgtcattggtggcgcgcgcatatacgggcatattgggatgcatggacagcacattgtctaaaacgtgttgcgtttcgtgcatattgttgagcgtaaccaccaccattttcgcccgtcccagaccggcggcttccaatacttccctgcgtttcgcatcgccgaacgacaccggctcgcctgcacttctggctacctgcacgcgtgcgatgtccaagtcgagcgcgaaatacggaatatcctcttgggcgaggacgcgtccgaccgtctgcccgcccctgccgaagccgacaatcagcacatgatcagacttgctcatcgcttccaccaacatgctgtgcagatcgagcgacttcatgtcccagcttgacttgaccaagcgcccgaccagcgcatcgctgccgcccaagaggaagggcgcgataatcatcgacagcagaaccgccgccgtcgccgcctgttccaattctggcgaaaccatatcaagctgcccggcaatggccagcatcacgaagccgaactcgccgccttgcgcgagatacaaagccgttttgaggctgtcgccgaccgaatgcttcattttgaatgcaatggcaaacacaaccaatgccttcaacaccagcagcattgccaacagcatcaatacctgccgccagccgccgatcaatgcctgaatgtccagcttcatgccgaccgtgataaagaagaagccgagcaaaatatcgcggaacgggcgaatgtcgtcttcgacttggaaacggtattccgtttccgaaagcaacatgccggcaacgaatgcgcccaacgccatagacaaaccttccagctcagtcagataagccacacccaaggttaccagcagcacattgatcataaagagttcggacgatttgcgttttgccaccatcctgaaccatcgcgacataattttgctgccgacgaaaaacagcagccccagcgtcagcagcatttttgcaaacgccaaacccaaggccgcccaaatatttccgtcccctccgccagccagcgcgggaatcagaatcatcagcggcacgacggcgatgtcctgcatcagcagcacgcccatcgccatctgaccgtgcggctgccccaactccgtcttttccgacaaaatccggctcacaatcgccgtggacgacatcgccaacgcgcccgatacggcaaacgcccaattgaacggcacgcccgtcagcatcagtatgcccattaccgacagcatcgtaacgccgacctgcaaaccgcccagaccgaacaccagccgcctcatcgccctcagcttgggcaatgaaaactccaaaccgatgctgaacatcaggaacacaatcccgatttcgcccaaataatccgtcgcatggcttttcggaatcaggctgagcataccgggccccgccaaaaagcccaccagcaggtagcccagcatggagggaatgttgaacttgcggcacaggatcaccgtaatgaccgacaccagcagaacaaccacaataggggcaagcgaaaattcgttcatggaccgtccgaacaggaaaatacagaaaaatgccgtctgaaacggcatacgccgccgtattataacaaaacaccgcgcaccatccgaaacgggcgcggcatacaattctgataaaatacgcccttttgacccgcaccaccgcac

SEQ ID NO: 4754 - protein, 160 aa, Neisseria gonorrhoeae
KEIISFFFACDHQHVTAFQCKRGIRVFNPAGAAADEQEFDAVSRHRKRADCFADGVCFCSQRKGVADGFAIFAESCLIITTDKQSLQRGITAVADICHRLIDVPVRRAVTQHRIACQHESGFFGVRHGFFRTHIGKRFHIIVIGGARIYGHIGMHGQHIV

SEQ ID NO: 4755 - DNA, 1104 bp, Neisseria gonorrhoeae
ttgtccgatgcccgcagtaaaatatcccttttatcctcggcagagccgatgtctttacgcaaaatcatccacatcgacatggacgcgttctacgcatcggtagaactacgcgagcagccgcatttgaaagggcggccggtggtcgtcgcgtgggagggcgcgcgttcggtgatttgcgccgcatcgtatgaggcacggcagttcgggctgcattccgcgatgtcggtggcaacggtgaaaaggctgtgtccgcaagcggtgtatgtgcctccgcatttcgatttgtaccgtcaggtttccgcgcagattcacgccgtattcaggcgttataccgatttaatcgaacccttgtcgctggacgaagcctatcttgacgttacccgtaatttcaaaaatatcccttacgccggcgaagttgccaaagaaatccgtgccgccatttttgcggaaacgggtttgaccgcatccgcaggcatcgcgccgaacaaatttctggcgaaaattgcttccgactggcgcaagccgaacgggcagtttgtgttgccgccgcacaaagttatggcatttttggaaaccctgcctttgggcaaaatccccggagcgggcaaggtaacgctgaaaaaaatgcagtcgctgggtatgcggacggcgggcgatttgcgccgtttcgagcgcggcgagctcttaaatcatttcggacgctacggctaccgcctctatgatttggcgcgcggtacggacgaacaccccgtcaaagccgaacgcgaacgcctccaaatttccacagaaatcaccctgcccgaagacctgccgctcgggcaggctgccggacacctgccccatcttgccgaagacctgtggcggcaaatcacgcgcaaaaacgtcgaagcccaaagcgtaacgctcaagctgaagacctacgatttccgcatcatcacgcgcacgctgacttattcctccgtattgcccgactgcgcagctctgctgcaggctgcgcaaatgttgatggcgcgcgtcccgccgcagacggaagacgcgttccgcctcatcggtatcggtgtcggcaggcttgtaccgaaaaatcagcagcaggatttgtgggcg

SEQ ID NO: 4756 - protein, 368 aa, Neisseria gonorrhoeae
LSDARSKISLLSSAEPMSLRKIIHIDMDAFYASVELREQPHLKGRPVVVAWEGARSVICAASYEARQFGLHSAMSVATVKRLCPQAVYVPPHFDLYRQVSAQIHAVFRRYTDLIEPLSLDEAYLDVTRNFKNIPYAGEVAKEIRAAIFAETGLTASAGIAPNKFLAKIASDWRKPNGQFVLPPHKVMAFLETLPLGKIPGAGKVTLKKMQSLGMRTAGDLRRFERGELLNHFGRYGYRLYDLARGTDEHPVKAERERLQISTEITLPEDLPLGQAAGHLPHLAEDLWRQITRKNVEAQSVTLKLKTYDFRIITRTLTYSSVLPDCAALLQAAQMLMARVPPQTEDAFRLIGIGVGRLVPKNQQQDLWA

SEQ ID NO: 4757 - DNA, 2070 bp, Neisseria gonorrhoeae
gtgcggcactcgactgcctcgaaagcggcgcagactgatttcagacggcatcaaaacatgatgaaactcaatgcccaacagctcgaagccgtccgctacctcggcggccccctgttcgtccttgccggcgcaggcagcggcaaaaccggcgtgattacgcaaaaaatcaagcatttgattgtcaatgtcggctatctgccgcataccgtcgccgcgattacctttaccaacaaagccgctgcggaaatgcaggagcgcgtcgccaaaatgctgcccaaaccgcaaacgcgcgggctgacgatttgcacgttccattctttgggcatgaagattctgcgcgaagaggcgaaccatatcggttacaaaaaaaacttctccattctcgactctaccgacagcgccaaaatcatcggcgaactcttaggcggcacgggaaaagaagccgtattcaaggcgcagcaccagatttccctttggaaaaacgatttaaaaacgcctgaagatgtcgttcagacggcctctaatgtgcgggaacaacaaaccgcgcgcgtgtatgcaagttatcaggaaaccctgcaaagctatcaggcagtagattttgacgacttaatccgcctgcctgccgtgctgttgcagcaaaacagtgaagtgcgcaacaaatggcagcggcggctgcgttatctgttggttgacgaatgccaagatacgaatacctgccaatttgcgctgatgaaactcttgacaggcgcggaagggatgtttaccgccgtcggcgacgacgaccagtccatctacgcatggcgcggcgcgaacatggaaaacctgcgcaaaatgcaggaaaactatccgcagatgaaggtcatcaaactggagcaaaactaccgctccaccgcgcggattctcaaaattgccaacaaagtcatcgaaaacaaccccaagctgtttaccaaaaaactttggtcgcaattgggcgaaggcgagccggttaaagtcgttgcctgccaaaacgagcagcacgaagccgattgggtcgtcagccaaatcgtcaaacaaaaactcatcggcggcgacaaaacccgatacgccgattttgccgtgttataccgcggcaagcatcaggcacggattttcgaggaagcattgcgcggcgcgcgcatcccctaccgtctctccggcggacaaagctttttcgacaaagccgaaatcaaagacgtgttgtcttatgtgcggctgcttgccaaccccaacgacgatcccgcctttctgcgcgccgttaccacgccaaaacgcggcatcggcgatgtaacgctgggcaaactcaacgcctacgcgcacgagcacgaatgcagcctgtatgaagccgcacaaaacgaagaagcccttgccacactgaacaataccaaccgccaacacctgcaagcctttatggatatgttcggcaactaccgcgccaaagccgaaatcgacgaagcgggcgagttcatcaacagcctgctcgaagaaatcgactatgaaaaccatttgatgcaaaacgaagaaggcaaagccggcgaaatcaaatggcgcaacgtcggcgagttggtatcgtggttcgcacgaaaaggcgaacgggacggcaaaaacgtcatcgaactcgcccaaaccgtcgccttgatgacgcttttggaaggaaaagacgaagaagaaaccgatgccgtctcgctatccacgctgcacgccgccaaaggtttggagtatccgtatgttttccttgtcggttgcgaagaaggtgttttgccgcacaacgacagcatcgaagaaggcaacgtcgaagaagaacgccgcctgatgtacgtcggcatcacccgtgccaaacgccaactcacgctgacccactgtgtcaaacgcaaaaaacaaggcatatggcaattccccgaacccagccgattcatagacgaaatgccgcaggaagatttgaaaatcctggggcgcaaaggcggcgaaccgattgtcagcaaagaagaaggcagacgtaaccttgccgatataatcggaaggatcgacaacctaaaaaaaagcggcccggcggat

SEQ ID NO: 4758 - protein, 690 aa, Neisseria gonorrhoeae
VRHSTASKAAQTDFRRHQNMMKLNAQQLEAVRYLGGPLFVLAGAGSGKTGVITQKIKHLIVNVGYLPHTVAAITFTNKAAAEMQERVAKMLPKPQTRGLTICTFHSLGMKILREEANHIGYKKNFSILDSTDSAKIIGELLGGTGKEAVFKAQHQISLWKNDLKTPEDVVQTASNVREQQTARVYASYQETLQSYQAVDFDDLIRLPAVLLQQNSEVRNKWQRRLRYLLVDECQDTNTCQFALMKLLTGAEGMFTAVGDDDQSIYAWRGANMENLRKMQENYPQMKVIKLEQNYRSTARILKIANKVIENNPKLFTKKLWSQLGEGEPVKVVACQNEQHEADWVVSQIVKQKLIGGDKTRYADFAVLYRGKHQARIFEEALRGARIPYRLSGGQSFFDKAEIKDVLSYVRLLANPNDDPAFLRAVTTPKRGIGDVTLGKLNAYAHEHECSLYEAAQNEEALATLNNTNRQHLQAFMDMFGNYRAKAEIDEAGEFINSLLEEIDYENHLMQNEEGKAGEIKWRNVGELVSWFARKGERDGKNVIELAQTVALMTLLEGKDEEETDAVSLSTLHAAKGLEYPYVFLVGCEEGVLPHNDSIEEGNVEEERRLMYVGITRAKRQLTLTHCVKRKKQGIWQFPEPSRFIDEMPQEDLKILGRKGGEPIVSKEEGRRNLADIIGRIDNLKKSGPAD

SEQ ID NO: 4759 - DNA, 762 bp, Neisseria gonorrhoeae
atgcacaccagcctgaccgtcaaaaataccgttatcggaagcgggcgcaccaaaatcgccgtgccgcttgtcgcccgagatgccgccgatttatcctccgtgctgtcccaaatcaaaaacctgcccttcgatatcgtcgagttccgcgccgactttttggaatgcgcgggcagcatcggcgaagtattgcgccacacgcaggccgtccgcgacgcgctgcccgacaaaccgctgctgtttacgttcagacggcattgcgaaggcggctcgttcccgtgttcggacgattattattttgaactgctcgacgcgctgatcgaaagccgcctgcccgacattatcgatatcgagctgttttccggcgaaaccgccgtccgccgcgccgtggcaaatgctcaaaaaaacggcatcgccgccctgctctgcaatcatgagtttcaccgcacgccgccgcaagaagaaatcgtatgccgtctgaaacagatggaggactgcggcgcggacatctgcaaaattgcggtgatgccgcaaagctcggaagatgtgctgactttgctttccgccacgctcgaagcgaaacggcttgtcgccaaaccggttattacgatgtcgatggggcagacgggtgcggtcagccggcttgccggacaggtgttcggctcaagcatcacgttcggttcgggaacgcaaaactccgcgccggggcaaatcggcgtatccgccctccgtgcggcactcgactgcctcgaaagcggcgcagac

SEQ ID NO: 4760 - protein, 254 aa, Neisseria gonorrhoeae
MHTSLTVKNTVIGSGRTKIAVPLVARDAADLSSVLSQIKNLPFDIVEFRADFLECAGSIGEVLRHTQAVRDALPDKPLLFTFRRHCEGGSFPCSDDYYFELLDALIESRLPDIIDIELFSGETAVRRAVANAQKNGIAALLCNHEFHRTPPQEEIVCRLKQMEDCGADICKIAVMPQSSEDVLTLLSATLEAKRLVAKPVITMSMGQTGAVSRLAGQVFGSSITFGSGTQNSAPGQIGVSALRAALDCLESGAD

SEQ ID NO: 4761 - DNA, 837 bp, Neisseria gonorrhoeae
atgaccgccaccgccgccgatttagaccgactcctcccccaaacccaatgccgcgaatgcggctatgaaggctgcctgccctacgcccgcgcgatgctgcggggcgaggcgcacaacctctgcgccccgggcggcgcaaccgtcgtccgcgaccttgccgccctgctcggcaaaccccttgtcgcacctgccaaaacccaagccaaagcactcgcccggatagacgaaaccgcctgtatcggctgcaccgcctgcatccgcgcctgccctgccgatgccattatgggcgcgggcaaacttatgcacaccgtcatcaccgacgaatgcaccggctgcggactctgcgtcgccccctgccccgtggactgcatccatatgcagcccgttgccgacaccgtcctgccgcgcgcgcgccgtttcagcctgtccgacgacagccgttttgccgccgccgaacacgcgcgtgcgcgctacctcaaacgcaacgaacgcaaacagcgcgaagccgacgaacgcaaggccatgcttgccgaacgcgaagccgccgtccgcaacgcgcgtccgcaaacgcccgacacaccggaaaaaccggcgttcaaccccgccgacctcatcgccaaagccatggcaaaagcgcaaacccaacaggatcgcctcgccgccgccgacaaccgccaaggctatcaggcaaaacagatagccgaagcccgcgaacgcgccgaattgcgccgcgcccaacgcgatatgaaatacggcagcgacagcgaaaaagccgccgccctcgaatacctcaaacaatacaaagccaaacaggaagccgcacagaataccgcctcc

SEQ ID NO: 4762 - protein, 279 aa, Neisseria gonorrhoeae
MTATAADLDRLLPQTQCRECGYEGCLPYARAMLRGEAHNLCAPGGATVVRDLAALLGKPLVAPAKTQAKALARIDETACIGCTACIRACPADAIMGAGKLMHTVITDECTGCGLCVAPCPVDCIHMQPVADTVLPRARRFSLSDDSRFAAAEHARARYLKRNERKQREADERKAMLAEREAAVRNARPQTPDTPEKPAFNPADLIAKAMAKAQTQQDRLAAADNRQGYQAKQIAEARERAELRRAQRDMKYGSDSEKAAALEYLKQYKAKQEAAQNTAS

SEQ ID NO: 4763 - DNA, 471 bp, Neisseria gonorrhoeae; identical to SEQ ID NO: 493

SEQ ID NO: 4764 - protein, 157 aa, Neisseria gonorrhoeae; identical to SEQ ID NO: 494

SEQ ID NO: 4765 - DNA, 1125 bp, Neisseria gonorrhoeae
atgaccgaccgattcatattccgcgccgcagcccgtgttgcgccgcagcccacataccgcatttgttccggagtaacccccatgtcagacgacaaaagcaaagcccttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggcctgccgcgcgggcgcatcgtcgaaatcttcggccccgaatcctccggcaaaaccacactctgcctcgaagccgtcgcccaatgccagaaaaacggcggcgtgtgcgcctttgtcgatgccgaacacgccttcgatcccgtttacgcccgcaaactcggcgtaaaagtcgaagagctttacctgtcccagcccgataccggcgaacaggctttggaaatctgcgacacgctcgtccgttcgggcggcatagatatggtagtcgtcgattccgtagccgcactcgtccccaaagccgaaatcgaaggcgatatgggggacagccacgtcggactgcaggcgcgcctgatgagtcaggctttgcgcaaactgaccggacacatcaaaaaaaccaatacgctggttgtgttcatcaaccaaatccgaatgaagatcggcgtaatgttcggcagccccgagaccacgaccggcggcaacgcgctgaaattctattcttccgtccgcctcgacatccgccgcaccggatccatcaaaaaaggcgaagaagtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaagaaaaccccgaaatttccgacgaaatcgacgcaaaaatccgcgccctcaacggcgtagaaatgcacatcaccgaagggacgcaggacgaaaccgacggcgaacgacccgaagaa

SEQ ID NO: 4766 - protein, 375 aa, Neisseria gonorrhoeae
MTDRFIFRAAARVAPQPTYRICSGVTPMSDDKSKALAAALAQIEKSFGKGAIMKMDGSQQEENLEVISTGSLGLDLALGVGGLPRGRIVEIFGPESSGKTTLCLEAVAQCQKNGGVCAFVDAEHAFDPVYARKLGVKVEELYLSQPDTGEQALEICDTLVRSGGIDMVVVDSVAALVPKAEIEGDMGDSHVGLQARLMSQALRKLTGHIKKTNTLVVFINQIRMKIGVMFGSPETTTGGNALKFYSSVRLDIRRTGSIKKGEEVLGNETRVKVIKNKVAPPFRQAEFDILYGEGISWEGELIDIGVKNDIINKSGAWYSYNGAKIGQGKDNVRVWLKENPEISDEIDAKIRALNGVEMHITEGTQDETDGERPEE

SEQ ID NO: 4767 - DNA, 1065 bp, Neisseria gonorrhoeae
ttgcctcgccttgccgtactatttgtactgtctgcggctctccgccttgtcctgatttttgttaatccgctataccaaaactcaaatcaagccgtccggaggcggctcaaaaaaaacggtacttcgcagcagaagtaccgtttatcgggatttcaggttttattcttcgggtcgttcgccgtcggtttcgtcctgcgtcccttcggtgatgtgcatttctacgccgttgagggcgcggatttttgcgtcgatttcgtcggaaatttcggggttttctttcagccagacgcggacgttgtctttgccctgaccgattttcgcgccgttgtagctgtaccacgcgccggatttgttgatgatgtcgtttttcacgccgatgtcgatcaattcgccttcccaactgatgccttctccgtagaggatgtcaaactctgcctgacggaacgggggggcgactttgtttttgatgactttgacgcgggtttcgttgcccaatacttcttcgccttttttgatggatccggtgcggcggatgtcgaggcggacggaagaatagaatttcagcgcgttgccgccggtcgtggtctcggggctgccgaacattacgccgatcttcattcggatttggttgatgaacacaaccagcgtattggtttttttgatgtgtccggtcagtttgcgcaaagcctgactcatcaggcgcgcctgcagtccgacgtggctgtcccccatatcgccttcgatttcggctttggggacgagtgcggctacggaatcgacgactaccatatctatgccgcccgaacggacgagcgtgtcgcagatttccaaagcctgttcgccggtatcgggctgggacaggtaaagctcttcgacttttacgccgagtttgcgggcgtaaacgggatcgaaggcgtgttcggcatcgacaaaggcgcacacgccgccgtttttctggcattgggcgacggcttcgaggcagagtgtggttttgccggaggattcggggccgaagatttcgacgatgcgcccgcgcggcaggccgccgactccgagggcgaggtc

SEQ ID NO: 4768 - protein, 355 aa, Neisseria gonorrhoeae
LPRLAVLFVLSAALRLVLIFVNPLYQNSNQAVRRRLKKNGTSQQKYRLSGFQVLFFGSFAVGFVLRPFGDVHFYAVEGADFCVDFVGNFGVFFQPDADVVFALTDFRAVVAVPRAGFVDDVVFHADVDQFAFPTDAFSVEDVKLCLTERGGDFVFDDFDAGFVAQYFFAFFDGSGAADVEADGRIEFQRVAAGRGLGAAEHYADLHSDLVDEHNQRIGFFDVSGQFAQSLTHQARLQSDVAVPHIAFDFGFGDECGYGIDDYHIYAARTDERVADFQSLFAGIGLGQVKLFDFYAEFAGVNGIEGVFGIDKGAHAAVFLALGDGFEAECGFAGGFGAEDFDDAPARQAADSEGEV

SEQ ID NO: 4769 - DNA, 99 bp, Neisseria gonorrhoeae
ttgttaatccactatatttttacccgacggggtgaaaaatacagttgctacagcccgacctacgcccgctttgcctctatcctgcgccgactttacgga

SEQ ID NO: 4770 - protein, 33 aa, Neisseria gonorrhoeae
LLIHYIFTRRGEKYSCYSPTYARFASILRRLYG

SEQ ID NO: 4771 - DNA, 129 bp, Neisseria gonorrhoeae
gtgcaaagtattgcacataaaagggcgcaggcttcatccgtaaagtcggcgcaggatagaggcaaagcgggcgtaggtcgggctgtagcaactgtatttttcaccccgtcgggtaaaaatatagtggat

SEQ ID NO: 4772 - protein, 43 aa, Neisseria gonorrhoeae
VQSIAHKRAQASSVKSAQDRGKAGVGRAVATVFFTPSGKNIVD

SEQ ID NO: 4773 - DNA, 120 bp, Neisseria gonorrhoeae
gtgcaatactttgcacttgctgaacaaaattcaaacgaccctttatatcaaatgcaaaaaatatgccgtcattcccgcgaaggcgggaatccagacctgtcggcacggaaatttatcgag

SEQ ID NO: 4774 - protein, 40 aa, Neisseria gonorrhoeae
VQYFALAEQNSNDPLYQMQKICRHSREGGNPDLSARKFIE

SEQ ID NO: 4775 - DNA, 159 bp, Neisseria gonorrhoeae
ttgcacttgctgaacaaaattcaaacgaccctttatatcaaatgcaaaaaatatgccgtcattcccgcgaaggcgggaatccagacctgtcggcacggaaatttatcgagtaaaacggtttttcagattctacgttctagattcccgcctgcgcgggaa

SEQ ID NO: 4776 - protein, 53 aa, Neisseria gonorrhoeae
LHLLNKIQTTLYIKCKKYAVIPAKAGIQTCRHGNLSSKTVFQILRSRFPPARE

SEQ ID NO: 4777 - DNA, 456 bp, Neisseria gonorrhoeae
atggcagcccgaatcactggaattggcggcaaaccggccataaacagatataatgccgcccgaacccttcggacggcattgccgcttccctcattcattcaaacacaaacaggagtattcagtatgttcggaaaagccggattaggcggcctgatgaaacaggcgcagcaaatgcaggaaaacatgaaaaaggcacaagccaaacttgccgaaaccgaaatcgaaggcgaagcaggcaacggcttggtcaaaatcacaatgacctgcgcgcacgaagtacgcaaaatcgacatcagccccgatttgattcaagaagccgccgatgacaaagaaatgctcgaagacctcatcctcgccgccctcaaatccgcccggggcaaagccgaagaaaccgcaaacaaaacaatgggcgcattcacccaagatctgccccccggcgtgggcgacttcttccgc

SEQ ID NO: 4778 - protein, 152 aa, Neisseria gonorrhoeae
MAARITGIGGKPAINRYNAARTLRTALPLPSFIQTQTGVFSMFGKAGLGGLMKQAQQMQENMKKAQAKLAETEIEGEAGNGLVKITMTCAHEVRKIDISPDLIQEAADDKEMLEDLILAALKSARGKAEETANKTMGAFTQDLPPGVGDFFR

SEQ ID NO: 4779 - DNA, 2208 bp, Neisseria gonorrhoeae
atgctagaatacgccgcccgaagccgccgttcagacggcattccgacgcaccgacagaaacatcacgaccgaaaccaagagaaaaacatggcctatcaagttctcgcccgaaaatggcggcccaaaaccttttccgacttagtcggtcaggaacacgtcgtcaaagccctgcaaaatgccttggacgaaggcaggctgcaccacgcctacctgctgaccgggacgcgcggcgtgggcaaaaccaccatcgcccgcatccttgccaaaagcctcaactgcgaaaatgcgcaacacggcgaaccttgcggcgtgtgccaaagctgcacccaaatcgatgccggacgctatgtcgacctgctcgaaatcgacgccgcctccaacacaggcatcgacaacatccgcgaagtcttggaaaacgcccaatacgcgccgaccgccggcaaatacaaagtctatatcatcgacgaagtgcatatgctttccaaaagcgcgttcaacgccatgctcaaaacgctggaagagccgcccgaacacgtcaaattcatcctcgccaccaccgatccgcacaaagtccccgttaccgtattaagccgctgcctacaattcgtcttacgcaatatgaccgcgcaacaggttgccgaccaccttgcccacgtcctcgacagcgaaaaaatcgcctacgacccccccgccctgcaacttttgggacgtgccgccgccggatcgatgcgcgatgccttaagcctgctcgaccaagccatcgccctaggttcgggcaaagttgccgaaaacgatgtccgccaaatgatcggcgcggttgacaaacaatacctgtacgaactgctgacaggcatcgtcaaccaagacggcgaagccctgctggcaaaagcgcaggaaatggcggcgtgtgccgtcggctttgacaacgccttgggcgaactggccatactgctgcaacaactcgccctgatacaggcagtcccctccgccttggcgcacgacgaccccgattccgatattttgcaccgcctcgcccaaaccataagcggcgaacaaatccagctttactaccaaatcgccgtccacggcaaacgcgacctgggcctcgcccccgacgaatacgccggctttatgatgaccctgctgcgtatgctggcgttcgcccccttggcggcggcttcgtgtgatgcaaacgccgtgattgaaaataccgaacttcaatccccgtcggcacaaaccgccgaaaaggaaaccgccgcaaaaaagccacaaccgcgccctgaagcggatgccgcccaaacgcccgttcagacggcatccgcagcagcaatgccgtctgaaggcaaaactgccggccccgtttcccatcaagaaaacaacgatgttccgccttgggaagacgcgccggacaaaaccgaaaccgcagccggcacggcgcgaacgtcggcaaaaagcattcagacggcatccgaagccgaaacgccgcccgaaaatcaagtttccaagaacaaggcagccgacaacgaaaccgaggcttccttgtccgaagtgccgtctgaaaaccccattcaggcaacaccgaatgatgaagccgttgaaacggaaacatttgcacacgaagcccctgcagaacctttctacggttttccggataatgactgccccccggaagacggcgtggaaatcccgccgcccgattgggcaaatgtcctccctgccgataccgcaggcggagggacggacgaagaagcagaagcgggcggcatcggcggaaacaacacgccgtccgccccgccgcccgaattttccaccgaaaactgggcagccatcgtccggcacttcgcccgcaaactcggcgcggcgcaaatgccggcgcaacactccgcgtggacggaataccgttccgacaccggactgatggttttggcaatgaccgccgaagcccgcgccaccgccgacaaaaagcggctcgacaaaatccgcgacaccctcgcccaagcctacgggctgcaactcaccctgcaaaccgaagactggcgcgacgaagccggccgggaaacccccgcgatgcaggacaagcgtgtccaagccgaagacaggcaaaaagcacaagcattgctcgaagccgaccccgccgcacaaaaaatcctccaagcattcggcgcgcaatggcagcccgaatcactggaattggcggcaaaccggcca

SEQ ID NO: 4780 - protein, 736 aa, Neisseria gonorrhoeae
MLEYAARSRRSDGIPTHRQKHHDRNQEKNMAYQVLARKWRPKTFSDLVGQEHVVKALQNALDEGRLHHAYLLTGTRGVGKTTIARILAKSLNCENAQHGEPCGVCQSCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLRNMTAQQVADHLAHVLDSEKIAYDPPALQLLGRAAAGSMRDALSLLDQAIALGSGKVAENDVRQMIGAVDKQYLYELLTGIVNQDGEALLAKAQEMAACAVGFDNALGELAILLQQLALIQAVPSALAHDDPDSDILHRLAQTISGEQIQLYYQIAVHGKRDLGLAPDEYAGFMMTLLRMLAFAPLAAASCDANAVIENTELQSPSAQTAEKETAAKKPQPRPEADAAQTPVQTASAAAMPSEGKTAGPVSHQENNDVPPWEDAPDKTETAAGTARTSAKSIQTASEAETPPENQVSKNKAADNETEASLSEVPSENPIQATPNDEAVETETFAHEAPAEPFYGFPDNDCPPEDGVEIPPPDWANVLPADTAGGGTDEEAEAGGIGGNNTPSAPPPEFSTENWAAIVRHFARKLGAAQMPAQHSAWTEYRSDTGLMVLAMTAEARATADKKRLDKIRDTLAQAYGLQLTLQTEDWRDEAGRETPAMQDKRVQAEDRQKAQALLEADPAAQKILQAFGAQWQPESLELAANRP

SEQ ID NO: 4781 - DNA, 1974 bp, Neisseria gonorrhoeae
atgccacgcattgccgccctgcccgaccacctcgtcaaccaaattgccgccggcgaagtggtcgaacgccctgccaacgccctgaaagaaatcgttgaaaacagcatagacgcgggcgcaacggcggttgatgtggaactggaaggcggcggcatccgcctcatccgcgtcggcgacaacggcggcggcatccaccccgacgacatcgaactcgcgctccaccgccacgccaccagcaaaatcaaaaccctgaacgatttggaacacgttgccagcatgggctttcgcggcgaaggcttggccagtatcgcctccgtcagccgcctgaccctgaccagccgccaagaagacagttcgcatgcgacccaagtcaaagccgaagacggcaaactcagcagccccaccgccgccgcccaccccgtcggcaccaccatcgaagccgccgaactcttcttcaacacccccgcgcggcgcaagttcctcaaatccgaaaacaccgaatacgctcactgcgccaccatgctcgaacgcctcgcgctggcgcatccgcacattgccttctcactcaaacgcgacggcaaacaagtgttcaaacttcctgcccaaagcctgcatgaacgtatcgccgccattgtcggcgatgattttcagacggcatctttggaaattgacagcggcaatagcgcgctgcggctctatggcgcgattgccaagccgactttcgccaaaggcaaaaccgataaacaatattgcttcgtcaaccatcgttttgtccgcgacaaagtcatgctccatgccgtcaagcaggcataccgcgacgtattgcacaacgcactgacacctgctttcgtccttttcctcgagctgccgcccgaagccgtggatgtcaacgtccacccgaccaaaaccgaaatccgcttccgcgacagccggcaagtacaccaactcgtgttccacacgctcaacaaagcccttgccgacacacgcgccaacctgaccgaaagcgtcagcaacgcaggcgaagtgttgcatgacattaccggcgttacgcctgccccaatgccgtctgaaaacgacggcgaaaatctgtttgatagcgcatccaaccacccgacaggcaacaaacccgatacacgcaatgcctttggttcatcaggtaaaaccgcgcccatgccttaccaggccgcgcgtgcgccgcaacaacacagcctgtccctgcgcgaaagccgcgcggcaatggacacctatgccgaactctacaaaaaaaccgacgacatcgaccttgagttgagccaattcgaacaggcacgtttcggcaatatgccgtctgaaacgcctgctcacaaaacagatacgccgctttcagacggcatcccgtcccaatccgaactgccgccgctcggtttcgccattgcccaattacttggcatctacattcttgcccaagccgaagacagcctgttgctcatcgatatgcacgccgctgcagaacgcgtcaactacgagaaaatgaaacgccaacgtcaggaaaacggcaacctgcaaagccagcacctgcttattcccgtaacctttgccgcgtcccacgaagaatgcgccgccctcgccgatcatgccgaaacgctggcaggcttcggcctggaactgtccgacatgggcggcaacaccctcgccgtccgcgccgcgcccgtaatgttgggcaaatccgatgtcgtctccctcgcacgcgacgtattgggcgaactcgcccaagtcggcagcagccaaaccatcgcatcacacgaaaaccgcatcctcgccacaatgtcctgccacggctcaatccgcgccggccgcaggctcaccctgcccgaaatgaacgcgctgctgcgcgatatggaaaatacgccgcgcagcaaccagtgcaaccacggcaggccgacgtgggtcaaactgactttgaaagaattggacacactgttcttgcgcggacag

SEQ ID NO: 4782 - protein, 658 aa, Neisseria gonorrhoeae
MPRIAALPDHLVNQIAAGEVVERPANALKEIVENSIDAGATAVDVELEGGGIRLIRVGDNGGGIHPDDIELALHRHATSKIKTLNDLEHVASMGFRGEGLASIASVSRLTLTSRQEDSSHATQVKAEDGKLSSPTAAAHPVGTTIEAAELFFNTPARRKFLKSENTEYAHCATMLERLALAHPHIAFSLKRDGKQVFKLPAQSLHERIAAIVGDDFQTASLEIDSGNSALRLYGAIAKPTFAKGKTDKQYCFVNHRFVRDKVMLHAVKQAYRDVLHNALTPAFVLFLELPPEAVDVNVHPTKTEIRFRDSRQVHQLVFHTLNKALADTRANLTESVSNAGEVLHDITGVTPAPMPSENDGENLFDSASNHPTGNKPDTRNAFGSSGKTAPMPYQAARAPQQHSLSLRESRAAMDTYAELYKKTDDIDLELSQFEQARFGNMPSETPAHKTDTPLSDGIPSQSELPPLGFAIAQLLGIYILAQAEDSLLLIDMHAAAERVNYEKMKRQRQENGNLQSQHLLIPVTFAASHEECAALADHAETLAGFGLELSDMGGNTLAVRAAPVMLGKSDVVSLARDVLGELAQVGSSQTIASHENRILATMSCHGSIRAGRRLTLPEMNALLRDMENTPRSNQCNHGRPTWVKLTLKELDTLFLRGQ

SEQ ID NO: 4783 - DNA, 1437 bp, Neisseria gonorrhoeae
ttgaatcgaggaaacacgatgcgccacctacccctgttttcactaatgcttttcccggcatcggtttacgccgcagattcggacggcgcaaacctaaacctgctgtggggcttgccctttgccctgattttgctgtctatcgcattgggtcccttgtttttttcgcatacctggcatcaccattacggcaaaatcaccgccttttggacattgctcttcctcatcccgttcagtttggtttttggcgcgtccgccggtatccataccgtcgcacacgcactcgttgaagaatatatccccttcatcctgctgctgcttgccctgtacaccatttcaggcggcattttggtttggggcgacttgaacggcacacccaagctcaacaccgccctgcttgccgtcggtacggcacttgcctctatcatgggaacgaccggcgcggcaatgctgatgattcgtccgctgctgaaagccaaccaagaccgtacccgccgcgtgcacatcgtcatcttcttcattttcctggttgcaaacatcggcggcggcctgacccctttgggcgaccccccactcttcctcggcttcctcaaaggcgtagatttcatgtggacggtcaaacatatgttcgcccccgtcctgattagcaccgctgtcctgttgaccgccttctatttcatcgacaaccgtttcttcaaacaggaaagcattgcacaagatacgccggcacaacaggaaaaacccgaaaaaatcgccatcttcggcaaatggaacttcctcctgctttcgggcgtggtcggcgcggttctaatgtccggcctttggaaacccgaacacccgggatttgaaatcctcggcagccgttacgccctgcaaaaccttgtccgcgatgtcatcctgattacattgaccgccgtatctatggcaatcacgcccaaacaagtccgcgcaggcaacgaattcaactttgaacccatcgccgaagtgggcaaactcttcctcggcatcttcatcaccatcttccccgtcctgagcattctgaaagcaggcgaggcaggcgcgctgggcggggtggtatcgctggttcacgatacggcaggtcatccgattaatacgatgtatttctggatgagcggcatattgtcggcattcttggataacgcgcccacttatctcgtgtttttcaatatggcgggcggcgatgcccaagccttaatgacgggtcccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacataccctcgtctttttcgttttcaaactactg

SEQ ID NO: 4784 - protein, 479 aa, Neisseria gonorrhoeae
LNRGNTMRHLPLFSLMLFPASVYAADSDGANLNLLWGLPFALILLSIALGPLFFSHTWHHHYGKITAFWTLLFLIPFSLVFGASAGIHTVAHALVEEYIPFILLLLALYTISGGILVWGDLNGTPKLNTALLAVGTALASIMGTTGAAMLMIRPLLKANQDRTRRVHIVIFFIFLVANIGGGLTPLGDPPLFLGFLKGVDFMWTVKHMFAPVLISTAVLLTAFYFIDNRFFKQESIAQDTPAQQEKPEKIAIFGKWNFLLLSGVVGAVLMSGLWKPEHPGFEILGSRYALQNLVRDVILITLTAVSMAITPKQVRAGNEFNFEPIAEVGKLFLGIFITIFPVLSILKAGEAGALGGVVSLVHDTAGHPINTMYFWMSGILSAFLDNAPTYLVFFNMAGGDAQALMTGPLFHSLLAVSMGSVFMGALTYIGNAPNFMVKAIAEQRGVPMPTFFGYMMWSVAFLTPVFIVHTLVFFVFKLL

SEQ ID NO: 4785 - DNA, 489 bp, Neisseria gonorrhoeae
ttgtgcgtcgtgctcgaacaggcgtttgcgtgccaatgcttcaaactctgtgcctgctttgccgtagttggcaaacggatgaacggcgatgccgccgcgcggtgtgaactcgccgaacacttcgatgtatttcggatccatcagggcgatgaggtctttcatgatgatgttgacgcagtcttcatgaaaatcgccgtggttgcggaagctgaagaggtagagtttcagggatttgctttccaccattttgatgtgcgggatatagcggatgacgatggtggcgaagtcgggctgcccggtcatcgggcagaggctggtgaattcggggcagacgaatttgacgaaatagtcgttgtcgggatgtttgttgtcgaatgcttcgagaatttcaggcgcgtagccggtcggatattgggttttttgattacccaaaagagagatgccttgcagctcttcgttgttgcgggacatagggtttccttagttttt

SEQ ID NO: 4786 - protein, 163 aa, Neisseria gonorrhoeae
LCVVLEQAFACQCFKLCACFAVVGKRMNGDAAARCELAEHFDVFRIHQGDEVFHDDVDAVFMKIAVVAEAEEVEFQGFAFHHFDVRDIADDDGGEVGLPGHRAEAGEFGADEFDEIVVVGMFVVECFENFRRVAGRILGFLITQKRDALQLFVVAGHRVSLVF

SEQ ID NO: 4787 - DNA, 183 bp, Neisseria gonorrhoeae
atgtaccactaccaatccgaagccacacaattcctcaaccgcctgatcgaagaaaaacctgaattggcgcaagaacgtttgaaaaatcaagggcttttgtgggatgtcgaactcaatcccgaagagcaaaaaaactttgaatcggcaaaagtggcgaaaaaaccttatacctattaccaagac

SEQ ID NO: 4788 - protein, 61 aa, Neisseria gonorrhoeae
MYHYQSEATQFLNRLIEEKPELAQERLKNQGLLWDVELNPEEQKNFESAKVAKKPYTYYQD

SEQ ID NO: 4789 - DNA, 246 bp, Neisseria gonorrhoeae
ttggacagatgggtcgtcatttcggcgggttcagtcttggtaataggtataaggttttttcgccacttttgccgattcaaagtttttttgctcttcgggattgagttcgacatcccacaaaagcccttgatttttcaaacgttcttgcgccaattcaggtttttcttcgatcaggcggttgaggaattgtgtggcttcggattggtagtggtacatctttgcgctccaattttacgggatacggcg

SEQ ID NO: 4790 - protein, 82 aa, Neisseria gonorrhoeae
LDRWVVISAGSVLVIGIRFFRHFCRFKVFLLFGIEFDIPQKPLIFQTFLRQFRFFFDQAVEELCGFGLVVVHLCAPILRDTA

SEQ ID NO: 4791 - DNA, 666 bp, Neisseria gonorrhoeae
atgacgacccatctgtccaatgtcgcaccggacctgcaaaactatttgaatgccatcggcgaacccgaacatcccgttttgacgcggctgcgtgagaaggccgggcatcaccgtatgggcaaaatggcgattgcgcgcgaacaggcggcggttttggtttggctggcaaagctgattcgcgcggaaaaatatctggaaatcggcgtatttaccggatacagcagcaccgcgcttgcattggcgctgcccgaacacgggcggattaccgcctgcgacatcaatgtaacctttaccgatacggcgcgtcaggtttggaacgaggccggtgtggcgcataaaatcagcctgcacctgcaacccgcattgctgacattggatgatttgattgcacagggtgaagccggaagctacgatttggcactgatagacgcagacaaaccgcccacgccgcaatatttcgagcgttgcctcaaactcgtccggcaaggcggcatcatcgccatcgacaatattttgttgaacggaagggtgatgcgcgaagcggcttttgatgcgccgcccagtgtcaaaattctcaaagatttcaatcaaaacctgccgaacgatacgcggattgtccccatcaccctgcccgtcggcgacggtttgaccctgcttctgaaaaaa

SEQ ID NO: 4792 - protein, 222 aa, Neisseria gonorrhoeae
MTTHLSNVAPDLQNYLNAIGEPEHPVLTRLREKAGHHRMGKMAIAREQAAVLVWLAKLIRAEKYLEIGVFTGYSSTALALALPEHGRITACDINVTFTDTARQVWNEAGVAHKISLHLQPALLTLDDLIAQGEAGSYDLALIDADKPPTPQYFERCLKLVRQGGIIAIDNILLNGRVMREAAFDAPPSVKILKDFNQNLPNDTRIVPITLPVGDGLTLLLKK

SEQ ID NO: 4793 - DNA, 711 bp, Neisseria gonorrhoeae
atgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacga

SEQ ID NO: 4794 - protein, 237 aa, Neisseria gonorrhoeae
MKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 4795 - DNA, 483 bp, Neisseria gonorrhoeae
atgatacaaatcggcatcatcatgggcagcaacagcgattggcccgttatgcggcaggcagcgcagtttcttgaagagttcggcgtagaatatgaggcgcgcgtcgtttccgcacaccgcactccggatttgatgtttgaatacgccgaaaccgcacgggcgcgcggcatcaaagccatcatcgcgggtgcgggcggcgcggcgcatttacccggcatggttgccgccaagaccaccgtccccgttttgggcgtacccgtcccaagcaaatacctgcgcggcgaagattcgcttttatcgattgtacaaatgcccaaaggcgtacccgtcgccacattcgccatcggcgaggcaggcgcggcaaatgccgcattgttcgccatctccatgctcgccaacgaaaaccccgaactggcgcaaaaactggcagacttccgagccaaacaggaacaaaccgttttaaacatggaattggaacagatt

SEQ ID NO: 4796 - protein, 161 aa, Neisseria gonorrhoeae
MIQIGIIMGSNSDWPVMRQAAQFLEEFGVEYEARVVSAHRTPDLMFEYAETARARGIKAIIAGAGGAAHLPGMVAAKTTVPVLGVPVPSKYLRGEDSLLSIVQMPKGVPVATFAIGEAGAANAALFAISMLANENPELAQKLADFRAKQEQTVLNMELEQI

SEQ ID NO: 4797 - DNA, 216 bp, Neisseria gonorrhoeae
ttgactatatttgtactgtctgcggcttcgtcgccttgtcctgatttaaatttaatccactatatatttcaaaaattgaaacccgcacagattgttaaaccccaaaacaggggcgggcgaaattcttccggcaatgggttcatgcaaacaaaatgccatctgaaccccgaaaacagggcttcagacggcatttgtgtattcgcggacggcgggttt

SEQ ID NO: 4798 - protein, 72 aa, Neisseria gonorrhoeae
LTIFVLSAASSPCPDLNLIHYIFQKLKPAQIVKPQNRGGRNSSGNGFMQTKCHLNPENRASDGICVFADGGF

SEQ ID NO: 4799 - DNA, 591 bp, Neisseria gonorrhoeae; identical to SEQ ID NO: 1631

SEQ ID NO: 4800 - protein, 197 aa, Neisseria gonorrhoeae; identical to SEQ ID NO: 1632

SEQ ID NO: 4801 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagcgccccgccgggccgggcggaagctgtttcggcgggcggcgtaaaggcagacgcggtcgcggcgcggcaggaaaagcggttgtcttcggcattccgaaacgcaacgggcggacctataccgttgccgcggacaatgccgagcctgaaacgttaccccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcggaaatacaacggaatcgatcgtaaaccttttccgccgttcttgagggaatgcgaatttcgacttaacttcggcacaccgtcccggcagctaaaaatcctgcgggatcggtgtggaatt

SEQ ID NO: 4802 - protein, 217 aa, Neisseria gonorrhoeae
MKITHCKLKKEVQKEPLRSFVPEVTARSAADILGIHPDSAALFYRKIRTVTNHRLALAADEVFERPAGPGGSCFGGRRKGRRGRGAAGKAVVFGIPKRNGRTYTVAADNAEPETLPPAVKKKIMPDGIVYADSPGSRGKSDAGGFTRCRINRSKEFADRRNHINGIGNFWNQAKRALRKYNGIDRKPFPPFLRECEFRLNFGTPSRQLKILRDRCGI

SEQ ID NO: 4803 - DNA, 102 bp, Neisseria gonorrhoeae
ttgaacaaacaatacaaacacatccgaaaaacgggaaccccccgtcagattgtcaacattttaaaccaaaatacccaagcaatacagcccccgttgcgcata

SEQ ID NO: 4804 - protein, 34 aa, Neisseria gonorrhoeae
LNKQYKHIRKTGTPRQIVNILNQNTQAIQPPLRI

SEQ ID NO: 4805 - DNA, 276 bp, Neisseria gonorrhoeae
gtccgccgtatggaaatactcgtcaggggtagccgcccggatgccgagcgcgtgaatcatgccgcctgaaaataaatctttgagcagcgatttgaccgttttctgacggttcagacggcttaaaccttcaaaacggccgctgacgaccaaaacggcataatgtccgccgccggtattgcccgcgtgtcctttgtgcagatggctctcatcgccgatttccaacaccagaggatcgagcgtctgcaggcgttcgcggatcaaatcgacagccggcat

SEQ ID NO: 4806 - protein, 22 aa, Neisseria gonorrhoeae
VRRMEILVRGSRPDAERVNHAA

SEQ ID NO: 4807 - DNA, 1278 bp, Neisseria gonorrhoeae
ttgtatctatttgtcgctagcatgatttttatgtttgtaaatcaatatattgatattatttcccgtgttcgggcggcatggaatcgggcggagggcaggtattttccatccttgcacaaagcctgctgcaagcctaaaatcgggcaggttattgttcagaaccagggctgcatcatgtctctttatccgatttacaatttttccgccggccctgccgtgttgcctgaagctgtgttgaggacggcgcagcaggaaatgtcggactacaacggtacgggtttttccgtgatggaaatgagccaccgttcggaaatgtttttaagcatcctgcatcatgcggaacaggatttgaggcagcttttgaaagtgcctgacaactataagatattgtttcttcagggcggagcaacaacccaatttaatatggcagccatgaatctggcacacggtttccgcactgccgacgcggtggtaacgggcaactggagccgtatcgcctatgaacagatgagccgtttgaccgatacggaaatccgtttggcggcgcacgggggcgagcagttcgactatctcgacctgccgcctgtggaaacgtgggatgttgcacccgattcggcgtttgtccattttgccgtcaatgaaactgtcaacgggctgcaataccgtgaagtgccgcgcctttcagacggcatgccgccgttggtgtgcgatatgtccagcgagattctgtcgcgtgagtttgatgttgccgactacggactgatttacgcaggcgcacagaaaaacatcgggccggcaggagttacggtggtgattgtgcgtgaggatttgctcgagcgttgtccgaacgatattcccgatgtgttcaactaccgttctcatttgaaccgcgacggtatgtacaacacgccgtcaacttacgcgatttatatgtcggggctggtgttccgctggctgcaggcgcagggcggtgtgaaaaaaattgaagcggtcaatcggctgaaggcgcaaaccttgtatgagacgatagatggcagcggcggtttttacatcaacgatattcatcctgatgcgcgctccaaaatgaacgtggtcttcaaaaccgcaagcgaagacttggaccgccgttttgtgctggaagccgaattgcagggcttgtgcctgttgaagggctataagtctgtcggcgggatgcgcgccagcatttataatgcgatgccgcttgaaggcgtgcgggctttggcagattttatgcgcgatttccaacggcgttacggt

SEQ ID NO: 4808 - protein, 426 aa, Neisseria gonorrhoeae
LYLFVASMIFMFVNQYIDIISRVRAAWNRAEGRYFPSLHKACCKPKIGQVIVQNQGCIMSLYPIYNFSAGPAVLPEAVLRTAQQEMSDYNGTGFSVMEMSHRSEMFLSILHHAEQDLRQLLKVPDNYKILFLQGGATTQFNMAAMNLAHGFRTADAVVTGNWSRIAYEQMSRLTDTEIRLAAHGGEQFDYLDLPPVETWDVAPDSAFVHFAVNETVNGLQYREVPRLSDGMPPLVCDMSSEILSREFDVADYGLIYAGAQKNIGPAGVTVVIVREDLLERCPNDIPDVFNYRSHLNRDGMYNTPSTYAIYMSGLVFRWLQAQGGVKKIEAVNRLKAQTLYETIDGSGGFYINDIHPDARSKMNVVFKTASEDLDRRFVLEAELQGLCLLKGYKSVGGMRASIYNAMPLEGVRALADFMRDFQRRYG

SEQ ID NO: 4809 - DNA, 294 bp, Neisseria gonorrhoeae; identical to SEQ ID NO: 1633

SEQ ID NO: 4810 - protein, 98 aa, Neisseria gonorrhoeae; identical to SEQ ID NO: 1634

SEQ ID NO: 4811 - DNA, 90 bp, Neisseria gonorrhoeae; identical to SEQ ID NO: 2155

SEQ ID NO: 4812 - protein, 30 aa, Neisseria gonorrhoeae; identical to SEQ ID NO: 2156

SEQ ID NO: 4813 - DNA, 150 bp, Neisseria gonorrhoeae; identical to SEQ ID NO: 2157

SEQ ID NO: 4814 - protein, 50 aa, Neisseria gonorrhoeae; identical to SEQ ID NO: 2158

SEQ ID NO: 4815 - DNA, 309 bp, Neisseria gonorrhoeae
ttgctccctgccgtcaaaaagaaaatcatgccggacggtattgtttatgccgatagcccgggcagccgcggcaagttggacgcgggcggttttacccgttgccgcatcaaccgttccaaggaatttgcagaccgtcggaaccacattaacggcattgggaacttttggaatcaggcaaaacgcgccttgcgaaaatacaacggaatcgatcgtaaacctttcccgccgttgttgagggaatgcgaatttcgacttaacttcggcacaccgccccggcagctaaaaatcctgcgggatcggtgtggaatt

SEQ ID NO: 4816 - protein, 103 aa, Neisseria gonorrhoeae
LLPAVKKKIMPDGIVYADSPGSRGKLDAGGFTRCRINRSKEFADRRNHINGIGNFWNQAKRALRKYNGIDRKPFPPLLRECEFRLNFGTPPRQLKILRDRCGI

SEQ ID NO: 4817 - DNA, 906 bp, Neisseria gonorrhoeae; identical to SEQ ID NO: 79

SEQ ID NO: 4818 - protein, 302 aa, Neisseria gonorrhoeae; identical to SEQ ID NO: 80

SEQ ID NO: 4819 - DNA, 186 bp, Neisseria gonorrhoeae
ttgggggacgttgtgccggatggcgtaaacggcggcctgcacccggctgctgaggttgagtttgcggagcaggttttgaacgtggactttgacggtggattcggcaagatcgaggtggcgggcgatgattttgttgctgtgtcctgcggcgagatagcccaagatttccagttcacgaggggtaag

SEQ ID NO: 4820 - protein, 62 aa, Neisseria gonorrhoeae
LGDVVPDGVNGGLHPAAEVEFAEQVLNVDFDGGFGKIEVAGDDFVAVSCGEIAQDFQFTRGK

SEQ ID NO: 4821 - DNA, 654 bp, Neisseria gonorrhoeae
atgaccatcaaaatcatcctgatagacgaccacaccctcttccgcagcggcatcaaagcccttttgtcgcgccaacacggttttgaagtcatcggcgaagccgcagacggactctcgggcatcaaaatgatcagtcggctgcaacccgatgtcgtcctgctcgatttggatatgccaggcatgaacgggcgcgaggccttgtcccaaatcatcagcatcaatccgcagcaggcagtcattatgctgaccgtttccgaagacagcgacgaccttaccgaatgtatgcgcatcggcgcgcgcggctacctgctgaaaaacatcaacgccgattttcttctcgaaagcatacgcaaagccgccgaaggcgataatgtattctcgcccgagatgaccgccaaactcgtcaaaagcctgatttccccccaacctgcccaaaggacgcaggcactctcctcacttacccctcgtgaactggaaatcttgggctatctcgccgcaggacacagcaacaaaatcatcgcccgccacctcgatcttgccgaatccaccgtcaaagtccacgttcaaaacctgctccgcaaactcaacctcagcagccgggtgcaggccgccgtttacgccatccggcacaacgtcccccaacctgtgccggaa

SEQ ID NO: 4822 - protein, 218 aa, Neisseria gonorrhoeae
MTIKIILIDDHTLFRSGIKALLSRQHGFEVIGEAADGLSGIKMISRLQPDVVLLDLDMPGMNGREALSQIISINPQQAVIMLTVSEDSDDLTECMRIGARGYLLKNINADFLLESIRKAAEGDNVFSPEMTAKLVKSLISPQPAQRTQALSSLTPRELEILGYLAAGHSNKIIARHLDLAESTVKVHVQNLLRKLNLSSRVQAAVYAIRHNVPQPVPE

SEQ ID NO: 4823 - DNA, 1029 bp, Neisseria gonorrhoeae
atgggcatcaaagtcgccatcaacggctacggacgcatcggccgccaggttttgcgcgccatctacgactatcagattcaagaccaactccaaatcgtcgccgtcaacgccagcggcagccttgaaaccaacgcccatctgaccaaattcgacaccgtacacggacgctttgaagccgacgtatcccacgacggcggcaacctcatcgtcaacggcgacaaaatccccttcttctcgacccgcaaccctgccgaactgccgtggaaagaactcggtgtcgatttggtcatggaatgcaccggcgcgttcaccagcaaagaaaaagccaaaatccacctcgaaagcggcgcgaaaaaagtcctcatttccgcaccgggcggcgacgatgtcgatgcaaccgtcgtgtacggcgtgaacgacagcgtcctgaccgccgacatgaccgtcgtttccaacgcttcctgcaccaccaactgcctctcgccggttgccaaagtgttgagcgaaagcgtcggcatcgtcaaaggcgcaatgaccaccatccacgcactgaccaacgaccaaaccgttaccgacgtgcgccacaaagacctgcgccgcgcccgcagcggcgtggaaaacatgattccgaccaaaaccggcgcggcaaaagccgtcggtttggtcttgcccgaattgaaaggcagactcgacgggcttgccatccgcgtgccgaccgtcaacgtatccttggtagatttgagcttccaagccgcgcgcgacaccacagtcgaagaaatcaacgcactgatgaaagccgtctcggaagcaggcgcgctcaaaggcgttttgggctacaacaccctgccattggtttccatggacttcaaccacaccaccgaagccagccacttcgacgcaacgctgaccaaagtcgtcgacggcaacatggtcaaagtgttcgcgtggtatgacaacgaatggggcttcagctgccaaatgctgaacaccgcacgccgtatgttcggacttgaagtgcgcccgctcaaa

SEQ ID NO: 4824 - protein, 343 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAVSEAGALKGVLGYNTLPLVSMDFNHTTEASHFDATLTKVVDGNMVKVFAWYDNEWGFSCQMLNTARRMFGLEVRPLK

SEQ ID NO: 4825 - DNA, 1767 bp, Neisseria gonorrhoeae
atgatactgccaacccgattttcagacggcatccccctttccctgcgcctgaaactcctgaccggcttgtgggtcggtttggcggcactgtctgtcgttttaacgctgctgctttctttccgcctggaaaatgccgcctcggtcatcgaagaggcgggcaatctgaagatgcaggcataccggcttgcctatatggcgggcgaaggctcgccccgcgcacaaatcgacaatcagattgccgaatttgaaaaaagtttaaaacgcatttcccaaagcgatgccatccatccgctgattccctccgacaatccccttgcctacgatttgatacagtccatgctgattatcgactggcaggccaacatcctccccccgttgcaggcataccgccgccccacacaaatcgagctttaccgctttgccggcaatatcgaactgtttttgcaggcgttggaaaatgccggcgaaaaaaacacttggtggctcaggcggtttcaatgggtcattatgctgatgacgctggtgtcgtccgtgctgatgcttttttggcaccagatttgggttatccgtccgctgcaggcgttaagggaaggtgcggaacgcatcggtcagcggcatttcgacatccctgttcccgaagacggtacgcccgaattcaaacaggtcgggcggtgtttcaaccaaatggcgctcaggctgaagactttatacgatgatttggaaggacaggttgccgaacaaacccacaaccttgaaaagcaaaaccgcaacctgaccctgctgtaccggaccacgcgcgacctgcatcaatcctatacgccgcgacaggcggcggaagaatttttgaaccacatcctgcccgccgtcggcgcgcaatccggcaacatctgcctggaaaacggttccgacacagacatttccgtccatacggccgaacacggcaaaaagccccctttggaaaaataccatgacgaaaccttccccatcgaatatcaaaacgagaaactgggcatgctttcgctcggcttttcagacggcacttccctcaccggagacgaccgcacgctgcttcaaaccctgattcggcaattgggcgtatcgctcgccggggcgaaacaggaggaagaaaaacgtctgcttgccgtattgcaggaacgcaacctgattgcacaggggctgcacgacagcatcgcgcaggcattaaccttcctgaacctgcaggtacagatgctggaaaccgcctttgccgaaaacaaacgggaggaagccgcagaaaacatcggctttatcaaaacaggcgtgcaggaatgttatgaagatgtccgcgaactgctgctcaatttccgtaccaaaatcagcaataaagaatttcccgaagctgttgccgacctgttcgcgcgcttcacgcaacaaaccgggataacggtcgaaaccgtttgggaaaacggttcgttcctgcctacacaggacgagcagctccaaatgattttcatcctgcaagaaagcctgtccaacatccgcaaacacgcccgcgccacccatgtaaaattcaccctttccgaatacggcggacgctttaccatgaccatccaagacaacggacaaggtttcgacacggagaaaataggagaacctacgggcagccatgtcggactgcacatcatgcaggagcgtgccaaacgcatccgtgccgttttagaaatccgttcccaagcacaacagggaaccaccgtctcattgacgggcgcacccaaagaaagcctacca

SEQ ID NO: 4826 - protein, 589 aa, Neisseria gonorrhoeae
MILPTRFSDGIPLSLRLKLLTGLWVGLAALSVVLTLLLSFRLENAASVIEEAGNLKMQAYRLAYMAGEGSPRAQIDNQIAEFEKSLKRISQSDAIHPLIPSDNPLAYDLIQSMLIIDWQANILPPLQAYRRPTQIELYRFAGNIELFLQALENAGEKNTWWLRRFQWVIMLMTLVSSVLMLFWHQIWVIRPLQALREGAERIGQRHFDIPVPEDGTPEFKQVGRCFNQMALRLKTLYDDLEGQVAEQTHNLEKQNRNLTLLYRTTRDLHQSYTPRQAAEEFLNHILPAVGAQSGNICLENGSDTDISVHTAEHGKKPPLEKYHDETFPIEYQNEKLGMLSLGFSDGTSLTGDDRTLLQTLIRQLGVSLAGAKQEEEKRLLAVLQERNLIAQGLHDSIAQALTFLNLQVQMLETAFAENKREEAAENIGFIKTGVQECYEDVRELLLNFRTKISNKEFPEAVADLFARFTQQTGITVETVWENGSFLPTQDEQLQMIFILQESLSNIRKHARATHVKFTLSEYGGRFTMTIQDNGQGFDTEKIGEPTGSHVGLHIMQERAKRIRAVLEIRSQAQQGTTVSLTGAPKESLP

SEQ ID NO: 4827 - DNA, 156 bp, Neisseria gonorrhoeae
ttggcagtatcatattcggaggaaagtcgttttaaacggtgcaaacaatatcattctttggaattagaaacaactgctcagaaaggacaggttaaggaaaacttaagcctcaatgctttcagtgttaaatcacgttatgataaaattcaaataaca

SEQ ID NO: 4828 - protein, 52 aa, Neisseria gonorrhoeae
LAVSYSEESRFKRCKQYHSLELETTAQKGQVKENLSLNAFSVKSRYDKIQIT

SEQ ID NO: 4829 - DNA, 612 bp, Neisseria gonorrhoeae
atgaaaacctcaaactttcccaaaagcccgcccgcattaaaaacgttcgcattgattttggcaggaggcctggccgaccgtatgggcggggaagacaaagggctggcactgttggaaggcagaccgctgattgaccgcgttatcggtaaaatcaggccgcaggtcagccatatcgtcatcagtgccaaccggaatttggaagaatacgcccgccgcagcccgcatgtttttccggatgcccggcagtggcagcatttcggcccgctttcggcattgtgtaccgcagccaacgatttgcagttggcggcggccgattggctgctgattgtaccttgcgatatgccgtatctgccggacgatttggtcgcgcgctttgaaagcgtctccaaacgcacaccgttgtgcaatgcgttttatgtggaaacgccggtaacgatgcactacaacattatgtatatccgtccgcaaattctgcaaagcgcgattccttatctgttttcgggtatgaaaacattaagaagctggttgcagcagcaaagggcgcggccggtcagattcgagtttgacgggcattttgccgacttgaacacgcaaaccgatttgcaggaggga

SEQ ID NO: 4830 - protein, 204 aa, Neisseria gonorrhoeae
MKTSNFPKSPPALKTFALILAGGLADRMGGEDKGLALLEGRPLIDRVIGKIRPQVSHIVISANRNLEEYARRSPHVFPDARQWQHFGPLSALCTAANDLQLAAADWLLIVPCDMPYLPDDLVARFESVSKRTPLCNAFYVETPVTMHYNIMYIRPQILQSAIPYLFSGMKTLRSWLQQQRARPVRFEFDGHFADLNTQTDLQEG

SEQ ID NO: 4831 - DNA, 777 bp, Neisseria gonorrhoeae
gtgcaagaccgccgaccggcgcggaaaggaaaggtcaaggcgtaccgggcggtttttgcccgaaccggaggcacaatgccgtctgaaggagtttcagacggcatttttcgcggggaaatgctacaatttgcaccatttttaccgacacagggaaacaggattatgtttacaggcattgttcaaggattgggaaaactgacggcaatccaccgcccgtcggaggcgtttcagacttatgtcgtcgagcttccgcaagaggcggcagaaaacctgcaacacggcgcatcggtcgccaataacggctgctgcctgacgattactgaaatcgaaggaaaccgcgtcagcttcgatttaatggcagaaactttggcaaaaaccaatttggggctgctgaaggaaggcgattgcgtcaacatcgaacgggcggcacgtttcggcgacgaaatcggcggacacgtcatgagcggacacattatggcaaccgtgcccattgtcgaaatcgaacgggacgggttcaaccgcacggtttggtttgcgctcccgcacgaactcaaaccctatatcctgaccaaagggttcgtcggcttggacggttgcagcctgaccataggcaaagtcgaagacagccgtttcaatgtccatctgattcccgaaactttggaacggacgctgttcggcagcagaaaggccggagacaggatcaacatcgaaatcgatccgaatacgcaggcaatcgtcgacaccgtcgaacggctgatggcgcaaagatatgcaaag

SEQ ID NO: 4832 - protein, 259 aa, Neisseria gonorrhoeae
VQDRRPARKGKVKAYRAVFARTGGTMPSEGVSDGIFRGEMLQFAPFLPTQGNRIMFTGIVQGLGKLTAIHRPSEAFQTYVVELPQEAAENLQHGASVANNGCCLTITEIEGNRVSFDLMAETLAKTNLGLLKEGDCVNIERAARFGDEIGGHVMSGHIMATVPIVEIERDGFNRTVWFALPHELKPYILTKGFVGLDGCSLTIGKVEDSRFNVHLIPETLERTLFGSRKAGDRINIEIDPNTQAIVDTVERLMAQRYAK

SEQ ID NO: 4833 - DNA, 879 bp, Neisseria gonorrhoeae
atgcaaagtgaggtagagatggaattgaacgaattcctcgataaagcctatgccgttttgcggcgtttggatgccgtgcttccgcccgaacccgggcatacggattggaacgcgcttgccttccgctggcagagtgcgggcaaaaaaggttttttggaacacttgcccgatccgcacgttttccctttgtcgcggcttgccggagtcggcaggcagaccgaattgctggtgcgtaataccgaacaatttattgccggcagacctgcgaataacgtattgatgagcggcgcgcgcggaacaggcaaatcctcgctggtcaaagccctgctgcacgaatatgcggataagggattgcgcctgatcgaagtcgataaaagcgatttgatcggcctgccgtatctgttggcacttttgaaggaacgcccggaaaaattcattgtgttttgcgacgatttgtcatttgaaagcggcgacgaaacctataaggcattgaaaacggcattggatggcggtctgtcccaacgttgcgccaacgtgatggtgtacgcgacttccaacagacggcatctgatgcccgaatatttggatgaaaatgcaggtacgacaggcgtgcgcggagaaatccatcaaaaagaggccgtggaagaaaaagtatctttgtccgaccgattcggattgtggctcagtttttatccgttcgatcaaaacgattatctggcggcagtgcgaagctggttggaagattttgatgtgccatatgacgaagccgcccggacggcggcgttgcagtgggcgcagatgcggggcaaccgctcgggacgttccgcttggcagtttgcctgcgactgggcgggcaggctgccggagcaacgtgcgccg

SEQ ID NO: 4834 - protein, 293 aa, Neisseria gonorrhoeae
MQSEVEMELNEFLDKAYAVLRRLDAVLPPEPGHTDWNALAFRWQSAGKKGFLEHLPDPHVFPLSRLAGVGRQTELLVRNTEQFIAGRPANNVLMSGARGTGKSSLVKALLHEYADKGLRLIEVDKSDLIGLPYLLALLKERPEKFIVFCDDLSFESGDETYKALKTALDGGLSQRCANVMVYATSNRRHLMPEYLDENAGTTGVRGEIHQKEAVEEKVSLSDRFGLWLSFYPFDQNDYLAAVRSWLEDFDVPYDEAARTAALQWAQMRGNRSGRSAWQFACDWAGRLPEQRAP

SEQ ID NO: 4835 - DNA, 1341 bp, Neisseria gonorrhoeae
atgattaaaatcaaaaaaggtctaaatctgcccatcgcgggcagaccggagcaagtcatttatgacggcccggccattaccgaagtcgcgttgcttggcgaagaatatgtcggcatgcgcccctcgatgaaaatcaaggaaggtgaagccgtcaaaaaaggccaagtgctgtttgaagacaaaaagaatccgggcgtagtatttactgcgccggcttcaggcaaaatcgccgctattcaccgtggcgaaaagcgcgtacttcagtcagtcgtgattgccgttgaaggcaacgacgaaatcgagttcgaacgctacgtacctgaagcgctggcaaaattgagcagcgaaaaagtgcgccgcaacctgattcaatcaggcttatggactgcgcttcgcacccgtccgttcagcaaaatccctgccgtagatgccgagccgttcgccatcttcgtcaatgcgatggacaccaatccgctggctgccgaccctacggtcatcatcaaagaagccgccgaagacttcaaacgcggcctgttggtattgagccgcctgaccgaacgtaaaatccatgtgtgtaaagcagcaggcgcagacgtgccgtctgaaaatgctgccaatatcgaaacacatgaatttggcggcccgcatcctgccggcttgagtggcacgcacattcatttcatcgagccagtcggcgcgaataaaaccgtgtggaccatcaattatcaagacgtgattgctatcggacgtttgttcgtaacaggccgtctgaataccgagcgcgtggttgccttgggcggcctgcaagtcaacaaaccgcgcctcttgcgtaccgttttgggtgcgaaggtgtctcaacttaccgccggcgaattggttgacgcggacaaccgcgtgatttccggttcggtattgaacggtgcgattgcacaaggcgcgcatgattatttgggacgctaccacaatcagatttccgttatcgaagaaggccgcagcaaagagctgttcggctgggttgcgccgcagccggacaaatactccatcacgcgcaccactctcggccatttcctaaaaaacaaactcttcaagttcacgacagccgtcaacggcggcgaccgcgccatggtaccgatcggcacttatgagcgcgtaatgccgttggacatcctgcctaccttgcttttgcgcgatttaatcgtcggcgataccgacagcgcgcaggctttgggttgcttggaattggacgaagaagacctcgctttgtgcagcttcgtctgcccgggcaaatacgaatacggcccgctgttgcgcaaagtgctggaaaccattgagaaggaaggc

SEQ ID NO: 4836 - protein, 447 aa, Neisseria gonorrhoeae
MIKIKKGLNLPIAGRPEQVIYDGPAITEVALLGEEYVGMRPSMKIKEGEAVKKGQVLFEDKKNPGVVFTAPASGKIAAIHRGEKRVLQSVVIAVEGNDEIEFERYVPEALAKLSSEKVRRNLIQSGLWTALRTRPFSKIPAVDAEPFAIFVNAMDTNPLAADPTVIIKEAAEDFKRGLLVLSRLTERKIHVCKAAGADVPSENAANIETHEFGGPHPAGLSGTHIHFIEPVGANKTVWTINYQDVIAIGRLFVTGRLNTERVVALGGLQVNKPRLLRTVLGAKVSQLTAGELVDADNRVISGSVLNGAIAQGAHDYLGRYHNQISVIEEGRSKELFGWVAPQPDKYSITRTTLGHFLKNKLFKFTTAVNGGDRAMVPIGTYERVMPLDILPTLLLRDLIVGDTDSAQALGCLELDEEDLALCSFVCPGKYEYGPLLRKVLETIEKEG

SEQ ID NO: 4837 - DNA, 684 bp, Neisseria gonorrhoeae; identical to SEQ ID NO: 567

SEQ ID NO: 4838 - protein, 228 aa, Neisseria gonorrhoeae; identical to SEQ ID NO: 568

SEQ ID NO: 4839 - DNA, 1062 bp, Neisseria gonorrhoeae
acaaaggaacaaaccatgggcatcaaagtcgccatcaacggctacggacgcatcggccgccaggttttgcgcgccatctacgactatcagattcaagaccaactccaaatcgtcgccgtcaacgccagcggcagccttgaaaccaacgcccatctgaccaaattcgacaccgtacacggacgctttgaagccgacgtatcccacgacggcggcaacctcatcgtcaacggcgacaaaatccccttcttctcgacccgcaaccctgccgaactgccgtggaaagaactcggtgtcgatttggtcatggaatgcaccggcgcgttcaccagcaaagaaaaagccaaaatccacctcgaaagcggcgcgaaaaaagtcctcatttccgcaccgggcggcgacgatgtcgatgcaaccgtcgtgtacggcgtgaacgacagcgtcctgaccgccgacatgaccgtcgtttccaacgcttcctgcaccaccaactgcctctcgccggttgccaaagtgttgagcgaaagcgtcggcatcgtcaaaggcgcaatgaccaccatccacgcactgaccaacgaccaaaccgttaccgacgtgcgccacaaagacctgcgccgcgcccgcagcggcgtggaaaacatgattccgaccaaaaccggcgcggcaaaagccgtcggtttggtcttgcccgaattgaaaggcagactcgacgggcttgccatccgcgtgccgaccgtcaacgtatccttggtagatttgagcttccaagccgcgcgcgacaccacagtcgaagaaatcaacgcactgatgaaagccgtctcggaagcaggcgcgctcaaaggcgttttgggctacaacaccctgccattggtttccatggacttcaaccacaccaccgaagccagccacttcgacgcaacgctgaccaaagtcgtcgacggcaacatggtcaaagtgttcgcgtggtatgacaacgaatggggcttcagctgccaaatgctgaacaccgcacgccgtatgttcggacttgaagtgcgcccgctcaaataagcaacaaaccgtcaa

SEQ ID NO: 4840 - protein, 348 aa, Neisseria gonorrhoeae
TKEQTMGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAVSEAGALKGVLGYNTLPLVSMDFNHTTEASHFDATLTKVVDGNMVKVFAWYDNEWGFSCQMLNTARRMFGLEVRPLK

SEQ ID NO: 4841 - DNA, 321 bp, Neisseria gonorrhoeae
gtgttggatttccaattcgtccaccgcaaaatccatgctggagtggtagcggctttcgacataatcgcgcgcctcgttccgattaaaaacatccgaagaaatgatttcgacgacagagcggcggcggctgtgttcggaatgcataaccttcaaacgcgccctgtcgcccgccattttgaaggcggcgcggattttacgcagctcattgtgctgaccctgtgtcagcccgagccggcgtatgtcgcagttcggttgaaaatcgttcggggggatataagccgtggcggcgtgggaaagctggcaggaaagcaaagccatact

SEQ ID NO: 4842 - protein, 107 aa, Neisseria gonorrhoeae
VLDFQFVHRKIHAGVVAAFDIIARLVPIKNIRRNDFDDRAAAAVFGMHNLQTRPVARHFEGGADFTQLIVLTLCQPEPAYVAVRLKIVRGDISRGGVGKLAGKQSHT

SEQ ID NO: 4843 - DNA, 141 bp, Neisseria gonorrhoeae
gtggcggcgtgggaaagctggcaggaaagcaaagccatacttaaaaaagaggcggcaggtttggcaaaacggcagggagcaggcagcggcacggcttttcctttaatccggatatttcggacaatatacttgattgccgtg

SEQ ID NO: 4844 - protein, 47 aa, Neisseria gonorrhoeae
VAAWESWQESKAILKKEAAGLAKRQGAGSGTAFPLIRIFRTIYLIAV

SEQ ID NO: 4845 - DNA, 234 bp, Neisseria gonorrhoeae
atggcgggcgacagggcgcgtttgaaggttatgcattccgaacacagccgccgccgctctgtcgtcgaaatcatttcttcggatgtttttaatcggaacgaggcgcgcgattatgtcgaaagccgctaccactccagcatggattttgcggtggacgaattggaaatccaacaccgcttcttccatattctcacaccgcaacagcagcaaatgtggctttcttcctgcctcaaa

SEQ ID NO: 4846 - protein, 78 aa, Neisseria gonorrhoeae
MAGDRARLKVMHSEHSRRRSVVEIISSDVFNRNEARDYVESRYHSSMDFAVDELEIQHRFFHILTPQQQQMWLSSCLK

SEQ ID NO: 4847 - DNA, 780 bp, Neisseria gonorrhoeae
atggtattatggcagttaacttttgttaataatgctgtttcgaggctttcccgcgttgagtccgcccataaaggcattgaaggaaaaaatatgaccgcctaccgtatcgcacccagtattttgtcggcagactttgcccgcctcggagaagaggtggcaaatgtcattgcggcgggtgcggatctgatccattttgacgtgatggacaaccattatgtgccgaacctgaccttcggacctatggtctgcgcggcgttgaagccttatgcaagcgtgccgatcgatgtgcatctgatggtcgaacccgttgacgatttaattcaatcgtttgccaaagcaggagcatcgattatcactttccatcccgaagcgagccgccatatcgaccgcagcttgagcctgattcgggacatgggctgtcaggcggggctggtgttgaatccggcaacgcccgtatatgtgttggaaaacgtgttagacaggctggatatggttttgctgatgtcggtcaaccccgggttcggcggtcagagcttcattccgcacactttggaaaaaatcagacaggttcgcgccatgcttgaccgctatgaagggaaaagcggcagacgtattgccattgaagtggacggcggcatcaaaactgacaatattgccgccgttgcccgagccggtgcggatacctttgttgccggttcggcgattttcggcaaaccggattacaaggcggtaatcgctgcgatgagggcggaactggaaaaagcggccagggctgaacct

SEQ ID NO: 4848 - protein, 260 aa, Neisseria gonorrhoeae
MVLWQLTFVNNAVSRLSRVESAHKGIEGKNMTAYRIAPSILSADFARLGEEVANVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYVLENVLDRLDMVLLMSVNPGFGGQSFIPHTLEKIRQVRAMLDRYEGKSGRRIAIEVDGGIKTDNIAAVARAGADTFVAGSAIFGKPDYKAVIAAMRAELEKAARAEP

SEQ ID NO: 4849 - DNA, 144 bp, Neisseria gonorrhoeae
atgccgtctgaaaccgaaccgggtttcatacggcattgttatcagacgtttgcaccggcaccggtttcgtcacttaacagaaaccttttgtccggcaggacagattctcccccgatgaaaataactgtttccgtggcaaacggt

SEQ ID NO: 4850 - protein, 48 aa, Neisseria gonorrhoeae
MPSETEPGFIRHCYQTFAPAPVSSLNRNLLSGRTDSPPMKITVSVANG

SEQ ID NO: 4851 - DNA, 1029 bp, Neisseria gonorrhoeae
atgctgcaaaccgacaacctgaccgccgcgcaaccgcaacgcatcgttgccgcccaaaccgcctccgcacaggaagaactgctcgaacgcgccctccgccccaaaacgctggacgactacatcgggcagcataaagccaaagagcagctcgccatcttcatccaagccgccaaaaaacgcggcgaagcactcgaccacgtcctgcttttcggcccgcccggactgggcaaaaccacccttgcccacatcatcgccaaagagttgggcgtaaatttgcgccaaaccagcggccccgtcctcgaacgcgccggcgacctcgccgcccttttgaccaaccttgatccgcacgacgtattgtttatcgacgaaatccaccggctaagccccgtcgtcgaggaaatcctctatcccgcgctcgaagactaccggctcgacattatgataggcgaaggacccgccgcacgttccgtcaaaatcgacctgccgccctttaccctcgtcggcgcgaccacccgcgccggtatgctgaccaacccgttgcgcgaccgcttcggcatcgtctcccgcctcgagttttacgaaaaccgcgaccttaccaccatcgtcagccgttcggcacaactgttgcagctcgatatgggcgaagaaggcgcgatggaagtcgccaaacgcagccgcggcacgccccgcatcgccaaccgcctgttgcgccgcgtgcgcgatttcgccgacgtgaaaaacaacggcgtaatcgatgccgccgtcgccgatgccgctttaagtatgctggacgtagacgcgcaggggctggacgtgatggacaggaaattcctcgaagccgttttgcacaaattcggcggcggccccgtcggtttggacaacgttgccgccgccatcggcgaatctacggacaccatcgaagacgttatcgaaccctacctcatccaacaaggctttttgcaacgcaccccgcgcggcaggatggcgaccgaacgcgcctacctgcatttcgggctgcccgtcgaaaaa

SEQ ID NO: 4852 - protein, 343 aa, Neisseria gonorrhoeae
MLQTDNLTAAQPQRIVAAQTASAQEELLERALRPKTLDDYIGQHKAKEQLAIFIQAAKKRGEALDHVLLFGPPGLGKTTLAHIIAKELGVNLRQTSGPVLERAGDLAALLTNLDPHDVLFIDEIHRLSPVVEEILYPALEDYRLDIMIGEGPAARSVKIDLPPFTLVGATTRAGMLTNPLRDRFGIVSRLEFYENRDLTTIVSRSAQLLQLDMGEEGAMEVAKRSRGTPRIANRLLRRVRDFADVKNNGVIDAAVADAALSMLDVDAQGLDVMDRKFLEAVLHKFGGGPVGLDNVAAAIGESTDTIEDVIEPYLIQQGFLQRTPRGRMATERAYLHFGLPVEK

SEQ ID NO: 4853 - DNA, 306 bp, Neisseria gonorrhoeae
atgaccctgaaaaccgatttattgcctaaaatcaacaacgaagattatcaacgcctcatcctcaaacatagcgcggaattcagcggcggagaaacccgcctgttgaacgaaatcctcgaaaaattcaatttcgacgttgttcaggcgcaggcattggcgcaggcggtaatgcagcaagttcgcttcgatcccaacgcctaccacatcgacagcgacgacgaagacaccaccggcatctgcccccactgcatcaacccgcctatgccgcccctgcacgactatctcgtttggcgcgaaacacgcgga

SEQ ID NO: 4854 - protein, 102 aa, Neisseria gonorrhoeae
MTLKTDLLPKINNEDYQRLILKHSAEFSGGETRLLNEILEKFNFDVVQAQALAQAVMQQVRFDPNAYHIDSDDEDTTGICPHCINPPMPPLHDYLVWRETRG

SEQ ID NO: 4855 - DNA, 156 bp, Neisseria gonorrhoeae
atgttttcaagtttcagacggcacttttcatttttgaccgcgattttacccggctgtcgtcatttccaattttatagtggattaaatttaaaccggtacggcgttgcctcgccttgccgtactatttgtactgtctgcggcttcgccgccttgtcc

SEQ ID NO: 4856 - protein, 52 aa, Neisseria gonorrhoeae
MFSSFRRHFSFLTAILPGCRHFQFYSGLNLNRYGVASPCRTICTVCGFAALS

SEQ ID NO: 4857 - DNA, 1230 bp, Neisseria gonorrhoeae
atgggcttaaaacattttctggaaaaaatcgaaccgcacttcctgccgggcggcaaacatgaaaaatggtatgccctctatgaagctgcggcgacgattttctatacatccggcgcggtaacgcgcaaagcggcgcacgtccgcgacgcgctcgactccaaacgcatgatgattttggtgtggctggctttgttccccgccatgttttacggcatgtacaacgtcggcgcacaggcattcggtgccttaacgcccgatttgctgcaacaaagcatcgccaacgactggcattacgcccttgccaacgctttgggcatcaatatgtcgcctgaagcgggcgtgttgggcaaaatgctgttcggcgcgatttacttcctgccgatttacgcgaccgtatttattgtgggcggcttctgggaagtcttgttcgcatccgtacgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgcgccttcctgttcttcgcctaccccgccaacttgagcggcgatgcggtttggacggcggttgacggctattccggcgcaaccgcgctggcgcaatgggcggcacacggtgcagacggcctgaaaaacgccgtaaccggtcaaaccatcacttggatggacgcgtttatcggcaaactgcccggctccatcggcgaagtctccactttggcactcttaatcggcggcgcgtttatcgtgtttgcccgcatcgcttcttggcgcattattgccggcgtgatgatcggtatgattgcgatgtcttcgctgtttaacttcatcggttctgacaccaacgctatgtttgctatgccttggtactggcacttggtggtcggcggcttcgccatcggtatgctgtttatggcgaccgaccccgtttccgcttcctttaccaatgtcggcaaatggtggtacggcgcgcttatcggcgtaatgtgcgtgttaatccgcgtggccaatccggcttaccccgaaggcatgatgttggcgattctgtttgccaacctgtttgccccgattttcgactatttcgtcgcacaagcgaacatcaaacgcagaaaggcgcgcagcaatggc

SEQ ID NO: 4858 - protein, 410 aa, Neisseria gonorrhoeae
MGLKHFLEKIEPHFLPGGKHEKWYALYEAAATIFYTSGAVTRKAAHVRDALDSKRMMILVWLALFPAMFYGMYNVGAQAFGALTPDLLQQSIANDWHYALANALGINMSPEAGVLGKMLFGAIYFLPIYATVFIVGGFWEVLFASVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVANPAYPEGMMLAILFANLFAPIFDYFVAQANIKRRKARSNG

SEQ ID NO: 4859 - DNA, 204 bp, Neisseria gonorrhoeae
ttgttcagcggaaccgatttctatccggacggaacagccggctttccccttgcaaacggatggaatcaagcgggtattcaaacacagccgtttatttttattccgccgccaagttatgggatagggtttgcgtgtttcgggcaggcaaaccgcgcaaccttagacgcagtccgaagttttgaaggcggcatccgggccgggttt

SEQ ID NO: 4860 - protein, 68 aa, Neisseria gonorrhoeae
LFSGTDFYPDGTAGFPLANGWNQAGIQTQPFIFIPPPSYGIGFACFGQANRATLDAVRSFEGGIRAGF

SEQ ID NO: 4861 - DNA, 1032 bp, Neisseria gonorrhoeae
ttgcagcggggcgatttgcgccagccgcgcccggtcgatttgttcggcgataaagtgcgcttttccctgcgcgcggcattcggcggcgattttgcccgaatccgcctgattggcggcttcgagcagggcgagccagtgcgcgcgttgcgggtagggcgtgtgttcgcggttcagacggccttgcgtgtcggcaatgcagacgttcaatgccgtctgaaaacgctcgggacggcggaaggcatcggtttttttcaatacgttcagaatggtttggcttttaagctgtccgacttggtggaaaataatgtgccaacggcaaaccaattcggcaagctcggcacactgcctcggcgcgcgcagccgttgattgacttcgcgcacgggttctacgccgttgatgtcgtgtccgtggtggcgcggcaggatgtcgggcggtgttttggctttgcccaagtcgtgcagcagggcggcatagcgttcgggcaggctcaaacccatatcggcggcgcgttgcagcgtcatcagggtatggatgccgctgtcgatttcgggatggtagtcggcgcgttgcggcacgccgaagagggcgtcgacttcgggcagcaagacttggagtgcgccgcattcgcgcaacatttcaatcattttgcgcggatttttttccatcaaacctttcgccaactcctgccagacgcgttcggcaaccaatgcgtccgcttcgccgttttccaccatctgccgcatcagctttatggtttcttcggcgatttcaaagccgtaacgcgcggcaaagcgggcggcacgaaggatgcggacgggatcttcggcgaaggcgggcgagacgtggcgcaaaatgcctgccgccaaatcccgttgcccgccgaaagggtcgataatcttgccgtccgcatcttgcgccatcgcgttgatggtcaggtcgcggcgcatcaagtcctgttccagcgtaacgtctttgtcggcgtggaaactgaaaccggcgtaacccttggcggttttgcgttcggtgcgggc

SEQ ID NO: 4862 - protein, 344 aa, Neisseria gonorrhoeae
LQRGDLRQPRPVDLFGDKVRFSLRAAFGGDFARIRLIGGFEQGEPVRALRVGRVFAVQTALRVGNADVQCRLKTLGTAEGIGFFQYVQNGLAFKLSDLVENNVPTANQFGKLGTLPRRAQPLIDFAHGFYAVDVVSVVARQDVGRCFGFAQVVQQGGIAFGQAQTHIGGALQRHQGMDAAVDFGMVVGALRHAEEGVDFGQQDLECAAFAQHFNHFARIFFHQTFRQLLPDAFGNQCVRFAVFHHLPHQLYGFFGDFKAVTRGKAGGTKDADGIFGEGGRDVAQNACRQIPLPAERVDNLAVRILRHRVDGQVAAHQVLFQRNVFVGVETETGVTLGGFAFGAG

SEQ ID NO: 4863 - DNA, 1230 bp, Neisseria gonorrhoeae
atgcagacttacctcgtcggcggcgccgtccgcgattatcttttgggcctgcccgtcaaagaccgcgattgggtggtcgtcggcgcagacgcgcaaaccatgttggcgcaaggtttccagccggtcggcaaagattttcctgtattcctccatcccaaaacgcacgaagaatacgccctagcccgcaccgaacgcaaaaccgccaagggttacgccggtttcagtttccacgccgacaaagacgttacgctggaacaggacttgatgcgccgcgacctgaccatcaacgcgatggcgcaagatgcggacggcaagattatcgaccctttcggcgggcaacgggatttggcggcaggcattttgcgccacgtctcgcccgccttcgccgaagatcccgtccgcatccttcgtgccgcccgctttgccgcgcgttacggctttgaaatcgccgaagaaaccataaagctgatgcggcagatggtggaaaacggcgaagcggacgcattggttgccgaacgcgtctggcaggagttggcgaaaggtttgatggaaaaaaatccgcgcaaaatgattgaaatgttgcgcgaatgcggcgcactccaagtcttgctgcccgaagtcgacgccctcttcggcgtgccgcaacgcgccgactaccatcccgaaatcgacagcggcatccataccctgatgacgctgcaacgcgccgccgatatgggtttgagcctgcccgaacgctatgccgccctgctgcacgacttgggcaaagccaaaacaccgcccgacatcctgccgcgccaccacggacacgacatcaacggcgtagaacccgtgcgcgaagtcaatcaacggctgcgcgcgccgaggcagtgtgccgagcttgccgaattggtttgccgttggcacattattttccaccaagtcggacagcttaaaagccaaaccattctgaacgtattgaaaaaaaccgatgccttccgccgtcccgagcgttttcagacggcattgaacgtctgcattgccgacacgcaaggccgtctgaaccgcgaacacacgccctacccgcaacgcgcgcactggctcgccctgctcgaagccgccaatcaggcggattcgggcaaaatcgccgccgaatgccgcgcgcagggaaaagcgcactttatcgccgaacaaatcgaccgggcgcggctggcgcaaatcgccccgctgcaaaaaacgtttcggggcgcg

SEQ ID NO: 4864 - protein, 410 aa, Neisseria gonorrhoeae
MQTYLVGGAVRDYLLGLPVKDRDWVVVGADAQTMLAQGFQPVGKDFPVFLHPKTHEEYALARTERKTAKGYAGFSFHADKDVTLEQDLMRRDLTINAMAQDADGKIIDPFGGQRDLAAGILRHVSPAFAEDPVRILRAARFAARYGFEIAEETIKLMRQMVENGEADALVAERVWQELAKGLMEKNPRKMIEMLRECGALQVLLPEVDALFGVPQRADYHPEIDSGIHTLMTLQRAADMGLSLPERYAALLHDLGKAKTPPDILPRHHGHDINGVEPVREVNQRLRAPRQCAELAELVCRWHIIFHQVGQLKSQTILNVLKKTDAFRRPERFQTALNVCIADTQGRLNREHTPYPQRAHWLALLEAANQADSGKIAAECRAQGKAHFIAEQIDRARLAQIAPLQKTFRGA

SEQ ID NO: 4865 - DNA, 1800 bp, Neisseria gonorrhoeae
ttggaatgccgtgaaggattatcatttggaaaccttttgcctgaaataataaaaccgatattttactataagtgtctgaaaatttgcccgtctgtttcagacggcggggcggttatgttacaatccgaaaattcgaaaaatttaatctcttgttcaataaaggttttacccataatgatttctaccaacggcattaccatgcagttcggcgcgaagccgctgtttgaaaacgtatccgtaaaattcggcgaaggcaaccgctacggcttgatcggcgcgaacggttcgggcaaatccaccttcatgaaaatcctcggcggcgatttggaacagaccgccggcgaagtggcgattgaaaacggcgtgcgtttgggtaaattgcgccaagaccagtttgcctacgaagacatgcgcgtgctggacgtggtgatgatggggcataccgaaatgtgggcggcgatgaccgagcgcgatgcgatttacgccaatcccgaagccaccgaagacgactacatgaaagccgccgaactggaagccaagttcgccgaatacgacggttacaccgccgaagcgcgcgccgccgaattattaagcggcgtgggcatttccgaagatttgcacaatgcgaaaatggcggaagtcgccccgggcttcaaactgcgcgtattgctggcgcaggcgctgttctccaagccggatgtattgctcttggacgaaccgaccaacaacttggacatcaataccatccgctggctggaaggcgtgttgaaccaatacgactccaccatgatcatcatctcgcacgaccgccacttcttgaacgaagtttgcacccacatggcggatttggactacaacaccatcactatttatccgggcaactacgacgactatatgctcgcttccgcccaatcgcgtgagcgcgccctgaaagacaatgccaaagccaaagagaaactgcaagagctgcaagaattcgttgcccgtttttccgccaataaatccaaagcccgtcaggcaaccagccgtctgaaacaggccgacaaaatcaaatcggaaatggtcgaagtcaaaccttctacccgtcaaaacccgtatatccgttttgaagccgatgaaaaagccaagctgcaccgtcaggctgtggaagttgaaaaactggccaaacgctttgaaacccagttgtttagaaacctcaacttcatccttgaagcaggccaacgcctcgccatcatcggcccgaacggcgcaggtaaatctaccttgctgaaactcttggccggcgcgtacaaccccgaatattcagacggcctgttgccggacgaaggcagcatcaaatgggcggaaaaagccagtgtcggctactatccgcaagaccatgaaaacgactttgacgtcgatatggacttgagcgaatggatgcgccaatggggtcgggaaggcgacgacgaacaagtcatccgaggcactttggggcgtttgcttttcggcagcaacgacgtggtaaaaaaagtgaaagttctctccggcggcgaaaaaggccgtatgctttacggcaaactgttgctgttgaaacccaatgtcttggtcatggacgaaccgaccaaccatatggacatggaaagcatcgaatcgctgaacatggcactggacaaatacaacggcacgctgattttcgtctcccacgaccgtcagttcgtttcctccctggcaacccaaatcatcgaactggacggcaaaggcggatatgaacactacttgggcgattacgaaagctatctcgagaaaaaaggcgtagca

SEQ ID NO: 4866 - protein, 600 aa, Neisseria gonorrhoeae
LECREGLSFGNLLPEIIKPIFYYKCLKICPSVSDGGAVMLQSENSKNLISCSIKVLPIMISTNGITMQFGAKPLFENVSVKFGEGNRYGLIGANGSGKSTFMKILGGDLEQTAGEVAIENGVRLGKLRQDQFAYEDMRVLDVVMMGHTEMWAAMTERDAIYANPEATEDDYMKAAELEAKFAEYDGYTAEARAAELLSGVGISEDLHNAKMAEVAPGFKLRVLLAQALFSKPDVLLLDEPTNNLDINTIRWLEGVLNQYDSTMIIISHDRHFLNEVCTHMADLDYNTITIYPGNYDDYMLASAQSRERALKDNAKAKEKLQELQEFVARFSANKSKARQATSRLKQADKIKSEMVEVKPSTRQNPYIRFEADEKAKLHRQAVEVEKLAKRFETQLFRNLNFILEAGQRLAIIGPNGAGKSTLLKLLAGAYNPEYSDGLLPDEGSIKWAEKASVGYYPQDHENDFDVDMDLSEWMRQWGREGDDEQVIRGTLGRLLFGSNDVVKKVKVLSGGEKGRMLYGKLLLLKPNVLVMDEPTNHMDMESIESLNMALDKYNGTLIFVSHDRQFVSSLATQIIELDGKGGYEHYLGDYESYLEKKGVA

SEQ ID NO: 4867 - DNA, 372 bp, Neisseria gonorrhoeae
atgataatccttcacggcattccaaattgcgacacagtcaaaaaagccaaaaacaggcttgccggatacggcttggagtttgggtttcgggatttcaaaaaacagatgccgtctgaagcggaaatctgctcgtggctggaacaagtgcctttggcaaccctgttcaacaaacgcgggacaagctggcgcaaactcgatgccgaaacacagcaaaaagccctgtcctcgacggcggaggccgtcaaactgatgtccgaaatgccgagcctgatcaagcgtcccgtattggagtgcggcagcagggtttacgtcggcttcagcgaagaaacctacgacggcatcttcaaccggcaagccccgtgcagacaggga

SEQ ID NO: 4868 - protein, 124 aa, Neisseria gonorrhoeae
MIILHGIPNCDTVKKAKNRLAGYGLEFGFRDFKKQMPSEAEICSWLEQVPLATLFNKRGTSWRKLDAETQQKALSSTAEAVKLMSEMPSLIKRPVLECGSRVYVGFSEETYDGIFNRQAPCRQG

SEQ ID NO: 4869 - DNA, 1536 bp, Neisseria gonorrhoeae
atgttccattccatcgaaaaatacagaacacccgcccaagtcttattaggcctgattgcattaacttttgtcggcttcggcgtcagcacggtttcccatccgggcgccgactacatcgtccaagtgggcgacgaaaaaatcagcgagcactcaatcaacaacgccatgcagaacgagcaggcggacggcggcagcccttggcgcgacgcggtgttccaatccctgctgcaacgcgcctacctgaaacagggcgcgaagctgatgggcatttcggtttcttccgaacaaatcaagcagatgattgtggacgatcccaatttccacgacgcaaacggcaaattcagtcacgcgcttttgagtcaatacctgtcgcaacgccatatgtctgaagaccagtttgtcgaagaaatccgcgatcagtttgccttgcagaatttggtaagcctcgtccaaaacggcgtattggtcggcgacgcgcaggcggaacagctgatcaggctgacgcaggtcaaccgcaccatccgttcgcacactttcaaccccgacgagttcatcgcccaagtcaaagcgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcgtttgaagagcgcgtggcgcgtttgccggcacatgaagccaaaccttctttcgagcaggaaaaagccgccgtcgaaaacgaattgaaaatgaaaaaggcggttgccgacttcaacaaggcaaaagaaaagctgggcgacgatgcgttcaatcatccctcctcgcttgccgaagccgccaaaaacagcggtttgaaagtggaaacccaagaaacttggctgagcaggcaggacgcacaaatgtccggcatgcccgaaaacctaatcaatgccgtattcagcgacgacgtattgaagaaaaaacacaattccgaagtgctgaccatcaacagcgaaaccgcgtgggtcgtccgcgccaaagaagtccgcgaagaaaaaaacctactgtttgaagaagccaaagatgcggtgcgtcaggcctatatccgtaccgaagccgccaaacttgccgaaaacaaggcaaaagaagtgcttacccaactgaacggcggcaaggcagttgacgtgaaatggtcggaagtgtccgttttgggcgcgcagcaggcaaggcagtccatgccgcccgaggcttatgcggaactgctgaaagcaaaaccggcaaacggcaaacccgcctatgtcagactgaccggtctgccggcacccgtgattgtcgaggcgcaggcagtcacgcctccggaggatattgccgcacagcttcctcctgcgaaacaggctttggcgcaacagcagtctgccaatactttcgacctgctgatccgctatttcaacggaaaaatcaaacagactaaaggagcacaatcggttgacaacggcgatggtcag

SEQ ID NO: 4870 - protein, 512 aa, Neisseria gonorrhoeae
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLAENKAKEVLTQLNGGKAVDVKWSEVSVLGAQQARQSMPPEAYAELLKAKPANGKPAYVRLTGLPAPVIVEAQAVTPPEDIAAQLPPAKQALAQQQSANTFDLLIRYFNGKIKQTKGAQSVDNGDGQ

SEQ ID NO: 4871 - DNA, 144 bp, Neisseria gonorrhoeae; identical to SEQ ID NO: 601

SEQ ID NO: 4872 - protein, 48 aa, Neisseria gonorrhoeae; identical to SEQ ID NO: 602

SEQ ID NO: 4873 - DNA, 666 bp, Neisseria gonorrhoeae
aagccccttgcacgccacttcgcgccgcccgatttcctctttcaacggcacggcgttcaacatccgcagacgttcggcaaaatccgcaaacggcagcagctccgaaccgaaacggcgcatatgttccgtatcctgctggcagtctatcagttccacgcccaaatccgccaaaaacggcacggcgcaggcaaacgcgattttcgacgcatccggttgcaacgcaaacatcgattcgccataaaacaccctgccgatctgaacgccgtaaaagccgcccgccaacctcgttttaccgttttcatcgggataatggcactcgaaagaatgcgcgtgtcccatttcgtgcagcttcaaatatgccgtctgaaactcgggcgcaatccaagtcccatcctgattcgggcgcgccgctgccgcacaatgcgcgacaacttccgcaaaacagccgttgaccgcaacccgatagctgccgttacgcagcgttttcgccagcgagcgcggaacgtgcagacgttcgggaacaattaccgcacgcggcccgaccgcataccaaaaaaaccaaccgtcccgcgaaaaccaaggaaacacgccgttccgatacgcctcgagcagccgccccgcgtccaaatccctgctcacgccgaccagcccgtcgcaccgggccaa

SEQ ID NO: 4874 - protein, 222 aa, Neisseria gonorrhoeae
KPLARHFAPPDFLFQRHGVQHPQTFGKIRKRQQLRTETAHMFRILLAVYQFHAQIRQKRHGAGKRDFRRIRLQRKHRFAIKHPADLNAVKAARQPRFTVFIGIMALERMRVSHFVQLQICRLKLGRNPSPILIRARRCRTMRDNFRKTAVDRNPIAAVTQRFRQRARNVQTFGNNYRTRPDRIPKKPTVPRKPRKHAVPIRLEQPPRVQIPAHADQPVAPGQ

SEQ ID NO: 4875 - DNA, 618 bp, Neisseria gonorrhoeae
atgatgaattccaaaaaacaggatgcattccaacgcctgatcggtgcgctgaaagtattgcccaacgtcgggccgaaatcggcacagcggatggcgtaccatctgttgcagcaaaagcgcaaagaggctgaagagctggtggatgccttacagacggcattgaggcaggtttgccattgcgcaaggtgcaatacattttgcgaaggcggattgtgcgatatttgtgccgatgaaacacgcgacgggcggcggctgatggtggtgcatatgcctgccgacgtgtcgaatatagaagcggcaaactgccacgacgggctgtatttcgtcctgatggggcaaatcaatacggcattgggaatggacgtatccgccatcgcattggacaggctggcgcaacggctggacggcggggaaatcgaagaaatcattatcgcgaccgcctttaccgcagaaggcaatgccacagcgtatgtcctgtccgagtttttcaaaaacctgccttacaaggtcagcaggctgtcgcagggcatcccattgggcggcgaattggaatatgtcgatgcgggaacgctggcgcaagcggtgtacgaacggcgtctgattaaagaaggcggggcg

SEQ ID NO: 4876 - protein, 206 aa, Neisseria gonorrhoeae
MMNSKKQDAFQRLIGALKVLPNVGPKSAQRMAYHLLQQKRKEAEELVDALQTALRQVCHCARCNTFCEGGLCDICADETRDGRRLMVVHMPADVSNIEAANCHDGLYFVLMGQINTALGMDVSAIALDRLAQRLDGGEIEEIIIATAFTAEGNATAYVLSEFFKNLPYKVSRLSQGIPLGGELEYVDAGTLAQAVYERRLIKEGGA

SEQ ID NO: 4877 - DNA, 96 bp, Neisseria gonorrhoeae
ttgaatctgcaaagtgcccccgctgccgaccgtaaagacgcactgcgccgcgctgctgccggaaacggtaatgctgcccgctgccgccgttcaggc

SEQ ID NO: 4878 - protein, 32 aa, Neisseria gonorrhoeae
LNLQSAPAADRKDALRRAAAGNGNAARCRRSG

SEQ ID NO: 4879 - DNA, 216 bp, Neisseria gonorrhoeae
ttgcacaacgcgccgaactaccctatccttctcttgaaacaaaaccttttctttaaggaaaacaatgaatatcaggaaaatctccgctttgtgtgctgttgccgtttttactgtttcgacagcctatgccaaagaaatcaaaatcgatgccaacaacacgccttattccgaagccgacgcgcaaaagctggcggcaacggcagtcggtatgggcgt

SEQ ID NO: 4880 - protein, 72 aa, Neisseria gonorrhoeae
LHNAPNYPILLLKQNLFFKENNEYQENLRFVCCCRFYCFDSLCQRNQNRCQQHALFRSRRAKAGGNGSRYGR

SEQ ID NO: 4881 - DNA, 177 bp, Neisseria gonorrhoeae
gtgcaagttttccgtcctgtttttccgaatttgccacataccgcgtctttatttacacagcctgccgttcggacgctgccggggttttacggtacaataaacttttgccgcctcccccaaaccgccgtccggggcggcacgtttgcagacatttttaaggtagcgttatgttttctc

SEQ ID NO: 4882 - protein, 59 aa, Neisseria gonorrhoeae
VQVFRPVFPNLPHTASLFTQPAVRTLPGFYGTINFCRLPQTAVRGGTFADIFKVALCFL

SEQ ID NO: 4883 - DNA, 1245 bp, Neisseria gonorrhoeae
atgttttctctagaggcttggataggcttgaggtatctcagggcgaaaaagcgcaacggctttatgtcgtttatcacgatggtttcgattgccggaatcgccttgggcgtaaccgcgctgattgtcgtcttgtcggttatgaacggctttcagaaagaaatacgcgggcagctcctgaatgtcgcgccgcacgccgaaatcggctatatcgacaatacggatacggattggcgcaacctgcttcggtttgccgaaaaccgcaaaggcattttggctgccgcaccctatgtttccaatcaggcattgctggcaaacgcgggcgaaatcaggggcgttcagatacgcggcattttgccgtctgaagagcgcaaagtggtggaatacggcgacaaaatgccggcaggcaagtttgaagacctgattccgggcgagtttgacattatcctcggtatcggtttggcggaggctttgggggcggaagtcggcgacaaggttacggtaattacgccggagggcaacgttacccctgccggaatcgtgccgcgcctgaagcagtttaccgtggtcggcctggtcaagacgggtgtttacgaagtggacaactcattggcgatgacgcatatccaagacgcgcgcgtactgtaccgcttggataaggaagttgcggggctgcggctgaagcttgccgatccgcaaaacgcccccgccttgacggcaacgctgattccggaggcgcaaagggacacggtttgggtgcgcgattggacgtacagcaaccgcagctattttgaagcggtcgaactggaaaaacggatgatgttcattatcctgacgctgattatcgccgtggcggcgttcaaccttgtctcttccttggtgatggcggttacggaaaagcaggcggacattgcgattttgcggactttgggtctttcccctgccggcgtgatgaagatttttatggtgcagggcgcgttttcaggctttttcggcacgctggcgggtgtggtctgcggcgtgctttggggttggaacgtcggcagggtcgtggcgttttttgaaaacctgctcggtgtccacctcatcaattcgcaggtttattttatcgactacctgcccagtgatgtcgatatgggcgacgttgccctgattgcctgcatttccttggggctgtctttcgtggcgacactgtacccgagctggcgcgcgtcaaaaacccaaccggcggaggctttgcgttatgag

SEQ ID NO: 4884 - protein, 415 aa, Neisseria gonorrhoeae
MFSLEAWIGLRYLRAKKRNGFMSFITMVSIAGIALGVTALIVVLSVMNGFQKEIRGQLLNVAPHAEIGYIDNTDTDWRNLLRFAENRKGILAAAPYVSNQALLANAGEIRGVQIRGILPSEERKVVEYGDKMPAGKFEDLIPGEFDIILGIGLAEALGAEVGDKVTVITPEGNVTPAGIVPRLKQFTVVGLVKTGVYEVDNSLAMTHIQDARVLYRLDKEVAGLRLKLADPQNAPALTATLIPEAQRDTVWVRDWTYSNRSYFEAVELEKRMMFIILTLIIAVAAFNLVSSLVMAVTEKQADIAILRTLGLSPAGVMKIFMVQGAFSGFFGTLAGVVCGVLWGWNVGRVVAFFENLLGVHLINSQVYFIDYLPSDVDMGDVALIACISLGLSFVATLYPSWRASKTQPAEALRYE

SEQ ID NO: 4885 - DNA, 693 bp, Neisseria gonorrhoeae
atgagtgatttgattttgaaatgcgaaggcgtgggcaaacgctaccgtgacggcggtttggacgttccggtgctgtacggcttggatttggaaatccgcacgggggaaagcaccggcatcatcggctcttcgggcagcggcaaatcgacgctgctgcatattttgggcgggctggatatgccgtctgaaggcagggtgctgctgatgggcgaggatttgcgtgccttaaaccagcggcgtttgggcgatttgcgcaaccgccatctcggtttcgtgtaccagttccatcatcttctgcctgaattttcggcactggaaaacgtgatgatgccgcttctgatcggcaaaaaaagccgtaaagaggcggtagaaacggcaatggcgatgctcgacaaggtcggactgaaacaccgttcgacgcaccgtgcgggcgaactgtccggcggcgaacgccagcgtgccgccattgcgcgcgccttggttacgcaacccaaatgcctgcttgccgacgaaccgaccggtaacctcgaccgggcaaacgcaaggaatgttttggatatgatgctggaactgaaaacggaattgggaacggggctggtggtcgtaacgcacgacgacgaactcgccggccgcttcgagcgcgtgatggtcatgaaagacggcagcctgcaccccagacagggcgcaaacgcc

SEQ ID NO: 4886 - protein, 231 aa, Neisseria gonorrhoeae
MSDLILKCEGVGKRYRDGGLDVPVLYGLDLEIRTGESTGIIGSSGSGKSTLLHILGGLDMPSEGRVLLMGEDLRALNQRRLGDLRNRHLGFVYQFHHLLPEFSALENVMMPLLIGKKSRKEAVETAMAMLDKVGLKHRSTHRAGELSGGERQRAAIARALVTQPKCLLADEPTGNLDRANARNVLDMMLELKTELGTGLVVVTHDDELAGRFERVMVMKDGSLHPRQGANA

SEQ ID NO: 4887 - DNA, 1776 bp, Neisseria gonorrhoeae
gtgccttcagacggcatttcgacaaggaatacgatggaactgcagacagatgaatttgcccaagcggcggcaagggcggcaatccgttttttggaacgctatgcgggttcgggcaacgaagtgcttgcaaactgtaccgaacgcctgtttcaggcattgcaaaacggtcattcgtttatccgtttgagcggggacgaggctgacgcgctgtcggcactcgcacccgtggtcggaacatccgccgcgcctttgattttggaaggcagaaggctgtttttgggcaggatgtggcagttggaatacgatttggctgccgaaataaaacgcttggcggcagccggcacgtccgcccccgacgcggcaggcgcgcggcaaaacctcgcaaaatggtttcaaggcgcgggaagcgaaggacagcgcgatgcggccgccttggcactgttgcagttttttatggtgattaccggagggccgggaacgggcaaaacgacaacggttgccaaactgctggcactgatttgcggtgaaaacgaaaatcttccccatatcgcgcttgccgcaccgacgggcaaagcggcggcacatatggcgcgcgcactgcaccgttcaatcaacggttttgacgcgccggaggccgtccgccgccatttgctcaaactggaagggcaaaccgtccaccgactgcttaagctgagcccgcccaaaatgcaggcggcgttcgaccatatccgtccgctgccgttcgacgtgctgattgtcgatgaagcctccatgttggataccgcattgatgctgcaacttttgaaagcggtcaaaaccggcgcgcgcgtgattctgctgggcgatgaaaaccagctcccgtccgtcggaatcggggcggtgctgtccgttttgtcgcaaaaaaccgttttggacggagaaacgcaccaaaggctggccggtttccttccggaacacggtttcagcgtcagcgcaaatccgcccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaatgctcgggtcgaaaggttgtaccgggcgcacaaagcctattggcaggcggtaaaagacggcaatatcgaagccgcatacgcaggcatctcggatatcgtggttctggcagcttggcggcaggatgcggaagacttcaacgaagcctattgcagctatgtacgccgcaaaatgaacataccggaacatttggcctatttcgccggagagccgattatgatcagacagaacgactacgcgcttgagctgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaatatcgggaagtctggctgctgccgccttccgacgcaccttcggacgaaggggacgatgcattgtccggattgagtaaggagctgttatataccgccattacccgcgccagggaaaaattcgtatttttcggcggcaaaaagacattttgtcaggcggtaaacaccgtcaaagtccgtcagacggcgttgggcagtatgcttgagcgggtattttcacaagaa

SEQ ID NO: 4888 - protein, 592 aa, Neisseria gonorrhoeae
VPSDGISTRNTMELQTDEFAQAAARAAIRFLERYAGSGNEVLANCTERLFQALQNGHSFIRLSGDEADALSALAPVVGTSAAPLILEGRRLFLGRMWQLEYDLAAEIKRLAAAGTSAPDAAGARQNLAKWFQGAGSEGQRDAAALALLQFFMVITGGPGTGKTTTVAKLLALICGENENLPHIALAAPTGKAAAHMARALHRSINGFDAPEAVRRHLLKLEGQTVHRLLKLSPPKMQAAFDHIRPLPFDVLIVDEASMLDTALMLQLLKAVKTGARVILLGDENQLPSVGIGAVLSVLSQKTVLDGETHQRLAGFLPEHGFSVSANPPVLAQNTAHLSFSHRFGDNSGIGCLARAAVSGDEGAWALFDRFPDELEHSECSPNARVERLYRAHKAYWQAVKDGNIEAAYAGISDIVVLAAWRQDAEDFNEAYCSYVRRKMNIPEHLAYFAGEPIMIRQNDYALELFNGDIGLIMEDVGRQGSLAAYFADADGFKKVAVSCLPEFEPAFAMTVHKSQGSEYREVWLLPPSDAPSDEGDDALSGLSKELLYTAITRAREKFVFFGGKKTFCQAVNTVKVRQTALGSMLERVFSQE

SEQ ID NO: 4889 - DNA, 849 bp, Neisseria gonorrhoeae
ttgccaacctgtttgccccgattttcgactatttcgtcgcacaagcgaacatcaaacgcagaaaggcgcgcagcaatggctaagaaattcgataaagacagcttcagcggcacgctgattgtcgtgttggcggtcagcctgatttgctcggtcatcgttgccggtgcggtcgtcggcttgaaacccatccaagaaaaacaaaaactccaagacaaacaaggctatattttgagcgtggccggtttgatggataaggacaccgacatcggtaaaacctttgccgagcgtatcgagcaacgcgtggtcgatttggcgaccggcgaatatgtgaaagacgcgccgaaagacttcagcgcgcgcatcgcaggcaaagaccccgcgcaaagcatccgcatcaaacctgaagacgatttggcaggcatcaaaagccgcgccaaatacaccgaggtttatttggtaaaaggcgaagacggcaaaatcgggcaaatcatcctgccgatgcacggcaacggtttgtggtcggtgatgtacggcttcgtcgccatccgacccgacggcaacaccatcaacggcattacctactacgaacaaggcgaaaccccgggcttgggcggcgaaatcggcaatcctttgtggcagcaaaaattcgtcggcaaaaaattgtttgacggacaaggcaaactcgccctgcacgtgggcaaaggcgcgggttcggacaaagaacacggcgtagacgccctctccggcgcgtcgctgacttccaaaggcgtgcaaggttcgttcgcctactggttcggcgaaaacggctatatcccctacctgaacaaattgaaatcagcaggagtgcaa

SEQ ID NO: 4890 - protein, 283 aa, Neisseria gonorrhoeae
LPTCLPRFSTISSHKRTSNAERRAAMAKKFDKDSFSGTLIVVLAVSLICSVIVAGAVVGLKPIQEKQKLQDKQGYILSVAGLMDKDTDIGKTFAERIEQRVVDLATGEYVKDAPKDFSARIAGKDPAQSIRIKPEDDLAGIKSRAKYTEVYLVKGEDGKIGQIILPMHGNGLWSVMYGFVAIRPDGNTINGITYYEQGETPGLGGEIGNPLWQQKFVGKKLFDGQGKLALHVGKGAGSDKEHGVDALSGASLTSKGVQGSFAYWFGENGYIPYLNKLKSAGVQ

SEQ ID NO: 4891 - DNA, 123 bp, Neisseria gonorrhoeae
cgccgaccagcccgtcgcaccgggccaaagcataggcaggatcgggaaaggcataattgtcaggggcaagcagcggaatacgcatggcagttctccaaaaacacagacggcatccaaaatcat

SEQ ID NO: 4892 - protein, 41 aa, Neisseria gonorrhoeae
RRPARRTGPKHRQDRERHNCQGQAAEYAWQFSKNTDGIQNH

SEQ ID NO: 4893 - DNA, 102 bp, Neisseria gonorrhoeae
gtgccgtttgaaaaaggcataaggggcggtggcgtgcttccgacggtaggcatcggaacgcccgcgccgccggcacggcatcattcgggcggattattcttg

SEQ ID NO: 4894 - protein, 34 aa, Neisseria gonorrhoeae
VPFEKGIRGGGVLPTVGIGTPAPPARHHSGGLFL

SEQ ID NO: 4895 - DNA, 177 bp, Neisseria gonorrhoeae
gtgcatttggggctgcgccctgccgactttttggaaaaggcatttatccgggcgggtttgcgtgttgaggatgttttgaaaaccaaaccggttcacaaaaaagctgccgattcgaacgatccgctggcttttgcccgaaacagggaaactactttcctgtgccgtttgaaaaaggca

SEQ ID NO: 4896 - protein, 59 aa, Neisseria gonorrhoeae
VHLGLRPADFLEKAFIRAGLRVEDVLKTKPVHKKAADSNDPLAFARNRETTFLCRLKKA

SEQ ID NO: 4897 - DNA, 405 bp, Neisseria gonorrhoeae
ttgggcggcagcatacacgttcctttcggcgtattctcgccgttgcgcggcgaatatctcgacctgcttgcccatgcgccgtcaacgggttttcagacggcattcgatatcgggacgggctcgggcgtacttgccgccattttggcgaaacagggcattccttccgtcatcggcacggataccaatccgagggcggttgcctgcgcccgtgccaatattgcccgtttgggttttgaaaaacaggttgaaatccgcgaaaccgatttatttcccgaagggtttgccgacctgattgtctgcaatccgccctggcttcccgccaagccgacttccgccgtcgaatccgcgttatacgaccccgaatctgcgatgctggctgcgtttttgcgtgatgcgccaaacatc

SEQ ID NO: 4898 - protein, 135 aa, Neisseria gonorrhoeae
LGGSIHVPFGVFSPLRGEYLDLLAHAPSTGFQTAFDIGTGSGVLAAILAKQGIPSVIGTDTNPRAVACARANIARLGFEKQVEIRETDLFPEGFADLIVCNPPWLPAKPTSAVESALYDPESAMLAAFLRDAPNI

SEQ ID NO: 4899 - DNA, 999 bp, Neisseria gonorrhoeae; identical to SEQ ID NO: 315

SEQ ID NO: 4900 - protein, 333 aa, Neisseria gonorrhoeae; identical to SEQ ID NO: 316

SEQ ID NO: 4901 - DNA, 567 bp, Neisseria gonorrhoeae
atgcacacccataaaccccagcagcagattgagcggcagaaaaaacggtttgccgtccgcctctccgtacacgtcgagcaaagcggcgcgtatatcgggcgcgcgtttgttgtccaacacaaaaccggggcggatttcaacggcaagcatattcagaatacggctctgttgcgcctgcttcatacggtgggcgtggaaaagggcggcgatatccgcatcggaacggacggcggcaggtttgcggaccttcttcttcattgccgaaagcacctgtttggcattgtggaaatcgccctgccagacagttgcaatattttgataggtagccttcaaaatgccgtctgcaccgctttcacggacataataccaacctttgggcggcttttgcagactttcgttgcgccattcgaacccgttatcgggaaaaataaaagaagacatgggatacctgcgtcatgttttgaaaatagggcggcagaaccgcaaaccatacggatggtacagcaaggagcggcaacacagaactgtttttttgttcccgccttgtctttccaagcccatgccgtc

SEQ ID NO: 4902 - protein, 189 aa, Neisseria gonorrhoeae
MHTHKPQQQIERQKKRFAVRLSVHVEQSGAYIGRAFVVQHKTGADFNGKHIQNTALLRLLHTVGVEKGGDIRIGTDGGRFADLLLHCRKHLFGIVEIALPDSCNILIGSLQNAVCTAFTDIIPTFGRLLQTFVAPFEPVIGKNKRRHGIPASCFENRAAEPQTIRMVQQGAATQNCFFVPALSFQAHAV

SEQ ID NO: 4903 - DNA, 276 bp, Neisseria gonorrhoeae
atggagtttgatgccatgccgtctgaaacattccggcttcagacggcatgggcttggaaagacaaggcgggaacaaaaaaacagttctgtgttgccgctccttgctgtaccatccgtatggtttgcggttctgccgccctattttcaaaacatgacgcaggtatcccatgtcttcttttatttttcccgataacgggttcgaatggcgcaacgaaagtctgcaaaagccgcccaaaggttggtattatgtccgtgaaagcggtgcagacggcattt

SEQ ID NO: 4904 - protein, 92 aa, Neisseria gonorrhoeae
MEFDAMPSETFRLQTAWAWKDKAGTKKQFCVAAPCCTIRMVCGSAALFSKHDAGIPCLLLFFPITGSNGATKVCKSRPKVGIMSVKAVQTAF

SEQ ID NO: 4905 - DNA, 501 bp, Neisseria gonorrhoeae
acgtttgcccttggcctgacagtcgctgcacacgccgtacatataaagcgcgtgatcgacgatgcggtagccgttttcctcggcgattttgtcttgcagggcttcgatttcgggattgtggaattccgttacctcgccgcacttcacgcagacgatatggtcgtggtggtcgcccttgtccaactcataaaccgccttgcccgtttcaaaatggtggcgttgcagaatgcccgcctgctcgaactgcgtcagcacgcggtaaatcgtcgccacaccgatttccacgccctcttccagcagaatgcggtacacatcttccgcactcaaatgctcttccgcgtgcttctcgaacaaatccaaaatcttcaaacgcgggccggtaaccttcagaccgctgtctttcagttgcgcaatgttgctgaatttttccataatattcaatatccctgtaaaataatagacgctataatacgcaatttcagcctgcttgcccactatcac

SEQ ID NO: 4906 - protein, 167 aa, Neisseria gonorrhoeae
TFALGLTVAAHAVHIKRVIDDAVAVFLGDFVLQGFDFGIVEFRYLAALHADDMVVVVALVQLINRLARFKMVALQNARLLELRQHAVNRRHTDFHALFQQNAVHIFRTQMLFRVLLEQIQNLQTRAGNLQTAVFQLRNVAEFFHNIQYPCKIIDAIIRNFSLLAHYH

SEQ ID NO: 4907 - DNA, 276 bp, Neisseria gonorrhoeae
atggatactctcttgtgtctgacaggatacggattgccgcgtaaattggggttgaaagtattatttcaagcatacgcggtttatttatggagtttgatgccatgccgtctgaaacattccggcttcagacggcatgggcttggaaagacaaggcgggaacaaaaaaacagttctgtgttgccgctccttgctgtaccatccgtatggtttgcggttctgccgccctattttcaaaacatgacgcaggtatcccatgtcttcttttatttttcccga

SEQ ID NO: 4908 - protein, 92 aa, Neisseria gonorrhoeae
MDTLLCLTGYGLPRKLGLKVLFQAYAVYLWSLMPCRLKHSGFRRHGLGKTRREQKNSSVLPLLAVPSVWFAVLPPYFQNMTQVSHVFFYFSR

SEQ ID NO: 4909 - DNA, 2460 bp, Neisseria gonorrhoeae
atgacacaaaaagaaaagcattttgaggaatatgctgctttggcgacccttcctttacgggatgtcgtcgtttacccgcatatggttctgccgctgttcgtcggcaggccgaaatccatcgccgcactggaaaacgccattacccgcgaggaaccggttttcctgttggcgcaaaccgatgcggcggtagaagaaccggttgccaccgacctgtatcagaccggtaccgtcgcacaagtcctgcaagtgttgaaactgcccgacggcacggtaaaagtgctggtcgaagggctgtatcgcggacgtgttttgaccatcgaagacacgggcgggctgttcgtttctcatatagaggcggtcgtggaagaagacacgggcggcaataccgacctcgaagccgtgcgccgcaccctgttggcgcagtttgaacaatacgccaaactcaataaaaaaatccctgccgaaattatcggcagcatcaacggcattgccgaaaacagccggctaaccgatacggtcgcagcgcatttgcagttgaaactggcgcaacgccaacagattttggagattcccgaaatcggcaaacggatggaattcctgctggcaaagctggaatccgaactcgacattatgcaggccgaaaaacgcatacgcggacgcgtcaaacgccaaatggaaaaatcccaacgcgaatattatctgaacgaacagattaaagcgatacacaaagaattgggcgaagaagacgaaaacggcgaactggatgccttggaggcaggcatcaaaaaggcgggtatgaccaaagaagcggaagaaaaatgcctgtccgaactgaaaaaactcaaaatgatgccgccgatgtctgccgaatccaccgtcgtacgcaactacatcgacaccctgctcggactgccgtggaagaaaaaatcccgcgtcagcaaagacatcgccaaagccggactggtgctggatgccgaccactacggcctggaaaaagtcaaagaacggattttggaatacctcgccgtccaaaaacgtatggacaagctcaaaggtccgattctgtgtttggtcggccctccgggcgtgggcaaaacctctttgggcgaatccatcgccaaagcaacggggcggaaatatgtccgtatggccttgggcggcgtgcgcgacgaaagcgaaatccgcgggcaccgccgtacctatatcggctctatgcccggcaagattttgcagaatatggcaaaagcaggcgtaagaaacccgttgttcctgctcgacgaaatcgacaaattgggcagcgactttcggggcgatcccgccagcgcgttgcttgaagtgctcgatcacgaacaaaacaacaagttcgccgatcattatgccgaagtggattacgatttgagcgacgtgatgtttattgcgacttcaaacagcctgaatatcccgaccccgctgcttgaccgtatggaaatcatccgtctgtccggctataccgaagacgagaaaatcaatatcgcgatgcagtatctcgtaccgaagcaaatgaaacgcaacggcgtgaaagaaggcgaattggtggtcgaagaaagcgcggtacgcgatattatccgttattacacccgagaggcgggcgtgcgttcgctcgaccgcgaaattgccaaaatctgccgtaaggtggtgatgcagattaccttgaacgaagataagaagaggttgtctgaaaccaagaaaaccagcaaagccaagcctagggcggttaaagtcaatgagaaaaacctacatgactacttgggcgtgcgccgcttcgattacggcgttgccgaaagtgaaaaccgcatcggacaggttaccggtttggcttggacggaagtcggcggcgaattgctgactgtcgaagccgcagcattaccgggtaaaggcatgatccagtgtaccggccagttgggcgatgtgatgaaggaatctgtatccgctgcatggtctgttgtccgttcccgtgcggaatcagtaggtttggctcctgatttttacgagaaaaaagacattcatgtccatgttcccgaaggtgcaacgccgaaagacggtccgagcgcaggcattgctatgactttggcgatggtgtccgcctttaccaaaattccggtgcgtgccgatgttgccatgacgggcgaaattaccctgcgcggcgaagtcctgccgatcggcggtctgaaggaaaaactgttggctgcgcttcgcggcggcatcaaacacgtcctgattccgaaagacaatgtcaaagacctggaagaaatccctgaaaacgtgaaaaccggattaaccatccatccggtcaaatggatagacgaggtattggctttgggtttggaaagccggcctgagtcttgggcagaaccttctgccgcggaagcggcggcggaatccgcttcaaaaccgaaaccccgcagcagggcaatcaaacat

SEQ ID NO: 4910 - protein, 820 aa, Neisseria gonorrhoeae
MTQKEKHFEEYAALATLPLRDVVVYPHMVLPLFVGRPKSIAALENAITREEPVFLLAQTDAAVEEPVATDLYQTGTVAQVLQVLKLPDGTVKVLVEGLYRGRVLTIEDTGGLFVSHIEAVVEEDTGGNTDLEAVRRTLLAQFEQYAKLNKKIPAEIIGSINGIAENSRLTDTVAAHLQLKLAQRQQILEIPEIGKRMEFLLAKLESELDIMQAEKRIRGRVKRQMEKSQREYYLNEQIKAIHKELGEEDENGELDALEAGIKKAGMTKEAEEKCLSELKKLKMMPPMSAESTVVRNYIDTLLGLPWKKKSRVSKDIAKAGLVLDADHYGLEKVKERILEYLAVQKRMDKLKGPILCLVGPPGVGKTSLGESIAKATGRKYVRMALGGVRDESEIRGHRRTYIGSMPGKILQNMAKAGVRNPLFLLDEIDKLGSDFRGDPASALLEVLDHEQNNKFADHYAEVDYDLSDVMFIATSNSLNIPTPLLDRMEIIRLSGYTEDEKINIAMQYLVPKQMKRNGVKEGELVVEESAVRDIIRYYTREAGVRSLDREIAKICRKVVMQITLNEDKKRLSETKKTSKAKPRAVKVNEKNLHDYLGVRRFDYGVAESENRIGQVTGLAWTEVGGELLTVEAAALPGKGMIQCTGQLGDVMKESVSAAWSVVRSRAESVGLAPDFYEKKDIHVHVPEGATPKDGPSAGIAMTLAMVSAFTKIPVRADVAMTGEITLRGEVLPIGGLKEKLLAALRGGIKHVLIPKDNVKDLEEIPENVKTGLTIHPVKWIDEVLALGLESRPESWAEPSAAEAAAESASKPKPRSRAIKH

SEQ ID NO: 4911 - DNA, 267 bp, Neisseria gonorrhoeae
gtgaacaagtctgaattgatcgaagcgattgctcaagaagccgatatttccaaagccgccgcacaaaaagctttggatgccactaccaacgcagtaaccaacgccctgaaacaaggcgacaccgttactctggtcggtttcggtactttctacgtcggcgaacgtgcggaacgccaaggccgcaaccccaaaaccggcgagcctctgaccattgccgccgccaaaacgcttaaattccgtgcaggtaaagcattgaaagacgcactg

SEQ ID NO: 4912 - protein, 89 aa, Neisseria gonorrhoeae
VNKSELIEAIAQEADISKAAAQKALDATTNAVTNALKQGDTVTLVGFGTFYVGERAERQGRNPKTGEPLTIAAAKTLKFRAGKALKDAL

SEQ ID NO: 4913 - DNA, 588 bp, Neisseria gonorrhoeae
atggcatttttccatccgggtttgacgggcagcccttcatccgaatccgacgggcaaacccctatcctgattcggcggggaaaacaaaaagccgattcttcaaggaatcggcttttgctgaaaaacagtttacagtgcgtctttcaatgctttacctgcacggaatttaagcgttttggcggcggcaatggtcagaggctcgccggttttggggttgcggccttggcgttccgcacgttcgccgacgtagaaagtaccgaaaccgaccagagtaacggtgtcgccttgtttcagggcgttggttactgcgttggtagtggcatccaaagctttttgtgcggcggctttggaaatatcggcttcttgagcaatcgcttcgatcaattcagacttgttcacaatcagtcccttcctgtcttaaaaaatgatgaaatgcccgaatactcggggtttgtactgcttgagcaactttcgctttatagcaattctgaaattgccgtgtcaagcaaaaaatacggaatcgccctattttacaggctttcaggacgaaaccgcatttttacaacacatttcctgcgtttcaatgtt

SEQ ID NO: 4914 - protein, 196 aa, Neisseria gonorrhoeae
MAFFHPGLTGSPSSESDGQTPILIRRGKQKADSSRNRLLLKNSLQCVFQCFTCTEFKRFGGGNGQRLAGFGVAALAFRTFADVESTETDQSNGVALFQGVGYCVGSGIQSFLCGGFGNIGFLSNRFDQFRLVHNQSLPVLKNDEMPEYSGFVLLEQLSLYSNSEIAVSSKKYGIALFYRLSGRNRIFTTHFLRFNV

SEQ ID NO: 4915 - DNA, 432 bp, Neisseria gonorrhoeae
atgactgagccgaaacacgaaacgccgacggaagagcaggttgccgcgcgcaaaaaagcaaaagccaaaatccgcaccatccgcatttgggcgtgggtcattttggcgttgctcgcttcaaccgccctgctctcccaatgcgcgatgtccaaaccgcaggcaaaacagaaaattgtcgagtcttgcatgaaaaatattccgtttgctgaaaaatggcagaacgatttgaaagcgcgcggcttggatgcggacaatacccgtctcgccgtcgactactgcaaatgtatgtgggagcagcctttggacggattgagcgagaaacagatcagctccttcggcaaactcggtgcacaagaacagcttgacctgctcggcggcgcaaacgcgtttgaaactcgagacaaacaatgtgtcgcggatttgaaagccgat

SEQ ID NO: 4916 - protein, 144 aa, Neisseria gonorrhoeae
MTEPKHETPTEEQVAARKKAKAKIRTIRIWAWVILALLASTALLSQCAMSKPQAKQKIVESCMKNIPFAEKWQNDLKARGLDADNTRLAVDYCKCMWEQPLDGLSEKQISSFGKLGAQEQLDLLGGANAFETRDKQCVADLKAD

SEQ ID NO: 4917 - DNA, 1392 bp, Neisseria gonorrhoeae
ttgattcaaagtgcggcacaattataccggcagcggatattttcgtctttcaatatttacatttcagtcggcttacaaggagacacaatgaagccagtaaacatcggtcttttaggcttaggtacggtcggcggcggtgcggctgccgtgttgcgggacaacgcagaggaaatttcccgccgcttggggcgcgaaatccgtatttctgccatgtgcgacttaagcgaagaaaaagcccgccaaatctgcccgtccgccgcctttgtcaaagatccgttcgaactggtcgcgcgtaaagacgtcgatgtcgtcgtcgaattgttcggcggcacgggcattgccaaagaagcggtgttgaaagccattgaaaacggcaaacacatcgttaccgccaacaaaaaactgctcgccgaatacggcaacgaaatcttcccgctggcggaaaaacaaaacgtcatcgtccaatttgaagcggcagtagcgggcggtatcccaatcatcaaagccctgcgcgaaggtttggcggcaaacaggattaaatccatcgccggcattattaacggcaccagcaacttcatcctctccgaaatgcgcgaaaaaggcagcgcgtttgccgacgtattgaaagaagcgcaggcattgggttatgccgaagccgacccgaccttcgacatcgaaggcaacgacgcaggccataaaatcaccatcatgagcgcgctggcattcggtacgccgatgaacttctccgcctgctatctcgaaggcatcagcaaactcgacagccgcgacatcaaatacgccgaagaactcggctaccgcatcaaactgttgggcgtcacccgcaaaaccggcaaaggcatcgaattgcgcgtccatccgaccctgattcccgaaagccgcctcttggcaaacgtcgacggcgtgatgaacgccgtgcgcgtcaacgccgatatggtcggcgaaaccttatattacggcgcgggcgcgggcgcattgccgaccgcttccgccgtggttgccgatatcatcgacatcgcccgcctggttgaagccgacaccgcccaccgcgtaccgcatctggcgttccaacccgcccaagtccaagcgcaaaccatcctgcctatggacgaaattaccagcagctactacctgcgcgtccaagccaaagacgaaccgggcacgctggggcaaatcgccgcgctgttggcacaagaaaacgtgtccatcgaagccttaatccaaaaaggcgttatcgatcagaccactgccgaaatcgtgattctgacccacagcacggtcgaaaaacacatcaagtcggcaatcgcagccatcgaagcactggattgtgtggaaaaaccgattaccatgatccgcatggaaagcctgcatgac

SEQ ID NO: 4918 - protein, 464 aa, Neisseria gonorrhoeae
LIQSAAQLYRQRIFSSFNIYISVGLQGDTMKPVNIGLLGLGTVGGGAAAVLRDNAEEISRRLGREIRISAMCDLSEEKARQICPSAAFVKDPFELVARKDVDVVVELFGGTGIAKEAVLKAIENGKHIVTANKKLLAEYGNEIFPLAEKQNVIVQFEAAVAGGIPIIKALREGLAANRIKSIAGIINGTSNFILSEMREKGSAFADVLKEAQALGYAEADPTFDIEGNDAGHKITIMSALAFGTPMNFSACYLEGISKLDSRDIKYAEELGYRIKLLGVTRKTGKGIELRVHPTLIPESRLLANVDGVMNAVRVNADMVGETLYYGAGAGALPTASAVVADIIDIARLVEADTAHRVPHLAFQPAQVQAQTILPMDEITSSYYLRVQAKDEPGTLGQIAALLAQENVSIEALIQKGVIDQTTAEIVILTHSTVEKHIKSAIAAIEALDCVEKPITMIRMESLHD

SEQ ID NO: 4919 - DNA, 369 bp, Neisseria gonorrhoeae
atgttgtttgaagaaaatccgatagacggacagtttgcagaatatgaatgcggcgcgggcggaatccggctggcggggcaaagtttccataaacccgtgcttgtacataaggattcggtctgcctgccgcaatgccgaaccttgtccgacctgactccggaaaacctgttgtccgacatcaaacctgttgactatccggaaatattgattatcgggacgggcgcggctcaggagtttatccatcccaaaatcatggcggatttttcccgaatcggaatcagcgtggaatgcatgaataccgattcggcattcaggacattggttttcctgcactcggaagggcgcagggcttgggcttggcttcaaccg

SEQ ID NO: 4920 - protein, 123 aa, Neisseria gonorrhoeae
MLFEENPIDGQFAEYECGAGGIRLAGQSFHKPVLVHKDSVCLPQCRTLSDLTPENLLSDIKPVDYPEILIIGTGAAQEFIHPKIMADFSRIGISVECMNTDSAFRTLVFLHSEGRRAWAWLQP

SEQ ID NO: 4921 - DNA, 531 bp, Neisseria gonorrhoeae
gtgatcgacgatgcggtagccgttttcctcggcgattttgtcttgcagggcttcgatttcgggattgtggaattccgttacctcgccgcacttcacgcagacgatatggtcgtggtggtcgcccttgtccaactcataaaccgccttgcccgtttcaaaatggtggcgttgcagaatgcccgcctgctcgaactgcgtcagcacgcggtaaatcgtcgccacaccgatttccacgccctcttccagcagaatgcggtacacatcttccgcactcaaatgctcttccgcgtgcttctcgaacaaatccaaaatcttcaaacgcgggccggtaaccttcagaccgctgtctttcagttgcgcaatgttgctgaatttttccataatattcaatatccctgtaaaataatagacgctataatacgcaatttcagcctgcttgcccactatcacaccatagcagttcgcaatagcaaaaccgcaacggcggacgggcagtcggacacagacagggtaaaataccgcttaagcgta

SEQ ID NO: 4922 - protein, 177 aa, Neisseria gonorrhoeae
VIDDAVAVFLGDFVLQGFDFGIVEFRYLAALHADDMVVVVALVQLINRLARFKMVALQNARLLELRQHAVNRRHTDFHALFQQNAVHIFRTQMLFRVLLEQIQNLQTRAGNLQTAVFQLRNVAEFFHNIQYPCKIIDAIIRNFSLLAHYHTIAVRNSKTATADGQSDTDRVKYRLSV

SEQ ID NO: 4923 - DNA, 624 bp, Neisseria gonorrhoeae
atggctgatatgaaacgcttgaaacatttgatgttctcaccctttatcgacaacaacccgattgccttgcaggttttgggtatttgttcggctttggcggttaccaccaaacttcagacggccatcgtaatgggtatttccgtagctttggtaaccggtttttccagcttcttcatttcgctggtgcgcaactacatccccaacagcatccgcatcatcgtgcaaatggcgattatcgcgtcgctggttacgctggtcgaccaactgcttcaggcatttgcctacgaattgtccaagcagctttccgtattcgtcggcctgattattaccaactgtatagtgatgggccgtgccgaagcatttgcgatgaaagagccgccgctggaaagcctgatcgacggcatcggcaacggtgcgggctacgggatgatgctgcttgtcgtcgccaccgtccgcgaactgatcggctcaggcaaacttttaggttataccgtctttcaaaccgtacaggacggcggctggtatcagaccaacggcctcttcctactcgcccccagcgcgttcttcatcatcggctttttgatttggggactgcgtacttggaaacccgaacaggcggaggaa

SEQ ID NO: 4924 - protein, 208 aa, Neisseria gonorrhoeae
MADMKRLKHLMFSPFIDNNPIALQVLGICSALAVTTKLQTAIVMGISVALVTGFSSFFISLVRNYIPNSIRIIVQMAIIASLVTLVDQLLQAFAYELSKQLSVFVGLIITNCIVMGRAEAFAMKEPPLESLIDGIGNGAGYGMMLLVVATVRELIGSGKLLGYTVFQTVQDGGWYQTNGLFLLAPSAFFIIGFLIWGLRTWKPEQAEE

SEQ ID NO: 4925 - DNA, 1290 bp, Neisseria gonorrhoeae
atggctgtcttcccactttcggcaaaacatcggaaatacgcgctgcgcgcgcttgccgtttcgattattctggtgtcggcggcatacattgcttcgacagaggggacggagcgcgtcagaccgcagcgcgtggaacaaaaactgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcagtgcgcgcgaagtgcagttttttaccgacgaagacggcgagcgcaatctggtcgctttggaaaaaaaaggcggcatatggcggcggtcggcttctgatgcggatatgaaggttttgccgacactgcgttcggtcgtggtcaaaacgtcggcgcgcggttcgctggcgcgggcggaagtgcccgtcgaaatccgcgaatccttaagcgggatttttgccggccgcttcagccttgacggtttgaaggaaggcgatgccgtgcgcctgctttacgacagcctgtatttccacgggcagcaggtggcggcgggcgatattttggcggcggaagttgtcaagggcggcacaacccatcaggcgttctattaccgttcggacaaggaaggcggagggggcggcaattattacgatgaagacggcagggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcacaaggcaatgtgcgcggcggcgaggtcatcggttttgtcggttcgacagggcgttcgaccgggccgcacctgcattacgaggcgcgcatcaacgggcagcccgtcaatcctgtttcggtcgcattgccgacacccgaattgacgcaggcggacaaggcggcgtttgccgcgcagaaacagaaggcggacgcgctgcttgcgcgcttgcgcggcataccggttaccgtgtcgcaatcggat

SEQ ID NO: 4926 - protein, 430 aa, Neisseria gonorrhoeae
MAVFPLSAKHRKYALRALAVSIILVSAAYIASTEGTERVRPQRVEQKLPPLSWGGSGVQTAYWVQEAVQPGDSLADVLARSGMARDEIARITEKYGGEADLRHLRADQSVHVLVGGDGSAREVQFFTDEDGERNLVALEKKGGIWRRSASDADMKVLPTLRSVVVKTSARGSLARAEVPVEIRESLSGIFAGRFSLDGLKEGDAVRLLYDSLYFHGQQVAAGDILAAEVVKGGTTHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAQGNVRGGEVIGFVGSTGRSTGPHLHYEARINGQPVNPVSVALPTPELTQADKAAFAAQKQKADALLARLRGIPVTVSQSD

SEQ ID NO: 4927 - DNA, 123 bp, Neisseria gonorrhoeae
atgcatgaataccgattcggcattcaggacattggttttcctgcactcggaagggcgcagggcttgggcttggcttcaaccgtaaatttcccgtttcagacggcatcggcactgactttcagg

SEQ ID NO: 4928 - protein, 41 aa, Neisseria gonorrhoeae
MHEYRFGIQDIGFPALGRAQGLGLASTVNFPFQTASALTFR

SEQ ID NO: 4929 - DNA, 1920 bp, Neisseria gonorrhoeae
atgattgaaatcaaaaacctcaccctgcaacgcggtttgaaagtcctgctcgacaaggcttccgctgccgtcaatcccggtcagcgcgtcggtttgatcggtaagaacgggacgggcaaatccagcctgtttgccttaatcaagggcgaaatcactcaggacggcggcgatatctcgattccgaaaaactggcggctcgcttccgtttcccaagaaacgcccgatttggatatttccgctttggattacgttttgcagggcgatgccgagttgcaggcttttcagacggcattgaggcaggcggaagtgcaaaatgacggcatgaagcaggcggaatatcatgccaaattggaagaaatcgacgcctataccgcgccggcccgcgcggcaaaattgttgaacgggctgggtttttcgcaagaagaacacagccgtcccgtcaaatccttttccggcggctggcgtatgcgcctgaatcttgcgcaagccctgatttgccgcgctgatttgctcttgcttgacgaaccgaccaaccatttggatttggaaactgtcttgtggttggaaaaccaccttgcctctttaccctgcacgcaaatcatcatttcccacgaccgtgatttcctcaatgcggccaccacccaaaccattgaattgtcgcagcaaaagctcacgcaatacagcggcaattacgatttttaccaaaccgaacgcgcgcagcgtctggcgcaacaacaagccgcatatgtcaaacagcaggcgcaaatcaaacatctgcaatcctttatcgaccgcttcaaagccaaagccactaaagccgttcaagctcaaagccgcatgaaggcgttggcgaagctcgaacgcatcgctcccgcacatctggacagcgagttttcctttgagttttacaatcccgaccatctgcccaatcctttgctgaagctggagcacgctgatttgggttacgaaggtaaaaccgtcctgcatgacattaccctgtcgctggaaagcggcgcacgctacgggctattgggtgtcaacggcagcggtaaatctacgtttatcaaagctttggcaggaaaaatcgatttactctccggcagcatcgtccattccgaaaaacttaatatcggctatttcgcccaacaccagcttgacaccatccgcgccgaccaaagccctgtttggcatatacagcagctttctcccgaagtacgcgaacaagaaatccgaaatttcctcggcggcttcgattttgtcggtgatatggcgttacagaaaaccgaacctttttccggcggagaaaaagcccgccttgcccttgccatgattatctggcaaaagccgaacctgctgctgcttgacgaaccgaccaaccatctggatttggatatgcgccacgccttaacgctcgcgttgcaaagtttccaaggtgcattaatcgtcgtatcgcacgaccgcagcctgcttgaagccacgaccgacagtttcctcttgatagacaaaggtcgtctgaaaaactttgacggcgatttgaacgattaccgccaatggcgcttggcacaggaaaacgccgcaaccgcgccagccgcttccactcaaagccaaaaccgcaaggataccaagcgtatcgaagcgcaaatccgtcaagaaaaagcccgacgcagtaagccgatacaacagaaaatcgacaaagccgaaaaagaaatggtgcagctttctgaaattcagacgggatgcgaagcatttttaacacaagaagacgcttaccttgaagcaaacaaagaaaaattgcaaaataccttatccgagctggcaaaagtcaaaacacagcttgcccaaatcgaagaaacttggctggcttgtcaagaagaattggaacggattgaaactgaaatcgagaaacagtttgccgagcga

SEQ ID NO: 4930 - protein, 640 aa, Neisseria gonorrhoeae
MIEIKNLTLQRGLKVLLDKASAAVNPGQRVGLIGKNGTGKSSLFALIKGEITQDGGDISIPKNWRLASVSQETPDLDISALDYVLQGDAELQAFQTALRQAEVQNDGMKQAEYHAKLEEIDAYTAPARAAKLLNGLGFSQEEHSRPVKSFSGGWRMRLNLAQALICRADLLLLDEPTNHLDLETVLWLENHLASLPCTQIIISHDRDFLNAATTQTIELSQQKLTQYSGNYDFYQTERAQRLAQQQAAYVKQQAQIKHLQSFIDRFKAKATKAVQAQSRMKALAKLERIAPAHLDSEFSFEFYNPDHLPNPLLKLEHADLGYEGKTVLHDITLSLESGARYGLLGVNGSGKSTFIKALAGKIDLLSGSIVHSEKLNIGYFAQHQLDTIRADQSPVWHIQQLSPEVREQEIRNFLGGFDFVGDMALQKTEPFSGGEKARLALAMIIWQKPNLLLLDEPTNHLDLDMRHALTLALQSFQGALIVVSHDRSLLEATTDSFLLIDKGRLKNFDGDLNDYRQWRLAQENAATAPAASTQSQNRKDTKRIEAQIRQEKARRSKPIQQKIDKAEKEMVQLSEIQTGCEAFLTQEDAYLEANKEKLQNTLSELAKVKTQLAQIEETWLACQEELERIETEIEKQFAER

SEQ ID NO: 4931 - DNA, 417 bp, Neisseria gonorrhoeae
ttgaaactgaaatcgagaaacagtttgccgagcgataaagaagcgcgggcagggtgcttatctttgcctgccaataacggtataattcggacgttaccaccgcctttttactttaccggtataaacatcagactttttgccgccttgggtctcctgtccctttccggcgcggcggcgcaagcctccatataccattgcaactcaaatggcaaaagcgtatatacatcagacccgtcaggatcgtgtgccgatgctgatttacctaaaatcagcagccatcagggaggcggataccgcctgaaaattaaaaaacttagtcaagaagccaaaatacacacaggaaacaaaaagaaaaacaaaaaacatgccgggaaaaagaacagacaggctgccaaagccccgaaggaaaatcaaaaa

SEQ ID NO: 4932 - protein, 139 aa, Neisseria gonorrhoeae
LKLKSRNSLPSDKEARAGCLSLPANNGIIRTLPPPFYFTGINIRLFAALGLLSLSGAAAQASIYHCNSNGKSVYTSDPSGSCADADLPKISSHQGGGYRLKIKKLSQEAKIHTGNKKKNKKHAGKKNRQAAKAPKENQK

SEQ ID NO: 4933 - DNA, 510 bp, Neisseria gonorrhoeae
atgaaatcaaaactccccttaatcctaatcaacctttccctgatttcaagcccattgggtgcgaatgcggccaaaatctatacctgcacaatcaacggagaaaccgtttacaccaccaagccgtctaaaagctgccactcaaccgatttgcccccaatcggcaactacagcagcgaacgctatatcctgccccaaactcccgaaccggcaccatcaccgtcaaacggcggacaggctgtcaaatataaagccccggtcaaaacagtatccaagccggcaaaatccaatacgccgcctcaacaagcacctgtaaataacagcagacgctccattctcgaagcagaattaagcaatgaacgcaaagccctgactgaagcccaaaaaatgttatcacaagcacgtctggcaaaaggcggcaacatcaaccatcaaaaaatcaacgcattgcaaagcaatgttttggacagacagcaaaatatccaagcactgcaaagagaattgggacgtatg

SEQ ID NO: 4934 - protein, 170 aa, Neisseria gonorrhoeae
MKSKLPLILINLSLISSPLGANAAKIYTCTINGETVYTTKPSKSCHSTDLPPIGNYSSERYILPQTPEPAPSPSNGGQAVKYKAPVKTVSKPAKSNTPPQQAPVNNSRRSILEAELSNERKALTEAQKMLSQARLAKGGNINHQKINALQSNVLDRQQNIQALQRELGRM

SEQ ID NO: 4935 - DNA, 189 bp, Neisseria gonorrhoeae
ttgacagaagaaatgatgaaaaagcaggagaatttttgggataagttgggcgatttactgtttgcgcccgttgatataatgttttggattaaaaaagtatgggcggcatatcctgtgtgtcggctgcctgtaatcgtattgaaggtcaacgtattccccaataccggctacacgtacaactgtttccga

SEQ ID NO: 4936 - protein, 63 aa, Neisseria gonorrhoeae
LTEEMMKKQENFWDKLGDLLFAPVDIMFWIKKVWAAYPVCRLPVIVLKVNVFPNTGYTYNCFR

SEQ ID NO: 4937 - DNA, 225 bp, Neisseria gonorrhoeae
atgctcgctgttccgccgcaggcattgcccgtcaaatcggcaatggcggaggaattcacggcacgctggcattttcattgctgtttttgtcgctgggacatattggaatggttgcctaccaccacatcaaaggcgaatccgttctgcccctgttcttgcttatctaggttattgcaaaatatgagtttgaaagatggatatttttgtttgcttttttatttgttc

SEQ ID NO: 4938 - protein, 75 aa, Neisseria gonorrhoeae
MLAVPPQALPVKSAMAEEFTARWHFHCCFCRWDILEWLPTTTSKANPFCPCSCLSRLLQNMSLKDGYFCLLFYLF

SEQ ID NO: 4939 - DNA, 180 bp, Neisseria gonorrhoeae
ttgggcgtatgccctgatgctcgctgttccgccgcaggcattgcccgtcaaatcggcaatggcggaggaattcacggcacgctggcattttcattgctgtttttgtcgctgggacatattggaatggttgcctaccaccacatcaaaggcgaatccgttctgcccctgttcttgcttatc

SEQ ID NO: 4940 - protein, 60 aa, Neisseria gonorrhoeae
LGVCPDARCSAAGIARQIGNGGGIHGTLAFSLLFLSLGHIGMVAYHHIKGESVLPLFLLI

SEQ ID NO: 4941 - DNA, 159 bp, Neisseria gonorrhoeae
atgcctgcggcggaacagcgagcatcagggcatacgcccaatgcccaatttggtgacggcggtgttggcggggcggtttttacgttggcggattccctaccctacgcaccaaacagacaatatcagcagcaggattctgactgcacggatatgttggta

SEQ ID NO: 4942 - protein, 53 aa, Neisseria gonorrhoeae
MPAAEQRASGHTPNAQFGDGGVGGAVFTLADSLPYAPNRQYQQQDSDCTDMLV

SEQ ID NO: 4943 - DNA, 591 bp, Neisseria gonorrhoeae
atggaacactatttgagcctcttcatcaaatccgtcttcattgaaaatatggcgctatccttctttttgggtatgtgtacgtttttggcggtatccaaaaaagtatccaccgcattcggtttgggtgtggcggtaattttcgtactcgggctgtccgtccccgccaaccaattggtttactcgctgctcaaagacggcgcgattgtcgaaggcgtggatttgacctttttgaaattcatcacctttatcggcgtgattgccgctttggtgcagattttggaaatgttcttggacaaattcgtccccgccctctataacgcgctgggcatctacctgcctctgattaccgtaaactgcgcaattttcggtgccgtttcgtttatggcgcaacgcgaatacgacttcggcgagtccgtcgtgtacggcttcggcgcgggtttgggctggatgttggcgattgtcgctttagcgggcattaccgaaaaaatgaaatattcggacgctcccaaaggcctcaaaggcttgggcattacctttatcgccgccggcctgatggcaatggcgtttatgtcgttctccggcatccagtta

SEQ ID NO: 4944 - protein, 197 aa, Neisseria gonorrhoeae
MEHYLSLFIKSVFIENMALSFFLGMCTFLAVSKKVSTAFGLGVAVIFVLGLSVPANQLVYSLLKDGAIVEGVDLTFLKFITFIGVIAALVQILEMFLDKFVPALYNALGIYLPLITVNCAIFGAVSFMAQREYDFGESVVYGFGAGLGWMLAIVALAGITEKMKYSDAPKGLKGLGITFIAAGLMAMAFMSFSGIQL

SEQ ID NO: 4945 - DNA, 1131 bp, Neisseria gonorrhoeae; identical to SEQ ID NO: 679

SEQ ID NO: 4946 - protein, 377 aa, Neisseria gonorrhoeae; identical to SEQ ID NO: 680

SEQ ID NO: 4947 - DNA, 153 bp, Neisseria gonorrhoeae
ttgtgcaaaagaagcaacatcatgaaattcaagcaatttattcttgccactgttttgggcgcgacagccttttccgcttgggcggacgattcataccaacatatccgtgcagtcagaatcctgctgctgatattgtctgtttggtgcgtaggg

SEQ ID NO: 4948 - protein, 51 aa, Neisseria gonorrhoeae
LCKRSNIMKFKQFILATVLGATAFSAWADDSYQHIRAVRILLLILSVWCVG

SEQ ID NO: 4949 - DNA, 333 bp, Neisseria gonorrhoeae
atgcccaatttggtgacggcggtgttggcggggcggtttttacgttggcggattccctaccctacgcaccaaacagacaatatcagcagcaggattctgactgcacggatatgttggtatgaatcgtccgcccaagcggaaaaggctgtcgcgcccaaaacagtggcaagaataaattgcttgaatttcatgatgttgcttcttttgcacaaagcgttcggaatagtgaagcccgcagcctatggctttgcggcagtcgcagctttacaagcggtattgcaggaaaccttaaaacacgatcattgcatcaagagctgttcgaattccgccaaa

SEQ ID NO: 4950 - protein, 111 aa, Neisseria gonorrhoeae
MPNLVTAVLAGRFLRWRIPYPTHQTDNISSRILTARICWYESSAQAEKAVAPKTVARINCLNFMMLLLLHKAFGIVKPAAYGFAAVAALQAVLQETLKHDHCIKSCSNSAK

SEQ ID NO: 4951 - DNA, 177 bp, Neisseria gonorrhoeae
ttgcttgaatttcatgatgttgcttcttttgcacaaagcgttcggaatagtgaagcccgcagcctatggctttgcggcagtcgcagctttacaagcggtattgcaggaaaccttaaaacacgatcattgcatcaagagctgttcgaattccgccaaatgaacctgacacgcaaactt

SEQ ID NO: 4952 - protein, 59 aa, Neisseria gonorrhoeae
LLEFHDVASFAQSVRNSEARSLWLCGSRSFTSGIAGNLKTRSLHQELFEFRQMNLTRKL

SEQ ID NO: 4953 - DNA, 714 bp, Neisseria gonorrhoeae
ttggcacgatgcactcggcggcgaaaaacagcagccgtattttcaggaaattttaaatgcggtcaggcaggaacgtttgtcggggcaaattatctatccgccggaggccgatgtgttcaacgcattccggctgacagcgttcgaccgggtcaaagtcgtcattctcggacaagatccgtatcacggggtagggcaggcgcacggtttggcattttccgtccggcagggtgtccgcataccgccgtctttactcaatatttacaaagaattggaaaccgacatcgaaggcttttccattcccgcgcacggctgcctgacagcgtgggcggagcagggcatattgcttctgaacacggttttgacggtgcgtgcaggacaggcgcattcgcacgcccttttaggctgggaacgctttaccgataccgtcatcaggcagcttgcgacacaccgcaagcaccttgtcttcatgttgtggggtgggtatgcacaacaaaaagggaggctgatagacagtcaaaatcatttgatactgaccgcgcctcatccgtctcctctgtcggcatatcgcggtttttttggctgccgccatttttcacaggcaaacagctatttgagtcaacacggtatcgaaccgataaactggaagctatgaatgccgtattcaagcgtcaaagtttgcgtgtcaggttcatttggcggaattcgaacagctct

SEQ ID NO: 4954 - protein, 238 aa, Neisseria gonorrhoeae
LARCTRRRKTAAVFSGNFKCGQAGTFVGANYLSAGGRCVQRIPADSVRPGQSRHSRTRSVSRGRAGARFGIFRPAGCPHTAVFTQYLQRIGNRHRRLFHSRARLPDSVGGAGHIASEHGFDGACRTGAFARPFRLGTLYRYRHQAACDTPQAPCLHVVGWVCTTKREADRQSKSFDTDRASSVSSVGISRFFWLPPFFTGKQLFESTRYRTDKLEAMNAVFKRQSLRVRFIWRNSNSS

SEQ ID NO: 4955 - DNA, 657 bp, Neisseria gonorrhoeae
atggacacttggcacgatgcactcggcggcgaaaaacagcagccgtattttcaggaaattttaaatgcggtcaggcaggaacgtttgtcggggcaaattatctatccgccggaggccgatgtgttcaacgcattccggctgacagcgttcgaccgggtcaaagtcgtcattctcggacaagatccgtatcacggggtagggcaggcgcacggtttggcattttccgtccggcagggtgtccgcataccgccgtctttactcaatatttacaaagaattggaaaccgacatcgaaggcttttccattcccgcgcacggctgcctgacagcgtgggcggagcagggcatattgcttctgaacacggttttgacggtgcgtgcaggacaggcgcattcgcacgcccttttaggctgggaacgctttaccgataccgtcatcaggcagcttgcgacacaccgcaagcaccttgtcttcatgttgtggggtgggtatgcacaacaaaaagggaggctgatagacagtcaaaatcatttgatactgaccgcgcctcatccgtctcctctgtcggcatatcgcggtttttttggctgccgccatttttcacaggcaaacagctatttgagtcaacacggtatcgaaccgataaactggaagcta

SEQ ID NO: 4956 - protein, 219 aa, Neisseria gonorrhoeae
MDTWHDALGGEKQQPYFQEILNAVRQERLSGQIIYPPEADVFNAFRLTAFDRVKVVILGQDPYHGVGQAHGLAFSVRQGVRIPPSLLNIYKELETDIEGFSIPAHGCLTAWAEQGILLLNTVLTVRAGQAHSHALLGWERFTDTVIRQLATHRKHLVFMLWGGYAQQKGRLIDSQNHLILTAPHPSPLSAYRGFFGCRHFSQANSYLSQHGIEPINWKL

SEQ ID NO: 4957 - DNA, 507 bp, Neisseria gonorrhoeae
gtgcatcgtgccaagtgtccatatctgccctatcctttcaaattcggctatactgctgatattgcgttattttgtcaaacgacgcgctttgtggggaaatgtatgactgtatggtttgttgccgctgttgccgtcttaatcatcgaattattgacgggaacggtttatcttttggttgtcagcgcggctttggcgggttcgggcattgcctacgggctgactggcagcacgcctgccgccgtcttgaccgccgcactgctttccgcgctgggcatttggttcgtacatgccaaaaccgccgtgggaaaagttgaaacggattcatatcaggatttggataccggaaaatatgccgaaatcctccgatacacaggcggcaaccgttacgaagttttttatcgcggtacgcactggcaggcgcaaaatacggggcaggaagtgtttgaaccgggaacgcgcgccctcatcgtccgcaaagaaggtaaccttcttatcatcgcaaaccct

SEQ ID NO: 4958 - protein, 169 aa, Neisseria gonorrhoeae
VHRAKCPYLPYPFKFGYTADIALFCQTTRFVGKCMTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 4959 - DNA, 945 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccatccgtcaaattgccgccgcccttcaaacccaaggcggggcggatgcggtcaatctgaagattgcggaacaatacgtagccgcgttcaacaatcttgccaaagaaagcaatacgctgattatgcccgccaatgttgccgacatcggcagcctgatttctgccggcatgaaaattatcgacagcagcaaaaccgccaaa

SEQ ID NO: 4960 - protein, 315 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 4961 - DNA, 375 bp, Neisseria gonorrhoeae
gtgaacaaaaccctcatcctcgccctttccgccctgttcagcctgaccgcgtgcagcgtcgaacgcgtctcgctgtttccctcctacaaactcaaaatcatccaaggcaacgaactcgaaccgcgcgccgttgccgccctgcgccccggcatgaccaaagaccaagtcctgctcctgctcggcagccccatactgcgcgacgctttccataccgaccgctgggactataccttcaacacctcccgcaacggcatcatcaaagaacgcagcaacctgaccgtctattttgaaaacggcgtactcgtccgcaccgaaggcgacgccctccaaaatgccgccgaagccctccgcgcgaaacaaaacgcagacaaacaa

SEQ ID NO: 4962 - protein, 125 aa, Neisseria gonorrhoeae
VNKTLILALSALFSLTACSVERVSLFPSYKLKIIQGNELEPRAVAALRPGMTKDQVLLLLGSPILRDAFHTDRWDYTFNTSRNGIIKERSNLTVYFENGVLVRTEGDALQNAAEALRAKQNADKQ

SEQ ID NO: 4963 - DNA, 1215 bp, Neisseria gonorrhoeae
atggagattattttaggtatcgtgatgtttaccgtcatcgtcttagctttggcactgatgattctgtttgccaaatccaagttggtcagcgaaggcgacatcaccatcaaagtcaatgatgaaaaagaactgactatgcccgccggcggcaaactcttgggcgcgcttgccagccaaggcatctttgtcccctccgcctgcggtggcggcggttcgtgcggacaatgccgcgttgtcgtgaaaagcggcggcggcgacattctgccgaccgagctgtcccacatcagcaaacgcgaagcacgcgaaggctgccgtttgtcctgccaagtcaatgtcaaaaccgacatggacatcgaagtacccgaagaagtgttcggcgtgaaaaaatgggaatgcaccgtcatttccaacgacaacaaagcaacgttcattaaagaactcaagcttgccattcccgaaggcgaagaagttcctttccgcgccggcggctacattcaaatcgaagccccgccgcacaccgttgcctacaaagacttcgacattcccaaggaatatcacgaagactgggacaaatacaatctgtggcaatacgtttccaaagtgaacgagccgattttgcgcgcctactctatggcttcgtatcctgaagaaaaaggcatcattatgctgaacgtgcgtatcgccacgcctcccccgcgcgtacccaatgcacctccgggacaaatgtcgtcctacatctggtcgctcaaacccggcgacaaagttacgatttccggcccgttcggcgaatttttcgccaaagacaccgatgccgaaatggtatttatcggcggcggtgcgggtatggccccgatgcgttcccacattttcgaccagttgaaacgtttgcactccaaacggaaaatcaccttctggtacggcgcacgctccaaacgcgaaatgttctatgtcgaagacttcgaccaactcgcggcagaattcccgaacttcacttggcacgtcgccctgtccgacccattgcctgaagacaactgggacggctacacgggcttcatccacaacgtggtttacgaaaaccacctgaaaaaccacgaagcaccggaagactgcgaattttatatgtgcggcccgccgattatgaaccagtccgtcatcaaaatgctcaaagacttgggcgtggaagacgaaaacatcctcttggacgatttcggcggt

SEQ ID NO: 4964 - protein, 405 aa, Neisseria gonorrhoeae
MEIILGIVMFTVIVLALALMILFAKSKLVSEGDITIKVNDEKELTMPAGGKLLGALASQGIFVPSACGGGGSCGQCRVVVKSGGGDILPTELSHISKREAREGCRLSCQVNVKTDMDIEVPEEVFGVKKWECTVISNDNKATFIKELKLAIPEGEEVPFRAGGYIQIEAPPHTVAYKDFDIPKEYHEDWDKYNLWQYVSKVNEPILRAYSMASYPEEKGIIMLNVRIATPPPRVPNAPPGQMSSYIWSLKPGDKVTISGPFGEFFAKDTDAEMVFIGGGAGMAPMRSHIFDQLKRLHSKRKITFWYGARSKREMFYVEDFDQLAAEFPNFTWHVALSDPLPEDNWDGYTGFIHNVVYENHLKNHEAPEDCEFYMCGPPIMNQSVIKMLKDLGVEDENILLDDFGG

SEQ ID NO: 4965 - DNA, 1068 bp, Neisseria gonorrhoeae
atgtatcggagaaaaggacggggcatcaagccgtggatgggtgccggcgcggcgtttgccgccttggtctggctggtttacgcgctcggcgatactttgactccgtttgcggttgcggcggtgctggcgtatgtgttggaccctttggtcgaatggttgcagaaaaagggtttgaaccgtgcatccgcttcgatgtctgtgatggtgttttccttgattttgttgttggcattattgttgattattgtccctatgctggtcgggcagttcaataatttggcatctcgcctgccccaattaatcggttttatgcagaacacgctgctgccgtggttgaaaaatacaatcggcggatatgtggaaatcgatcaggcatctattattgcgtggtttcaggcgcatacgggcgagttgagcaacgcgcttaaggcgtggtttcccgttttgatgaaacagggcggcaatattgtcagcagtatcggcaacctgctgctgccgcccttgctgctttactatttcctgctggattggcagcggtggtcgtgcggcatcgccaaactggttccgaggcgttttgccggtgcttatacgcgcattacgggtaatttgaacgaggtattgggcgaatttttgcgcggtcagcttctggtgatgctgattatgggcttggtttacggtttgggattgatgctagtcggactggattcgggatttgccatcggtatggttgccggtattttggtgtttgtcccctatttgggtgcgtttacgggattgctgcttgccactgttgcagccttgctccagttcggttcgtggaacggaatcttggctgtttgggcggtttttgccgtcggtcagtttctcgaaagttttttcattacgccgaaaattgtaggagaccgtatcggcctgtcgccgttttgggttatcttttcgctgatggcgttcggagagctgatgggctttgtcggaatgttggccggattgcctttggccgccgtaaccttggtcttgcttcgcgagggcgcgcagaaatattttgccggcagtttttaccggggcagg

SEQ ID NO: 4966 - protein, 356 aa, Neisseria gonorrhoeae
MYRRKGRGIKPWMGAGAAFAALVWLVYALGDTLTPFAVAAVLAYVLDPLVEWLQKKGLNRASASMSVMVFSLILLLALLLIIVPMLVGQFNNLASRLPQLIGFMQNTLLPWLKNTIGGYVEIDQASIIAWFQAHTGELSNALKAWFPVLMKQGGNIVSSIGNLLLPPLLLYYFLLDWQRWSCGIAKLVPRRFAGAYTRITGNLNEVLGEFLRGQLLVMLIMGLVYGLGLMLVGLDSGFAIGMVAGILVFVPYLGAFTGLLLATVAALLQFGSWNGILAVWAVFAVGQFLESFFITPKIVGDRIGLSPFWVIFSLMAFGELMGFVGMLAGLPLAAVTLVLLREGAQKYFAGSFYRGR

SEQ ID NO: 4967 - DNA, 156 bp, Neisseria gonorrhoeae
atgccccgtccttttctccgatacataaaatccacccttccgaaaataatattgcgcgccagtatagcagaaccgccgcgccgtcaaaaaagcctccgccttcccgatagcctgttatcgtggtttaggctaaaatactgcacatccgatgccgtc

SEQ ID NO: 4968 - protein, 52 aa, Neisseria gonorrhoeae
MPRPFLRYIKSTLPKIILRASIAEPPRRQKSLRLPDSLLSWFRLKYCTSDAV

SEQ ID NO: 4969 - DNA, 156 bp, Neisseria gonorrhoeae
atgagggatgttttgttttcttgttcggtcatgatgtgctgccttatcgtgtacggtatgccgtctgaaagcgggtttgcctttcagacggcatcggatgtgcagtattttagcctaaaccacgataacaggctatcgggaaggcggaggcttttt

SEQ ID NO: 4970 - protein, 52 aa, Neisseria gonorrhoeae
MRDVLFSCSVMMCCLIVYGMPSESGFAFQTASDVQYFSLNHDNRLSGRRRLF

SEQ ID NO: 4971 - DNA, 210 bp, Neisseria gonorrhoeae
atgggggcggttcatcccgagttcgagcaagcggttttagaaaccgtccgccttcacgcccccgacacgcaggctcaccacatcaccacgcgtccgagcagcaaaggcaactataccggtgccaccgttcaggtaaaggttgaaaaccaagaacaattggacaacatctaccgcgcactgacttcgcacgaactggtcaaagtggtactt

SEQ ID NO: 4972 - protein, 70 aa, Neisseria gonorrhoeae
MGAVHPEFEQAVLETVRLHAPDTQAHHITTRPSSKGNYTGATVQVKVENQEQLDNIYRALTSHELVKVVL

SEQ ID NO: 4973 - DNA, 621 bp, Neisseria gonorrhoeae
atgaaaatcatacacaaaggtttggtcgaatatctgccgacttttgaggcaatgaaaacctttaatgccggacggaatgcagacaccgaagacgaactgtgggtcgtcgaacacccgcccgtctttacgcaaggactggcgggaaaacccgagcacctgctgattagggacgacatccccgtcgtccaaatcgaccggggcgggcagattacctatcacgggcccgggcaattggtcgtttatacgatgattgatttcaaacggcgcaaaaccagcgtccgcaacatcgtttccgcgcttgaaaacagcatcatcgccacattggcggaatacggcatcgaagcggcggcagatcccaaacgccccggcatttacgtcggcgaacgcaaaatcgcctcactggggctgcgtatcaaaaacggttccgtctatcacggactcgcactcaacgtcaatatggatttaagcccgtttacccaaatcaacccctgcggctacgccggtatggaaatgacgcaaatcgcggattttgtccaaccctgccccgcgccggacgaagtcgcctccaaactcaccgcacaccttgaaacacaactcacaccgaaagcagacaacaatgag

SEQ ID NO: 4974 - protein, 207 aa, Neisseria gonorrhoeae
MKIIHKGLVEYLPTFEAMKTFNAGRNADTEDELWVVEHPPVFTQGLAGKPEHLLIRDDIPVVQIDRGGQITYHGPGQLVVYTMIDFKRRKTSVRNIVSALENSIIATLAEYGIEAAADPKRPGIYVGERKIASLGLRIKNGSVYHGLALNVNMDLSPFTQINPCGYAGMEMTQIADFVQPCPAPDEVASKLTAHLETQLTPKADNNE

SEQ ID NO: 4975 - DNA, 1014 bp, Neisseria gonorrhoeae
ttgaaacacaactcacaccgaaagcagacaacaatgagtgaaatcaaaaccgacgaccccaaacgcggcatcaaactcagaggcgcggacaaaaccgcccgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggcgacatctgcacccgccgctgcccgttctgcgacgtgggacacggccgtccgaatatgctcgaccccgacgagccgaaaaacctcgcagaatccgtcaaagccatgaacctgcgttacgtcgtcatcacctcggttgaccgcgacgacctgcgcgacggcggcgcccaacacttcgccgactgcatcaaagccatccgcgaaaccagcccgaacaccaaaatcgaaatcctcgtccccgacttccgaggccgcttggacatcgcactgaaaatccttgccgaaaccccgcccgacgtgatgaaccacaacttggaaacccatccgagcctgtacagaaaagcccgtcccggtgccaattatcaacattctttagacttattaaaacgttataaagaaatgatgccgcatatcccgaccaaatccggcattatggtaggcttgggcgaaacagacgaagacgtgcgtgaaattatgcgcgatatgcgggcgcacaatatcgagatgattaccatcggacagtacctccagccttcagacggacacttgcctgtcttgcgctacgttacacccgaacaattcaaaatatttgaaaaagaagcatacgaactgggctttaccaatgccgccatcggcgcgatggtacgttcaagttaccatgccgacgaacaggcggcggaagccttacgcgaaagccacggcggttgcgggcatcat

SEQ ID NO: 4976 - protein, 338 aa, Neisseria gonorrhoeae
LKHNSHRKQTTMSEIKTDDPKRGIKLRGADKTARIPIKVVPLQEKLKKPEWIRAKLPSRKFFEIKDILREQKMHTVCEEASCPNIGECFSKGTATFMIMGDICTRRCPFCDVGHGRPNMLDPDEPKNLAESVKAMNLRYVVITSVDRDDLRDGGAQHFADCIKAIRETSPNTKIEILVPDFRGRLDIALKILAETPPDVMNHNLETHPSLYRKARPGANYQHSLDLLKRYKEMMPHIPTKSGIMVGLGETDEDVREIMRDMRAHNIEMITIGQYLQPSDGHLPVLRYVTPEQFKIFEKEAYELGFTNAAIGAMVRSSYHADEQAAEALRESHGGCGHH

SEQ ID NO: 4977 - DNA, 162 bp, Neisseria gonorrhoeae
atgcgtgcattgtatgcaaaagctgtcggcatgacaaattttctatttaaaatacaaacaattatcaaaataaatagggcgtattccccgatgccttccaaatcagtatgctgtttcttatcggttttttttgctgctaaaactaagaatccatctcatcaa

SEQ ID NO: 4978 - protein, 54 aa, Neisseria gonorrhoeae
MRALYAKAVGMTNFLFKIQTIIKINRAYSPMPSKSVCCFLSVFFAAKTKNPSHQ

SEQ ID NO: 4979 - DNA, 423 bp, Neisseria gonorrhoeae
cactagacatcccgatttgcacagaaaggttctcccgtgaacaaaaccctcatcctcgccctttccgccctgttcagcctgaccgcgtgcagcgtcgaacgcgtctcgctgtttccctcctacaaactcaaaatcatccaaggcaacgaactcgaaccgcgcgccgttgccgccctgcgccccggcatgaccaaagaccaagtcctgctcctgctcggcagccccatactgcgcgacgctttccataccgaccgctgggactataccttcaacacctcccgcaacggcatcatcaaagaacgcagcaacctgaccgtctattttgaaaacggcgtactcgtccgcaccgaaggcgacgccctccaaaatgccgccgaagccctccgcgcgaaacaaaacgcagacaaacaataaggaacacac

SEQ ID NO: 4980 - protein, 135 aa, Neisseria gonorrhoeae
TSRFAQKGSPVNKTLILALSALFSLTACSVERVSLFPSYKLKIIQGNELEPRAVAALRPGMTKDQVLLLLGSPILRDAFHTDRWDYTFNTSRNGIIKERSNLTVYFENGVLVRTEGDALQNAAEALRAKQNADKQ

SEQ ID NO: 4981 - DNA, 1191 bp, Neisseria gonorrhoeae
gtgtttgaagccgaatatttaaccgccgaaatcgtccaagaggatgttttcgtcttccacgcccaagtctttgagcattttgatgacggactggttcataatcggcgggccgcacatataaaattcgcagtcttccggtgcttcgtggtttttcaggtggttttcgtaaaccacgttgtggatgaagcccgtgtagccgtcccagttgtcttcaggcaatgggtcggacagggcgacgtgccaagtgaagttcgggaattctgccgcgagttggtcgaagtcttcgacatagaacatttcgcgtttggagcgtgcgccgtaccagaaggtgattttccgtttggagtgcaaacgtttcaactggtcgaaaatgtgggaacgcatcggggccatacccgcaccgccgccgataaataccatttcggcatcggtgtctttggcgaaaaattcgccgaacgggccggaaatcgtaactttgtcgccgggtttgagcgaccagatgtaggacgacatttgtcccggaggtgcattgggtacgcgcgggggaggcgtggcgatacgcacgttcagcataatgatgcctttttcttcaggatacgaagccatagagtaggcgcgcaaaatcggctcgttcactttggaaacgtattgccacagattgtatttgtcccagtcttcgtgatattccttgggaatgtcgaagtctttgtaggcaacggtgtgcggcggggcttcgatttgaatgtagccgccggcgcggaaaggaacttcttcgccttcgggaatggcaagcttgagttctttaatgaacgttgctttgttgtcgttggaaatgacggtgcattcccattttttcacgccgaacacttcttcgggtacttcgatgtccatgtcggttttgacattgacttggcaggacaaacggcagccttcgcgtgcttcgcgtttgctgatgtgggacagctcggtcggcagaatgtcgccgccgccgcttttcacgacaacgcggcattgtccgcacgaaccgccgccaccgcaggcggaggggacaaagatgccttggctggcaagcgcgcccaagagtttgccgccggcgggcatagtcagttctttttcatcattgactttgatggtgatgtcgccttcgctgaccaacttggatttggcaaacagaatcatcagtgccaaagc

SEQ ID NO: 4982 - protein, 397 aa, Neisseria gonorrhoeae
VFEAEYLTAEIVQEDVFVFHAQVFEHFDDGLVHNRRAAHIKFAVFRCFVVFQVVFVNHVVDEARVAVPVVFRQWVGQGDVPSEVREFCRELVEVFDIEHFAFGACAVPEGDFPFGVQTFQLVENVGTHRGHTRTAADKYHFGIGVFGEKFAERAGNRNFVAGFERPDVGRHLSRRCIGYARGRRGDTHVQHNDAFFFRIRSHRVGAQNRLVHFGNVLPQIVFVPVFVIFLGNVEVFVGNGVRRGFDLNVAAGAERNFFAFGNGKLEFFNERCFVVVGNDGAFPFFHAEHFFGYFDVHVGFDIDLAGQTAAFACFAFADVGQLGRQNVAAAAFHDNAALSARTAATAGGGDKDALAGKRAQEFAAGGHSQFFFIIDFDGDVAFADQLGFGKQNHQCQS

SEQ ID NO: 4983 - DNA, 615 bp, Neisseria gonorrhoeae
ttgtcaacaatattcacgatttcccattacaaacctcccgtacacccgcttttttccgtcccaaaaacacaaaataaatcaacactttcatttctccgcaaaagcggttataatcacgccgatttttcaacttttgacgaaaaatggccacggggccatttttttattatgtacatagggagcagcatggatattcaaaccatcctcgaaaaaaccctgcccggcctgggatacgaactggtcgatttcgaactggccgcgcaaggaacattgcgcgtgttcatcgacaaagaaggcggcattaccgtcgaagactgcgccaccgtcagcaaccacttgagccgcgtcttcatggttgaagacatcggctacaaaaacctggaaatttccagccccggactcgaccgccccttgaaaaaagccgccgacttcgtgcgctttgccggtcagaatgccaaaatcaaaacccgcctgccgataggcggtcagaaaaactttatcggtaaaatcgaaggctgcgaaaacgacactgttaccgtttccttcgacggcaaaaccgtacaaatcgaattgggcaacatcgacaaagcccgcctgcgccccgaattcaaattc

SEQ ID NO: 4984 - protein, 205 aa, Neisseria gonorrhoeae
LSTIFTISHYKPPVHPLFSVPKTQNKSTLSFLRKSGYNHADFSTFDEKWPRGHFFIMYIGSSMDIQTILEKTLPGLGYELVDFELAAQGTLRVFIDKEGGITVEDCATVSNHLSRVFMVEDIGYKNLEISSPGLDRPLKKAADFVRFAGQNAKIKTRLPIGGQKNFIGKIEGCENDTVTVSFDGKTVQIELGNIDKARLRPEFKF

SEQ ID NO: 4985 - DNA, 147 bp, Neisseria gonorrhoeae
ttggaaggcatcggggaatacgccctatttattttgataattgtttgtattttaaatagaaaatttgtcatgccgacagcttttgcatacaatgcacgcatcccgaacagcgttacagaacgccgtttaaccgcacgaaacccaaat

SEQ ID NO: 4986 - protein, 49 aa, Neisseria gonorrhoeae
LEGIGEYALFILIIVCILNRKFVMPTAFAYNARIPNSVTERRLTARNPN

SEQ ID NO: 4987 - DNA, 462 bp, Neisseria gonorrhoeae
atgcaaggcaatcaagctgttgttgattacatgaacgaattgctgtccggcgagctggcggcacgcgaccaatacttcatccactcccgcctctactccgaatggggctacaccaaactttttgaacgtctcaatcacgagatggaagaagaaaccacacacgccgaagacttcatccgacgcatcctgatgctgggcggtacgccgaaaatggcacgctccgaactgaatatcggcacggacgtggtttcctgcctcaaagccgacctgcaaaccgaatacgaagtgcgcgacgctttgaaaaaaggcatcaaactgtgcgaagaggctcaagactatgttacgcgcgacctgatggttgcccaactgaaagacaccgaagaagaccacgcacactggttggaacagcagctgcgcctgatcgagctgattggcgaaggcaactactaccaaagccaactg

SEQ ID NO: 4988 - protein, 154 aa, Neisseria gonorrhoeae
MQGNQAVVDYMNELLSGELAARDQYFIHSRLYSEWGYTKLFERLNHEMEEETTHAEDFIRRILMLGGTPKMARSELNIGTDVVSCLKADLQTEYEVRDALKKGIKLCEEAQDYVTRDLMVAQLKDTEEDHAHWLEQQLRLIELIGEGNYYQSQL

SEQ ID NO: 4989 - DNA, 495 bp, Neisseria gonorrhoeae
ttggctttggtagtagttgccttcgccaatcagctcgatcaggcgcagctgctgttccaaccagtgtgcgtggtcttcttcggtgtctttcagttgggcaaccatcaggtcgcgcgtaacatagtcttgagcctcttcgcacagtttgatgccttttttcaaagcgtcgcgcacttcgtattcggtttgcaggtcggctttgaggcaggaaaccacgtccgtgccgatattcagttcggagcgtgccattttcggcgtaccgcccagcatcaggatgcgtcggatgaagtcttcggcgtgtgtggtttcttcttccatctcgtgattgagacgttcaaaaagtttggtgtagccccattcggagtagaggcgggagtggatgaagtattggtcgcgtgccgccagctcgccggacagcaattcgttcatgtaatcaacaacagcttgattgccttgcataatatctctcttttcttaatttgggtttcgtgcggt

SEQ ID NO: 4990 - protein, 165 aa, Neisseria gonorrhoeae
LALVVVAFANQLDQAQLLFQPVCVVFFGVFQLGNHQVARNIVLSLFAQFDAFFQSVAHFVFGLQVGFEAGNHVRADIQFGACHFRRTAQHQDASDEVFGVCGFFFHLVIETFKKFGVAPFGVEAGVDEVLVACRQLAGQQFVHVINNSLIALHNISLFLIWVSCG

SEQ ID NO: 4991 - DNA, 471 bp, Neisseria gonorrhoeae
atgaaaggcgaccgtttggttatccgcgagctgaacaaaaacttaggcttgctgctggtaaccattaaccaatatttccttcacgcccgtattttgaaaaactggggctttgaagaactgggcgaacatttcttcaaacaatcaatcgtagaaatgaaagctgccgacgatttgattgaacgcatcctcttccttgagggattgcccaatttgcaagagctgggcaagcttctgatcggtgaatctaccgaagaaatcatcgcctgcgatttgaccaaagaacaggaaaaacacgaagccctgcttgccgccatcgccacagcagaagcgcaacaggattatgtcagccgtgatttgttggaaaaacaaaaagatactaacgaagaacacatcgactggctcgaaacccagcaggaactgatcggcaaaatcggtttgccgaactacctgcaaacagcggcgcaagaggac

SEQ ID NO: 4992 - protein, 157 aa, Neisseria gonorrhoeae
MKGDRLVIRELNKNLGLLLVTINQYFLHARILKNWGFEELGEHFFKQSIVEMKAADDLIERILFLEGLPNLQELGKLLIGESTEEIIACDLTKEQEKHEALLAAIATAEAQQDYVSRDLLEKQKDTNEEHIDWLETQQELIGKIGLPNYLQTAAQED

SEQ ID NO: 4993 - DNA, 120 bp, Neisseria gonorrhoeae
ttgattcaaatcaatttagattttattcgtaaaccggcaaagaaaaacggcatacccgtttatacggatatgccgtctgatgatgcaggggactgctgtatttggcagtggtttgtgttt

SEQ ID NO: 4994 - protein, 40 aa, Neisseria gonorrhoeae
LIQINLDFIRKPAKKNGIPVYTDMPSDDAGDCCIWQWFVF

SEQ ID NO: 4995 - DNA, 318 bp, Neisseria gonorrhoeae
atgatgggcaacaaattgactctgcctgccgaattgcctgacgaacaggatttgcgggcggtattggcatacaatatgcggcttttccgcgtgaacaagggttggtcgcaagaggaattggcgcggcaatgcggtttggacaggacttatgtgtcggcagtcgagcgcaaacgctggaacattgccctgtcgaatatcgaaaaaatggcggcggctttgggcgtggcggcgtatcagttgctgctgccgccgcaggaacggttgaacctgatgaccaattccgccgatacccgacaagtgccgtctgaaagcggtatt

SEQ ID NO: 4996 - protein, 106 aa, Neisseria gonorrhoeae
MMGNKLTLPAELPDEQDLRAVLAYNMRLFRVNKGWSQEELARQCGLDRTYVSAVERKRWNIALSNIEKMAAALGVAAYQLLLPPQERLNLMTNSADTRQVPSESGI

SEQ ID NO: 4997 - DNA, 570 bp, Neisseria gonorrhoeae
atggttcggcggtcaaataccgctttcagacggcacttgtcgggtatcggcggaattggtcatcaggttcaaccgttcctgcggcggcagcagcaactgatacgccgccacgcccaaagccgccgccattttttcgatattcgacagggcaatgttccagcgtttgcgctcgactgccgacacataagtcctgtccaaaccgcattgccgcgccaattcctcttgcgaccaacccttgttcacgcggaaaagccgcatattgtatgccaataccgcccgcaaatcctgttcgtcaggcaattcggcaggcagagtcaatttgttgcccatcatttgtttccggataaatggttaaaagttaagtatttgctgttacggattttacttcacataaaagccaaaaaaaaggggtggcggcagccacacccaaacacacacacacatcaagaggaaagaggtaaaatcaagacggattgggaaacagcaaacaaacaatctagatttcatatcggtattatcaaacaaaaaccgttatcgagtattgattcaaatcaatttagattttattcg

SEQ ID NO: 4998 - protein, 190 aa, Neisseria gonorrhoeae
MVRRSNTAFRRHLSGIGGIGHQVQPFLRRQQQLIRRHAQSRRHFFDIRQGNVPAFALDCRHISPVQTALPRQFLLRPTLVHAEKPHIVCQYRPQILFVRQFGRQSQFVAHHLFPDKWLKVKYLLLRILLHIKAKKKGWRQPHPNTHTHQEERGKIKTDWETANKQSRFHIGIIKQKPLSSIDSNQFRFYS

(The sequence listing continues in the following parts.)

The invention claimed is:

1. An isolated protein comprising the amino acid sequence of SEQ ID NO: 2.

2. A composition comprising a protein according to claim 1.

* * * * *